United States Patent 7,868,149 (PLANT GENOME SEQUENCE AND USES THEREOF) - sequence listing, part 47

SEQ ID NO: 25002 - DNA, 25333 bp, Oryza sativa
  unsure (1)..(25333): unsure at all n locations
aaaataaaagttatagatcttgatgagttatacaactttgttgttgatgactttttcagttaaagtcgttcactaacaaaaaaaaattctatttgaatttctcaaactttgaatttcaaatttcaaatagtttaaatagagtcagatggagaaatgaccaaaataaaaattttgcacctcgatgagctctacaactttggtttcagtaacttttctatttgaattcatttatcaaccctaatttttcttcgaagttatcaaattttgaaaattcaaaatttgaattgttcaaatgaacttatttgtacaaaggaccgatacaatagttgtagatctcgatgagttatacaattttgttgtttatgatttttgatggttgtgtatgtgaatgaatgtatatgaaagggggatgttggggtgtgacatatcccagcctagggcttaaaaggattaatagaatactcataccaacaagttacaactactcttccggaagccgatctccaaagaactttgatattaaacgtgcttggcatagagcaatttcgggatgggaggaaggacaaaagaaagattggcgtgagagaggtgggacggcatggcaaggctagccaaaaataaaaattattttttaatttatttttttttgggattatactcatctgtgacgggcattaacttaggcccgattgagatgactcatctgtgacgggcattaacttaggcccgattgagatgactcatctatgactatgacgggctaagttaatgcccgtcacagataagggtcatctgtgacgggctatattttaggcccgattaagatagatcatccgtgacggcctatagtttgacatgtcgtctgggtcaaagctatcggtgatgggctttaattagggccgaattaaaaaggttcaatcgcttacggccggtntgtcggaattaaattacttttcacattagtgacttctagcctgtgacggacgccgtgcccaattgagatgggggttgccgcccgattgaggtgatggtatcctttctagtgaaataaactacgataaaaaagaaataactccaaaattaaattttaaaattcaaaattttcttctaagcataattgtaagagaaacaatttggctcggagtttgaatcgattagatatgtaaaactaagattcaactccaaaataccttgttggtgtccttgacattgtacaactaagacggtgtttgaaattaatgaaaatagagaggatacatgaattgagaaagtcattagcgcatgattaattgtcttttagttattacaaacttgaaaaataggtttatttgctattttaaagaaacttctatttagaaatttattttctagttttaattaattttttttcatttttacaaactccgataaaatgattacttaaaaataaacttattttataacaaaaggaaggggctagaatgaacttattacaggacggataaaatagaaatcactattttttctatttatttttcatttagtctataagaacaaagtcatgcttaactgattatagataaccattaaatttgttgaggggcgttttatgcataatttagatctgttgggttctacatttttaaacatcatctattactgttgcttgatctttctttttcccatttcatatatgcctaaggatttttaaataaacaatacaacatttatgtaccccgaattacacagtatccatgggctatgcaatcatcgtgccaaaagacacgcttatttccaacttccaagtatgcgctagtagtagtgctttggtatgcgttttccctcttttttttctatttaattaactgttcaccacaaggctgcattaaaacatagacaaatatactgcatataataaaaaaagacaaatatcagatctccctatatgactgagaaccatattggtttccctgataagtccagactaaagtcaaaatttaaatttttaaacttaattttaaagttgattttaagatatttttcaacgtagtttttatttcagtattgcttctagttcgctaacaatacatgtataaaagtttaaactataaattaatttctatttttgataagccgttttgacttagtagaaaatatgtacaactgatgagagcattaatctgtgttcgacagtgtgagaaggtgaaaaaaaatctcgttttctatactgtacccgaactaataaatgatgtgttttttcaaaagaaaaatctataggaaatttacttcaaaaattcatattaatccattttttaatttaaaataagtaatactacttaaccacattattttgtgtatcttaccattgttctattttctcatttactcaaacacactcaaagcggtagttattttgggataaattttaaacccaaaagagcagtttttttttattgtaaacagaggagtaaatttcacctttagacatttttttttatcgccgttgtttctatttggatcacctttcaaccatttttttcagtgttgtccggataatactacctttgtcgcattttgtaccatcctcaaccgttttatccatttacatctaaattgtcatatatcaaagaacggactacgacatacagctgagggagtttattgacaaataagaacaagagtactcgagcttgttcatatgcatgcaccaaaagaaagtaacaaatgcaagattagcccagtccgaagtgaaaacattggtcaaaggtgatcaaaagtgaaacatcggtaataaaatgtggcccaaaataaaaatttactcaaaagaactttataggaaagttatcttaaaaaatattaatccatttttcaggattaaaaaaattaacactcattaatcatatgctaatgacttatctcatttttcgtatctatcattcttctcttttctccttcactcaaacacacccttaggtttagtagttattttgggacaaattttaaacccaaatgagcgattatttggagatggagagagtaattagaatgtgaagtgggcccatagggcatctatataagtaattttcttatctattgttactagggtaaaaaatcaagagaaatattaattaataaaataaaaggacttaaacataaaaggtagagagctgaaatacaaaatctaccaacggtacattaaggttatcgtgcatcgtgaaacatatgtgcttctattgtgaatacctcaaagtgcatgatcttcacaagaatttgataaaagttgagctaattcctataaagtctagcaaaatattttcattaattgcccttgccaatatatacaagccatacagagaactctaaccagcacgtttattttcccgaagagctagctcttgccttcgctaagaatcgttaattatatggaagaattgctaaaaagtgttacacgtgaacgtttacaacattggccaaataaaacattctgcattttagcacaataatattttttacttcttggcccattatacagcaaagtcatgtctcttttgatatattattttgagcttagatttttttttccaagtttccgtttatctaagtgaaatatgtttgtcgggaaataaacatttccatttttttccaactagaaatattgcagatcttttttccaaataaaaatatcacagataccaccgattattgtcgtttggttctttttattccatttcatatatatttaagaaatcaaactaattctaaataactctacaacatttatatatcttaaacgaaaaatataaatattcacgggtacttttagttggtgagccaatggcgcacccattttctagtttgtctcgaaattaaataccgtgaccgtgtcaggttccacattattcaacgttcctcattacgtgttgctgtctgaaatgtgagaaggacacacctacctaagctgacagcaactagggtgaaacggatcagatattaaataatattccatctgatccgatccgaatccgtccgaaataaggatatgatattggtttttaaaaatctggcggatatggatgtggatatggatagtatgatacagatgcggatgaggatatggtatatccaaaatccggcggatacggattatccgacatttttattggattatccgataggtcctttaccggataatccaaaattataaacacatataaccactctatctattgcatataacataagttggtccatccaatggcctaattcatctattacccgagatttcttactctgaggcttttaccgtttcatgtcacacttgtgtagctgtatttttttatattatgaacatcaactattcatgttgtttagtacttaagcacgtaattattacaatgggtcgtttattgactattgtattattgtcccttacattgctaactcaatgttgtattaaatgtatacacacgtaacatccgataaatttaatccgtttcttaaccgattccgcaccgactctgcaccatttccgacatccgaaacaatccactccgcatccttatccgtacactatccgcatccgctccgaatccgcttaaaaaatatagtttaggatatggtataaccactgtccgtccgaatccgctccgttttcaccgttagcaacactatcctgtacgataaatacaatatacctacctgtgacccacgtaatcaagcctgacgttagcacaatcgtataccataaatacaattcgatgatataattagcatgaggacatagaattctaattaaactcttaattaaacttacgttcgagatgttgctttcccaagcgatcaagtgatcaagaaagcgcgcaaagtggatcagtccgaagacaaagtcctcaaatccatgattccatgcacagtatgaaaatgatgtcaatcaaacatgagtggggcctgctttgcttcttcctctgccaaaatattatttgcattgctttttcaatctataaatccagggctaatttcaggatcattaattagttacggagccgagatggaaaaggaagcgagcgcgatggttgcgaggagaagcaccagccgccatgattggaggaggtggtggtggcggctgctgcctctcgcctgctgcttcgtttgttgggtggcctccacggcggtgacggtggcggcggcagccggcgtcgccgtgacgagccttcctggtttcgacggcccactgcccttctccctggagaccgggtatgtatactgtatgcaatgaatgactgttcttccaatcgagatatgtctcttttttttttctatttgattcgcgaaatgttttgatatgaaggtgcatgtattgtcagtggcggagtatgccaaaaaaaaatataggtgggtcgaacacgcgagacatataaatcatcatacatcaaagtagcagttaaacaaagttaacaccattgaattatcatatataaaagataggaacaattttgtttttaccactagtttgatatccaatattaattttacccctattttttagggtttttgtttttacctcagtttttccaaaacgaaccagccgtttattcctgtttttaacggaagtgagcggagctggagttattgcggtaaagaaatagaaaagaagaataaattatatattttgcaaaatatgtagtgacctttgttcctcctggttattttgcaaatgtttggttgtatcgccccgagaaccgctgcttcctctccccgatccccatctcaaacagtagaaagtgaggtggcggcagcggcggcggcggtgacctggtcgggcgatggcgacggggagcaagcggcgtcggagggtcggccaggcggcgggagcagcagccgtcgtcggcgacccgaccaggcggcggcgacctgaacaagccacgaggagcaagaggccgccatggctgagaggagcagccgtcgtcggcgacctaaccaggcggccgccacaggctcgcactcagcctcgctgctgccgcccgttctgcttgagctcattctttagattgtcgttgtagaacagaatcacttctgtctaggataggatccattgtgattgctgcactgccgcactggtggctaatgattgttcattcattctttttttttacatatagtaaaaaaattgaaatgctgccaaaattatcaaaatcctgaatctgatcatgccactattatgttgatattctatccaaattattatattagtcaaagattgtcaaaatcatttgattttcgaaatgttccgagccacatgtataatatagggataaaaacacaatgaatgatggttgcaaatgtgcaacaataagtgagggtataaacgtcattttgccaataacttaaccatataaagtaaaggtaaaatgtgctttcgttttgaaaaacagggaaaaaacgaaaaccctaaaaaagaagggcaaaattaatattggatgtaaaagtaggggtaagaatgaaattgcccctaaaagatattatgagagctgagaacatttggaggcataggtaagtccatattccaagttttcaaggcctggaatgtcttcttaattgtatcaacacgaagtcctcgaaatatctcattttcaacatagcacaacatcaagtcattgagccactcatctgacatcctattgcacaaatatgtcttattatgttcatagctgagaaagctctttcaacagatgcggttgccacagataaaagcaatgctaactcaattagacgttagactaatggaaaagtcacgttcttctcagtttctactatcttaatggccaaacttccaaaataatggcagccaacaaaatcatcaattcttggaacatgtagaatgaaggtctcaagttgatcccttatattagaaggatcagcatttgagaaatcttgatcatatatttcagtcaagcgagcaatcttatcaatatcaaacttagagaatgggtccttggatcaatagaagaaaagctaactagtagctctgatgagatacctcattgaagcgatgattcatctcagtgataatagcatcaagagctgcaaagaaagtgtcaagacgctaataatgctcttgagtgattaagttcccttgcattcttgatcgaccaaatcttggtattggctcatccatatttggcactggaatctttttttttttgcatcacaaaatgactaattacctcttcaaataatggctgccaagcatcatttctcaaattgaccaaacgtgtcttcacatcaacaagcaatgacatggcttgaacaataatgtactatatattcatttaaaaaaaactgttcgttcattctaatttgggtcctaccacaagcagtcccccttctgcattgatcatgcatttattttgagatttattattgtgaaccctccatgttttttccttactgtgatttgtaaacttggccgatttgaaggtgcccctcaagcaatgtgtccccgacatgtttgcggtgtccaccttcttcgtgaggggcaacggcgcattgactcacttctagacgtatcgatggattgagggtcacttagtggcctccttaataccggaccttctccttatcgttttcccacgtctttgggcctcgctgacggttgcttctggccttgccgaaaactcatgggttagggacatccgtggcgctctcacagtccctgtcctctcccccgggactctcgccctacggatgaacaagatggagctacaacataagacatacaaagtatatactactcaaagaacatatattcaataaagaaatatataaaccgtgagcataaataaataaagaagataattctattaattcaactatagtcttacacaaagaggaaagtactagagacatactcaaaactccgagaagactatgggaccgaagctcctaagctttattcatactaaaaactatagagaatacaaagtggaagagtgaattgctcctttaggtgtgtgttgtgaagtgaaatgagctcctctatttatagcctccgaatgatggtagttaagtcggttgtaggtcaggaaacgggcataactgctagcaagagtgaaggaggagtcgccacgtggaagctcagtggcggggctagcaagcctagttcggctgaaccatggccaccacctttcgccatcgcctttgattagaggatgacatgtgggcccctatgacggttcccggttgtttgttcccattctaagtcggtttgcattgacttgtgggcccatcaatcctcgtactagcatgtgattcgccggaagtgtgtttcttcgtatgccggcttcatttcctcttcactttagtgtataattcttgcatccaagttaattcactaatcctaatacaactacattatttattattgatatacgtgtaagaaatgctaattttccctttattcattgtgctagttagtggtcgaaattggtacgtaatgaccatcaacacagtggtgaggacaacggcttgggctagggggcgtagctatgatgagtgaactagccctaaactagatcggtcttaatctagtcaaaccacctccttgaagagtatctatttgacaacgtcacagatggtaaccatcggtgacagtctatagagggacaccgtcacggatggtagcaaaattctatcttcctatatagttggtacccactaagaggtatttactcctataaagcaatacatgcaagaagccacatcatcaataattttaagccatcagatgatattagtacacagataacaaccgttggatcaagaagctacttattcatcaaattcaatcatttattagttatccattcacctccctttgcttcacctcatagtcacacatagcaccattacatattttgtgcataacaccattttttcttaatacaactcaaattattgtttaatatgtgtgttctgttttattatgcaagatataaagatagcatataattattaggtatcgttatctgaatccattttcagaaaaaacttgagtgaagtagagagatgcaaattgtaactacaatgatacccatattgagtatgaaaataatattcatatattataacaatacataatgatgcttggaaaaataaagcatgaattgtattgtaataacataagtcatatataaatccatattatcatatattttgtatatacatagagtcgcacctaaccatttaaaaccatgatttcgtttgacgataaaactacaaaacccgcggtaaagacgtggggtgccaactagttgtactaaatgattgaagcttcgcaacaatagcaaatcaaaataatacaaaggcttcaattacgaggataggccttcaatgtgatctgaacaaacatacgccacgtcttctttagtgtcatcgtctaggtctatgtgtgaatcaacatggaggtttatgctgtaatcgtccttatcgccgatattgtcaaccccaacaatcattcttttgtcattcctaaagatgcgcagcttcttgtttgcacaacctattttgcaagtacaaatggttcatccacgtaactaatcctgcttagatccaaatttgtcaaaccttcctaattgacttttactccagtgcataaattgacccagcggcaacaaaacaatgagactttgaacttcgtgtagttcagctcacagatcagctttatgcggctgtagtttgggttggacccaagttgatccagaaatgcctatatacgaaccccgctgttttataatcttgtttgacggtgtaaagtgtgtatccattaatatcgtatcgctgccatgtgtcaatatccaaaaacagtcctactggaaaccatgttaatgtttcgcttacgccttctgtcaatgttgcaatatgattcttaaaccattcgttgaaatgggagttatggttcttattgatccagttatctgatcgactcatgttctcctgctggatcttcattacatgttcttcaaagtatggcgtaacttctatcatattttggagcatagagaaataggcctactcataggctagttgggcctgctatattctttttttgcctactgtgccgacatcagataaccttccttcatgacgagatgttagaactcaaacatgtaatcaatgtagaactcaataacctgctatgtcatgtaacattcaatgatgctcctcttcgctttagctctattcctaacatacgatttcagaattcccatgtacatcttgaatgggtacatttcgcttagaatatgtgggccacataattttgtttgcttctcaacatgaacagggagatgaacatgatatcgaagaaaggcagtagaaaatacatctccaggtgatagagggttttgacaatatcttcctacaagctatcaagaccaattgtatctataacctttgactaattgcattgaagaaggcgcacagatgcatgattgtgtgatagaaattagttggaagaatattccttacagcaactggtcagagctgtgtgattaatacatgacaaacatgggatttcattccaaccagttttagatcgtccaacaaaacatacttccatatcatcgctgaatagcccgaaggaactttatatcattcaagcaggattacatatggatcctctcttccatggccaatttgtgtcaagcaagagggaggtacgctcttgctatgtctagattagttaatggagtgagttcacttcaaatattaatctcctataaatctagatgtgcgttcaatccatcttttatctttgctggactattcaacaatagccctatcaaactatcatactcattcttttctacatgtttcagatcaatgcaatgatgcatctcaatatctttctagtatggtagtcactataatatgtccttagtattaatatgttttcttttcttcccaaactcattgcatatgtgttctcgtgaaattcgtcgcacacggaggcctaggagatttgcatcgatttagtgcaggtcctaaatcttgatgaggtttgggcatgccaattaatttgattccgcaactaacaaggtggaaatcgatcgatgatgaagaagtttttcatcaacttgggaagccgataatcaacttagggagatcgaaactaagatcttgctagaataaaaggtggcgatgcatcaaaatttgatagcagctaactttgtatgttttgccttacatccgatgtatagaggtgtctctggccaatctggtgaacttcatgtaatctttcttgttgtaagatggcgaacaaggaatagtcatgcgaagcgcttcccaaaaaccatattgccgccttctcccgatgcagggcgttgaaggcgaaggttccagagacctgctctcccgatcaccagcgcacgccggcgagcgggatggagttgactataagcgatgatgcagtacagaagaggaggaaaaccctagattgattttacgtgtgttgcgtggagacggcggctcaactaatgtagagatattaggacgcacgtatgatcactactccgcataatcgaaccagacatgttgcgcataacttatctggactccacgccgtttcatgcactggattattcggagtgtttccaaaaaaacaaatctgaatatcccgcagcaaaacaaaacaccaaaaggaggcaacatctgcgcaagggtgacgaaccaattttggcggaccattcgacgcgtacttcgtgcactcgcgccgccatgccattccaggccaggtgaggcaagcgagcgagcatgcacgtgtgttccccctcttctctccacctcacatgcctcaagtggcaaggagagcatcctcccttatatagagatctctctctcctaaggtggtattaaacaccctatgcatgccatcagatgaggtgggcttgtaattttccaaagaattaatctttaaatgggataaggctcatctattaattccaactacccccaccaaatctcaaaatcccactgagatttgcctttttccaatgtactgtttatagaccagcggttcgatggagactaattaaggttgaatatccacctggaactccaagctacacttactcacaacttgaacaatggactacgccttaaattgcaagccttatgcaaataagtttcactcaaagtcttatctggtactagaagactacccttcgggtggacgtataagtcgtactccttggtctcttattaagcttcctagaagattcacccaaaatctccatagactgcgaccaacagtcaagctcacaaatgtgagttctttcaagaatgctctgcaggatagcatcttcgataattaaagccaacagaactcattaaggcatagccaacctgccttgcagctcacgagagtacatgcatcttcacttagagagagtttagattgctactctcctccagttaactaatgccttgttcttcccaggttctaattcgcgggatctctgatcacatagactgggttaccgcttgatgaggatgtaaggtcccgatcttccgataggtattgataagcagtcgatttgagcagagtcgtgacacaactcaatccgacttctaaatgaacatcctcctgagccccacaatcgcagcaccacgtctcctctggttatcaaccgtgccgaaacctggttgacctcaccgaaaaggctaatccctgcatgcgaatcgaagaacacaaacaagaacaagatagattgcaacagaatgcatatgaatgattaagcactcaaatttcgggttctacgaatcgatctagtggcaaaactattctcgacagattaatctaagcaaaacccaactctaaacgacgctggctactgaataaatatgattaggaatgtcgtagggttgccctagggggcacaccctattgggctaagcccacaactcaattacaaggcccaaaacccaaattagattccgactggatgaggtacatggcttgttttgcaggttcccgacagctcggtaggaattttgatgtgggaccaaaaccatctgaaagtagactccataagctttccaacaaatactaatgggccccgaaattccttctagatcagcagctaggtccgtttacagttgatgctgtcaagaggcccgaatccgaatttaaaacgtgtagaactttatctcttgtcttctatggaccaaaaagtgatgtggtaagatggaagtggacttagagaaggtcttgatttggtccccaataaacttctttaatcatccattcattccttacgcacagtctcttttctttcgcccaagcaagtacctctgcaaacgaaagcacacaaaactcattgtgtagcaacttttgttcaaatatataacaagtaaatcaaatatagaacatatgtatctttggttcattaatacataaggtaatcatggttatatctgagctagttgtgttcctatcatcctccccttcttgattggaaaccgtcctaggttttaggttgtcatggagcgtattgaacttacctttatctatcacaacatccggtgaagaacatttcttgatggccatatggttggatcctgaaatctttgtagtcgaaaaaccacaacactcctcttcttacaaaccaacttgtaactcatttaaacaactagaggaacttgatagagaattacgtatacgcatgcggtcctttagacaatacctttcatcatgaaaaggaggtgtagtcaaattagaacaaatatatactcgatgcatattatattctcctttactatcataattgccataacatgaaaaatcacattagaagggtatggtatttaagaaagatagcaatttaagctcttcattctcgctagcaatgtgaataacatgttcaaacgcaacacatggtctcaaaccatctccttctatgcattgtctatcacatttcgtgatagtcccttcgtgaaggatctaccaggttgcttgctgtttggatgtaatccaatggtataacttcggagtttctcaatctcctgacaaagttcaattgtcttttcacatttctagacgatttcatgttatcattagaactgttgactttgacaattaccgtttgattgtgacagttcataaaaatagctagcaccagtttttcaaccatagacagatccatcaacagaacacgcagccattccgcctcaacaatagcagtatcttctgccatcagctctgcttctatggatgacctcatcaaaatagtcagtttgcaagaccttcatgaaacagcaccaccacctgatgtgaagacatatccactagtggttttgatctcatccacatcagagatccaattaaaaccactatattcctctagtaacgcaggatacctagcacagtgaagccccaattccatagtaccttttagacagtgcatcactcactcaagcgcacgccagtgatcatctcccaggttagagataaaccggctcaacttgctcacagcaaaggagatgtcagtcctagttgtggtaggtaggtacataagtgagccaataatttgggagtattccaattgattcctagcaattctcttcttcttgcgaagcaacaagctaggatcataaggtgttggagaaggcttgctattagtagccaaagtgactcaagatcttctccacataatgggactgtaagagtgtaatcccatcctcacctctaattagcttaatgtttaggataacagcagctactcccaaatctttcatatcaaaattttgagataagaatgatttaacatcattaatcaactcaagatttgtccaaaatattagtatgtcatcaacatacaagcatataataactccctcaccccctccatggtgatagtacacatatttttttgcatcattgactgcaaagcctacagatatctgtcgacgggggatacccgtagaccggatatagagggtattggggtccgttggtatgaggatctacgtagtacgacatcaagccctaatctagttggtatgggattatatgatggaaaccgcagattacaaagggaataacataactcgatgaccccgatgagaacgtagttgagttgattcgactagatctcccgacgacttggcttctgtaggctccggctccgtaggctgtgggggatgtgttggcagtaatcttcgatgccttaggtcctttcccagggcgtcccttatatactgcgggtcagttgatatccaagtaggactcagagatatcggacccctcacgatatggtaacgacccagtctcgtccgagtaggactcctttcatccgcagatcctgcttctatcacgtgatacatttccttaacgtatacggaaactattcgtatacgcgcgggtataccgtatcggtacccatcgtacatccaaggatagagggtataccttatccgtaaccctgacagtagccgacttctgcttaaatgaactcatgttatcgatcgcgacttctaatgtcggaattgttgtcattctcttctggtcgatctcgctgtgaaaactgtagagactaagagtcatcgacaacactgcgtgaagttcaacggtcatgagtgaatttaaattgaagtctgaaaactgccgcacataacggacccagaattttccggcggcaatctctctcctttccttgggatacgtaccgtcggtagtgtgcttattttgggcatccatttgaagtccgttcgccaggaaactctcctgccttctagcgctcttcgtcttctccgctccccgcaaagaaaaccctagcccacttccttcatcctattctccggcgatcctccggcggcgatggatcttgagaagtcaactttgaccaccgcatccatgaagaagctctaggacgacggtgccctccccggtcgcgggaccttgcagtgggaggctggaggtacagtaccggaacccatcttgggttgcatggttgtagtcgaggattatatttcttgcggttttcttcctccgccttccgagtttcttcttctcgtcttgaacttctatggcctttctttgcttcacctgaaccccaactctatcgcctttctgagcgtcttctctcatctttgcgaggcctacattggggtagagcccttccttgatctcttccgcttttattattagctgcgcttgatggaatccagcagggtatctggatgtgttggattctgacttcaggatgccctgaagtcgcgttacatcacctactagtgcccctcttctcgcatcaagtggcggacgaggtggttctatctccagatagagaactcggatcccgtccttgttgtccctgaggagcaaccggaaaaaattccagagtggaccaccaaacccaccctaactccctccctccaatcctttattgatatcatcgatgatctccgaagacgggggttgtcgggatacgaagtcgctgccgacttcgtaggtcggcggattcagccgctgcaggcccgcgcccatccagcctttgattattctgggccagaggacacgacccgggtctctcctgacttaccgagtttccgttctcgatttattggtctaaacagtgacatcgtggggcgccatgttggtcaaataatgatcagcgcactctcgggggtgggcaacatccacatcccaccttgcgacatggacgcggccgaacgcgccaacacgattaatgtgatcgtagtcgatgattcctttatatcttccctgtctagactgcaccgtgacttcaagttatgcaggcgctccctttgacggacgtcatcgggccccttgtggaccaccaggcagcagcatcgttgaaggagagcgtcaccaaggaggcatctgacgctgtcactgccaccacgagtggcagcaatgttccgaagaggggaaggaaattctcctctgtactcgggactcgccggaaggcgacaaactctgtggtaagctcttctcttgttctttaacgcgtagtcggaacgacttgacctcacaccatttcatcttggtcaggactcggacgcgtctcctccacctcagcgaaggcaaaggctggtgacgatcggtgagaagtatgtaaatgttcttgaggtcttttcattctcgaagttgtgatcgactagcctcatgaagaaaaagaaaatcttcgctggaaggcgcgggcaaaggtggtgcacggtgggactgatgctgtctctagcgcgtcccctacggcgacttcgacagaagtcgtggtcgctactaaggaccaggaggcgacaccgagtagccctgtcgtcggcctcatgcccacccggggcttgtccaccgatgccctcacctggggggagctccaagtggagatggagcgcatcctccaggccggcgctcgtggcataggtcacgagatcgaggaggccagggcggtggcgttgtcggcgaaccagcgtgccgaccagctggcacgcgatctggcggaggcccgcgaggacctcctaaagatgagggagctggtagccggcaacgagatgcagcgacgcgggctcgaggactggatgtcggagctcaagggccacatgatcaacatccgcggttcgctgcgaacgtcgttcaccagcctgcaccaactcgccagggagtgcggtgtcacgactaccatcccggcacaccccgatgagttctcgttgacgtcatcgctcacggaactggctacggcgatggaggagatcccctccaagcactcggccatgatcggcgaggagacgtccaacggtatatgcaccaaggcgtgccatgtccttgcgtgcatgaggctagcgcattccgatctagaacttaagagggccttggatcagggggtggccgatgacgcgcgcaaggttacgatggaagaagtcggtgacttgggggagtctatccactccctttttgaagagtaggatatccatttttctttgtactccttaatctacatgcttgtaaaactctatgcgggtcccaactgcttttatcttgaacatctgtttcccttgtttccatagcatgtgatcctgagtacttttctcgttgtagatatgctgttttcaaggatgtccagcagcgtgggcagcccgatgtgccggtggtcattccgctgctcacacttgagccacatacgccgctggtggagggcgataagagcccgtccgtggaaacaaacatggccatgacgtccttaggttcgtgccttgatttccttcgctcctcgtgttcggatttaattaattagttgtgttctcgagagagaagagtagcttgacttagtccattccgtgttgggaagattttgagaacatgttggctgatcgagatcgtcgaatccagtactggaagacgaaactcgacgtgaccaaactcgaaagggccatggtggaggtgaagaaggactaggccgttgaagctcttcgaggtcgcgaggtgtggttcaactcgtacctcaagagctgctacacggcgatggcgggggtttgcaaggagcttcgagttcaccatggaaatcccgaggagtcagcggctggctacatctcgtggttgaatggggcctatgcatagctcgaagggattggcaagcgcatcgatgaggccttgaagcaggagtgtcgtcgagcgagccgttacgccggagggcatgtgctggcctatatccgagatctccgcccgcagctgcaccttgagttctttcgtgaagggttctcgcattatcggaggacgcccgcgaagatcgatggtcttgcgcagtcgatggcgccacttgccgagaacgttttttgctccatcgattggcgttggccgtcctggtagcttttgtgtcctatagaaaatatctcaaggaagcatgtaacatactttgaagtatttatgacttgtaaggaatacttgtaaaatagaaatagaatgtatctaactaaatttccttactctgggtatgttgtgtatgagtgttttctcactttgcgacttcggctagtcacttgagccatacactctccctagcccccacccttgtcatcggagaatcgttctcgggggataaggctcttggacccttgacctgccttggttgaaaaagcactgaccctagcccccaaccgtgaagttggaaaactcaatttccgattacacggcttggttaatacgcactgtgagaactcgtagatgaccagatcttacatggtcgtttgtctctgcatgatccgacaaggccttatccgctctaggcgtccccagccgaagttcccttaggttccttaaaggccttgtcaggatggtgtaaaaggacatgaggataggtttcaactttaggtgtcatcgtggtctgggatcgtcgggaatgaacactttgacaatattatttacctgaaatcaactttattgaaatcatgagatgtcttacaaatatggatattttttatttatacataaaatttacgtagggaataacagaactcgatgatacgacgagaacgtagtcgagttgattcgactagatctcccgaagacttggcttctgtaggctccggctccgtaggctgtgggggatgtgttggcagtaatcttcgatcccttaggtcctgcccagggggtcccttatataccgcgggtcagttgatctccaggtaggactcagagatatcggacccctcacgatatggtaatgacccagtctcgtccgagtaggactcctttcgtccgcagatcctgcttctatcacgtgaaagatttccttaacgtatacggaaactattcgtatacgtgcgggtataccgtatcgttacccatcatacatccaaggatagagggtctaccttatccgtaaccctgacaatatcaatgttctatcaaatttgcacaccttgccttctataccttcaactataaacccataaggttgatccatatagatctcatccagctctacattaagaaaagctgtcttaacgtccatttgatgaatgagaagaccatgtgaggcagctagggaagtagtacatgaattgtggtcaatctaccaacaggtgagtaagtgtcgaagaaatcttcgccttctttctgagtatagccctttgcaacaagctgatccttgtacttttcaatagtaccattaggccaaagctttttcttgaacacccccttgcatcccacatgtttacacccatagggtcactctgtcacctccaaaatcctgttagcaataatggaatccatttcactatggatagcctccttctagtagtcagcaccaggagatgcgtatgcttctaaaattgacttagactgtgttcatttgggtgtgttgggatcaaatctcctgtgcacggaaaacggagtggtccattagcgcgtgattaattaagtatttattaaataatttttgaaaaatggatcaatataattatttaaagcaactttcatatagacaattttggcaaaaaagcaccgtttagcggtttgaaaagtgtgaatgcgggaaacgagggaggtgagttgggaaagttgggggaaagagctcaatcttaggagtgtcatctacgaggtacacagtgaaatcatgactaaaagacttagtagtcctttgtttcttacttctccaaggagtctcactgtcatcctcctcagtcatcctcctcagtgatatattcatgtgtatgttcagtttgtcctggtggtgtgattgaactgagaattatttcacaggattggctagaagtactgtgtgtatcctttattggaaaaaagctttcaaagaaggtagcgtcatgagtctccataattgtaccaacatacatgtgaggtacctccgatttaactattaaaaatctataggcaatgctgtaatgagcatatcctagaaagacacggtccacagtattagttccaagtttgcacttcttcgttattggtacattgacattcaccaagaacccccatgtgcacaagtaagaaagtgatggttttctctcgatccattgctcatatggtgttttgtccttatttctattaggaaccctatttaagacatgattcgaggtcaacaatgcctccccccaccatgcctgtagtcccacagtatccaacatggcattcaccatgtcagtcagtgtgaacagggaggcgtcctctcatgtatgatgccatgtttctcacagaataagtcaaactcgtttgagaaaaactctccactacgatcagacctaaatctttttatctttctgtcaagttggttttcaatttctgccttatagattttaaaatagtctggaccatcatctttcgttttcaacaaatacacatagcaaaatcaagtagcttcatcaatcaacgtcatgaaatatcgtttttctcccttctcaagaccccatccatttcacaaagatctaaacgtaggagttccagaggtgccaagtttctctccccggctgccttgtaaggcttgcgaggttgctttgattgcacacaattatgacacttagaacctttaacaatggagaacttatgaattaaacacatactgtaaagccgagacatcaagcctctacatagacgggaggcactcataaccaaccaataaaatgtgacataaatgtgagtgccaaacattagcctcattatccacactcatagcctttaccaataaaatatccatgtttagacacgactactttattagattcaaacaccaacttaaatccatctctacatagatgggagacactaacaagatttttgtcgatagtagggacatgctgcatgttcttcagttgcacgatctttcctgaagtaaacttcagatctaccgtgtcaatacatgaactgaagcatgtgacctattctccattaggacggtggaatcccgtgcgacctgataagaacaaaatagtgagatgtcagcacaaacatgtacattggcccctgtatctacccaccagttagtagactgattaacagaaaaaaatagtaggtaaattaccatacccgctttcatctccagtgtttccaatggtcacattggaagacttagaagactaccctgcaggtgccttcatccccttgcgttgtggacaattcttggccagatgaccaggcaagccacacacaaagcaagttctccttagacgcgatgtctttttcccgagttttctcctcaacatcaagagatgctattaacccctcaacatagtattcatgtctcgtgtgttttaagtgcaatattgaaatttttccaaaatgaaggtagtttcgcaataatgcacccgaccacaaatttgtcgggtaagacacacttaaggagttcgagttccttagcctttgtatgtgtttcgtgagtctgctcaactacagaatggttatcaatcatcttgtagtcttgaaactgctccatgacatacagatcattgctagcatcagtagcatcgaatttggtattcagtgcatcctataactccttagtgtcaatcatgtgcatatacacctcgactagacgattgccaagaacgctaacaatgcatccaattctatcatttatgaattttttctgcttttcagcaatgagaattcctttagatttgccattactaacccagaagcatttcatcgccgtcaaccatagagtgaccctgttctaccatcccttaaagtgtataccggagaatttatccagcctcagtgcattggcacaataagccatagttaaaccatagtgcctataataaggtttttggattgttgaatatataaacacataatgatttagtttattccataaataaatcatgacactgcagatgtaaactagcattatcgcatcatacgatctacacatgtaaactagacagtaaagcatgagcagatggaatatgcgaaacatattgaatgcgtatcgagggttttcgaaaaccagcttctcagtaggaaggactcacaataccatgcgttgacgacggtgcacagcacgcgagcgaagagaaagatgagctgatgtgggcgaacaaggagcagtcgtgcgaagcgcttcccaaaaaccttattgccactatatcccgacgtagggcgttgaaggcgaaggttccgaaggcctactctcctgtttgccggtgcacaccggcaagcgggatggagtaaactacgagtgacggcgcagtacaaaggaggaggaaaaccctagattgatttcacatgtgttgtgtggaggcggtggctcaacttatatagacatatcaggatgcttgatcagggtgctgttgacggtcattatcaatcagtttcacccgtcaatattaccaaaataaaggagaactagttatgcttccaatgcaaatttatgttggaataacttatgttccactagcactacgattctaacctcttgcaaagaataaatacaaaatggaggagaattggcagcaaaacggacaatcaatcaatcggatactgtcaagaatcagacttgtggacaagtgggctgaaaacacagaattgacacgatccaacaggcccagaattcactgttctggataagggagaagtcaaagaggccacctgctgagattgggccagtttggctcagcccatggttcggccgatctcgtcgtttagccgttcaatgcaagattggcgttggactgtctggattgctttcttatggcggttgaagggtattactgaccttcccaacaaccataaccgtcattactaggctatttaaggccttcacctcctcacttcttccacacactcaagcaagtagcttctcacattttctcaagttttgtatagtctctagagtatagtagaatagaaatagaatagagttcttcagtcctcggagtcttcggaagagttcgggtatggctcttgtaccttttccttctttaataagacttgtaatatttatagaatatttttctcaatatatttacagtactttacttcatttggatcattcgagtaccagcttctgatttattatttgagatataattatctagctagattactcgagagatgcaatggtgtgggtataatgttcatttatatgattgctctatgtcatgacgatgattgtagagtagtatttggtagcataagcgaggtgcttaggctattgaatatcattatttggggttatatgctgtgggacagtagaggtgggccgctggtggtgacagctcagtatgtgtattcctccacgttagtatataatcctgagttactttcctagggatggtactccttcgtattttagccgcagttggatggccatgacgggttgtcataaggaactcggcaaccaggggtggtctctcgaaacaccaggaggtcatcgtaaggggggtattggttatatagttatatagtagataatatagactaaagttgtacgtatgtatattagaagtataggaaatgatttttttcttattcttttccacttagcctagaattagtatgtatgagaatattgagtgcttctactttgtgtcactctacacttgaattgaattaacccctgcttagactttgattattacaagtaacatataaatattagcttggttctctctattataatcttcccacgggattaaacaaatacgatacccttagaatactcttgggtaaatgctacaatggtatatccatgtgcttgcggatataatctgtaaccataatataccatgaatatgtatgtgccattgctgagaattatatttctagtaatgttaagaaataccaacaggcgcttgcacgatctccactccgtgtaaccgaactggataagtcgtgcgtaacttatccggactccacgctgtttcacgcaccgggttattcggagtatttccaaaaaccaaatctaaatttcccacagcaaaacaaaactgcaaaaggagactgcatctgcgcaagggtgaggaaccaattttggtagaccattagacatgtacgtcgtgcgcgtgccgccaggcatggccaggcctggcgagcgagtgcgtgcgtgtgttccctctcttctcttcacctcacatgcttcaagtagtcaggagagcatcctctcttataagaaggtctccctctcctatagtaggcaagttggtattaaactccccatgcatgtcatcccatgaggtgggcttttgtgactttccatataattaatctctgaatgggctaagactcatgtattaattccaacataacaaacatgcacatgtctgctccatgttcttcctgattttgtgatccaacacccgcttcatcttcaatattaataacgactgatcatgc

SEQ ID NO: 25003 - DNA, 3095 bp, Oryza sativa
ggtataattttcttgcgatatatgttgatggtcgttattgatcagtttcaactgtcaatattacaaaaatagagaactagtgatgcttgcaatgcatacatatgctagaataataatattccactagtattaggtatactaacctcttgcagggaatgacactaaagtggaggagaatcgacatcaacatagacgataaatcaatcggacgatgtcgagagtcagacttatgaatgaatgggccaagaacgtagaattgacacgatgaattaggccaaaattcacaagtctacgaagtgaagcaacggaggaggccaccagccgaaattgggctggattgggccggccccaggttcggccgaacctccctcgcctccgttggatccaggttttggctggacggttgagatgaagccccaatgacggttggatggtattaccgaccattccaaccgtcacaaccgtcatagttcagctataaaaggacttcaccttctcacttcacacacacacctcaagcaatagctctctcatttctctcaattttagtttagtagtatctagctagtggaataggaatagagtagaaatcaagagtccggaagccgtcggaagagttcgggtatggctctagcagctttcctttcctcttttgtaagctttgtacttttattataatactcttctaaatacatttatggattgaaatactttccaagtatataaatacctactttacattatgttcttgttatactaaatatacggctagcttatctgggagatgctttggtgcgggtataatgtttgcttatgcagttactctatgtcatgacgatgatattggagtagtatctggtagtttagacgtggtgtctagattacgggatattattatttggggttatatattgcggatgagaggtgggccgctgatggtgacagctcagtacgtatttctccacgccgatatataatcctaagttaattccctgaggagagtattcctccatatttagccccggttgtatggtcatgacgggctgtcgtaaggaactcgacagtcaggggtggcttctcaaagtaccaggagggcatcggatagagggtattagctagtatatcagttaactagaatgtatgtatactatgtatattaaaagtataggaatagatcttctttctcttttctttccacttagctcagataatatattatgagaatgagaatgagtagtaatacttgtgtgtcactctacccttggattatcttaaccactacttagaatatgattatcacaagtaatatataaattattagttgagttctctctacatgatctttccacaggataaaataaatacgatacccttggaatactctccggtgaaatgctacaatggtatattcgtacgcttgcggatgaactctgtaaccataatataccaggagtatttctgcaccattgctgagaattatatttctagtaatgtcgttaagaaataccaacaatatattacaaaatttgtaggaatggttaatttattactacctagatagcctttccttaaattttctgttattttaataaaagacaatattcacccctctagctctcccaccacaaatggggatagtacatttgatcaggattcctttccacgaagtggttgggagtattcatagtaacagccaataaatggagaccatcaataactataatcctcagtgacgggccataacattatctttgtggggccgtcaccagtgcggggttaggttgcggcttgtcaatgataatctttatcgggccgccacctatcctcatcaccgatgagtgtcactggtgacgggtctggccaagaggcctatgatgagtgcctatatggttgcttctatatcggggtttattccagcccgtcaatagtatggcctatgtgacaggtgataggccccatcacaaattcctcattcacgactttaaattgattatgtggttacatatgcttgcctgactaatactatggcagattaggaaatacttagatgttagcactacaatggcatgtaccgtacacataatacatatgcgccggagctaaacctaacgtgccttgggaaattgattgacttgagaaaatacaggttgtctacagagtatatcgagtgtacttcccgttatgcatagcattgtacacttcacgacataaattgtcctatttgaaatcccctctcctactcccacctctgcgggaaagccaatctctccactgcatattggagttgtcctttatcataaaacatctattcaatttgcacctgcttacaatcatactgttattgggcaccaagaccatcattgacccttagacgacacatcaggaagtgtcacgaccggaattaacccaacgggcgttccttacgtgcgtgtattattccttatcccaggaggcaaggtacaccaaaagttgatacatttcagagtttatcaagcggaagcgtaaatagttaatttattacatgggcggcgaaggcccagcacacacaaagacaaacgagaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagagtttgcagtaaacagcattaaaagacacttagttgctcaaagctattttgtaaacacgattccagagctatacaatattattaatcaaggccgtgaacccacacgaacctgccttaacccaaggcctacgatgattcagactcaactagcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatcttta

SEQ ID NO: 25004 - DNA, 22392 bp, Oryza sativa
agagggaatcaccgggaataattcccccctattgattgcacgcggggaggacgggggcggcgggattcgcggcggcggcggcgctagggcgcgggcaaggtggcgggagcggcgggaggaaggggatgacgggtgggccccacccgtcagcgagggtggcgggtgggctcgcccgtcagcggcgcgcgcgcggggagaggccggatgggccgcggggagaggagagggagggggagggagatgggctgagccggcccaagaggaagagggagggaaaggggactttttagagtttttctttttataaaatcattttaactttgtttatttcttaataattattatttgtgctctgaaaattccactaaaatttatttacgtattttaggcttttaggaaatatacaaaaatcctccaagcctcatttgacttttaactttgcacattttaattgttgggggctttcacaaggattttaattattctaggcatcatttaaaggatatattttagagtcgttttgggacgtgacaggaagcacgttgatttctatgtcccagtgtgttgtatattggccttgcactacaattttgatgtattccttgtttcccagctgcatctattccactaacgcctcattctcatttgttgcatcaatagtcaacagtgagttcagcttgtcgtcagcctaatcatacgcctagcaattactatatggtgcaacaacctctttcattgcttcacttaggccagagtaatacacattaaactcttgcacagattcgacatgagtttgttccaagaactcatcaagtaaataatttgaggaagcagaaagttcttgttaaaatatacggaaaatagcaaattgtacatgtacacaagaaactagaagctggctccatggaagcatttcatcaagcaacttgcatgcagcattagagcgggttgagctctcacctgctcaccgtgtggttgcagccgagaaaaagcggagaactgcaggggttcgagggaagatgcgacacgctgctgcgtatggacgtcaatgggaggagcgaggaggcaacagacggggcggcagcgctgcctccgcagctttgatgactccactagtattgccaggctataccctttcttattcactctagctacaaactttctccaacttccagtgcatgcaagttgtactacttcccactgccaagcatactcaccccttacaggcctcacagttttgataacaaacttttgaacaattggatcaaccctaaacatattatgcagccaccctaggacatcgtacataacctactactctagtgaatttaggcatataagttcaaatctaccctgctaacgcaaaattagtataggagcatcaccgtcatacgcacaaataaccacatcatatgtcatcttgatagaacatgaaaaaatgtcttaccatggaactacccaataatttcacatgtggttcagtttttactgatgcaatacaacttcattaaaatacggttcaacgtcaacttaatactccgtgttaatttttactaccgccaattatgcacagtaacatacgtgctaccaaaaacctttttcactgtaataataaattaatactaagtaaaaaagacatgtactcaccaagtacttacttaaatatttaactactctaactattctagtaaaactaatttaaatctgtgctaacatccagcattttacttagggattgggaatttaaccttgcaatcacctgagggagggcctccactgccgctcctctcccgctgtctgcaggtgtggcctccttcctctctcgtggcctccagcagcgtcctctcccacagctgcactccccattcattgccgacgccaatgtgccctctaagtggtcctccctcttcagatcaaaacgacccctgtcgagctgtggggaaggatttaaaagggctgtactgaatgcccattgttcaataggggatatactggggccaattgaactactgtcattagacagggcctgcggctgttagttgtgggcctagtcgaactatcaaagttcaacaagcccctattgaaccacccgcagtttgaatggcttggctcaccgcgcttccaacaattgatatgcctatgttgaacttgtgcccttcgacaagcctcacatcgaacatcatgaatttgattggcttctactttcacgattataattaggcacaaaatatttttttctcattttccattaaaataataatatattttttaaaaatccaataacttcaacacaatgacagagttaggcatcataaaaaagtttgcgccggcaataatgatcataatagttataaattcttttatttgcatatacgtagatcatagtacttgtcttccacccatttgagatgaacgctactataatgatcttctccaaactacgacttgctacaatagcctccaaatgatagttccagtatattccaaaatgtcgtattcgtagggtttgatatgtatttctaataaaatcaatgccacttctattaatttaatcatgtggctaaaagtatttgttttctaaaccacaatgggtggttagctacatatgtttctccttcttcaacgattgtggttccagccttggtacaaagaaatgaaaacttattggctattcaatgccagcgatccatatatatcatgtgtgcgcaatattactgttgcagatacgtggaggtgaacgagagtactagcgtgcgcctcttctactactttgttaagtcagagaaggatcctgatgtagacccacttttattgtggctatcaggtgggccaggatgttctagtatctctggcctaacccacgagataggtaaattaactagcaggttttttttctcaaattattaaaaagtttacattgagttccttcggataaacaatatatattatattataaaccatgcttataggtcatgttacaataaggcttgttgtacttaacaaattgtttatgtccatatatttatagggccattccaattcgctgcaaaacggtattacagtggaggattgccggaaattatctaccgaccagagacttggactaaggttgcctacattttttattgaatgtggcaacaaagaaaattatttgtatctctgtctcaaatgaaaaaaaaggcatatgcccttatccaggttttaagggatgaactttgtatggttttgcaggtgagcaacataatctttgtggattctcctataggggcagggttctcatacgcggcaacaatggaagggtccaagtctagtgataccaagacagtgaaacagctttatattttcctcagaaaggtaactctgtgctgaccaatgcatgcccagaatttcagatttttactctatctgtcttgtatggaattggtttaatattttttttatttgccttatggttttcttcgagaacatctgcgggctttgaatgtcatttcagtaacatccaccatcagttacaaaatattttttttaggttgctcagtaaattctatggttaggtcaaaagattccttttttgtcacttgagttgtccatttttaaattttaaataccttagattttctttctaagcatctgattggttctaggatcattgagatgatggaaatcataagaatcaatgcaggattgcttatattgtaatataaaattggaatcctagagctccttatattttgaaatggacggagaatgagaaagtacatgtacagcacataattaagtgtgacttcaccatactggatgtatcaggaagtaccacatttaccatttagtaactagcagttactatgaggtaccaaattctgcaacaaaaaatattcttgtactatttgaaatgctgcacaatatatatagatgtaacaaataatgaaaattgaccattatactcccctgatctacttcaataacttaatcatctaaactatttttttggctcactttaatccctacacaattgaaaatggttcactttagttttttttaaaagaattgttcactttacttcttaataatatttctgttttagttcctctttatacaagatatattttaatctaaaatttttcatgaacgtttgtgtcgatggtggatacccgtagaccggatatagagggtattggggtacgttggtacgaggatctacgtaatacgatatcaagcaaacaaaagacaaggattatactggttcaggccccttgataggtaataaccctaatccagttggtatgggattatatgatggaaaccacagattataaagggaatagcggaactcaatgataccgatgagaccgtagtcgagttggttcgactaggtcacccggcgacttggctcctgtaggctccgacttcgtatgctatggtggatgtattggcggtgagattcgatgccttaggtcctgcccagggggtcccttttataccgcgggttacttgatctctaagtaggactcggagatatcggacccctcacgatatggtaacgacctagtcttgtccgagtaggactccttccatctgtggattctgtttctatcatgtgatagatttccttaacgtatacaggaactacccgtatacgcacgggtataccgtatcagtatacgacgtatatccatggatagagggtataccttatccgtaaccttgacagtttgaactttaaaatctccatgtttagttcagtatttggtgcttccaacatatgtagacagtgatataaaagtctaaaaaaatgttaagacataaactgtaatgcatctatctccttatgtagagagaagaaaagaaaagaaaaatatcgttacgaagtaagccgaactaatttcactagttaggggtgtgaattgagctgcatatagtttaggcggtttactgctttcacaaaatagttcaagagactacaattaactttttcataaagaaatatcataaaaaagaaaaaacagttttttataataaaataaatgtgtgatttattttctctagggaaacaaaagtttgtgtttacatcagacatagtagtccttcatgtcaaattatccccaatgtatagttctattcaaatgtgagagtgtcatgttactttccttcgatagcaaacacagtaacagcaaaacataacaatatgagaaggcttgtgtataaggtctatcacggaagtctgcctacgaaaaagccctccattttcacatgcggccagctatatgcagccatggatctgtcaaaatagccttgtcccaggcagccacctatggaaatagaggctttacggcatctattgcttgggacaagatgttttcgcatgtagcccgtgctttattgccttgtccattaaaaattaatgttagactttcttccaatgaaaatttacctttgttcaccttaattgggtttgtttgcagaatttgctattctaattttgatgcttgtagacaaaatttagatttttgctattctagtttccacacctatgtatgtgcaacaagttctctcaagctatacggaccaagctgtgaatcaagttaattttctaatctaagctatattgccgaagctatgaattaaaatgagtaaattctttatttccccatggtagccaactatacggccattttcaagttttctagattatttgtccaatgatccatcaaaagaccatgttgtgtgtcataccatggaaaagagtttccgaatacaacattaagtatgatattatgtctatatggtaagtaaatcgataatgatgcatcatacagttattatgttcttgagaatttttgacacttttcattattgcctttttacgcccatccggttggaggacgctacacatgccacataaatgcatactaacagttacaatatttttttcttaaattatttttgttagttatatgcatcatgttaattgtgacaaaacaatactattatgaaatttagtttctacttgaaatatgaagctgcgattgtcagggttacgggtaaggtataccctctacccttcgatatacgtcatatatcgatatggtatgctcacgcgtatacggacgttttcagcatacgttaaggaaatacatcatggagttcacagatggaaggagtcctactcggtcagaactgggtcgtcattgtgtcgtgttcggactggcctctccgagtcctacttggagacagttgacctgcgatataaaagggaccccccgagaggacctaaggcatcgaatcttagagccaactcacccaccacagcttacgaagccggagcttgtcagagccaagtcgcggggagatctagtcggatcaactcgactacgatctcgtcggtatcgtcgagttctgctattccctttgtaatctgtgatttccatcatataatcccatatcaactggattagggctagtacctaccaaggggcctaaaccagtataatccctgtttcctgtttgcttgatgtcgtactacgtagatcctcgtactagcgtaccccaataccctctctatctggtctacgggtatcccccgtcgacagtggcgcgccaggtagggggacttggtgctcaaggttctactactatgacatccagcttcgccgacaacagcgtcaacaccaacctcaaccaaggagttcctacttcaacaacactggtgtggactcaagtcggtgaaatcatctttccggtttacaccacagtgccgatctcagctggtccgccaatggccagaaacgagaatgcagtggctacaacctggggcgactccatgtcgaaggatcctcccaccgaagcggagatcggaacgtcgacgacatccgagcccgagaaggatcctaatgcggccaagccttgtattcccaataggaatcacaagccgacgaggattacttccgaggtgacaaggtcctgatgtcctatcacaaaaccaggaaacacaccctgcaagcctgctggatctttctcaacgtccatgctgaaattcgtgcctgcaaagagcgtggaattcagcgtacctctccaactcatgatgtctattgtcctattcacaagacaaagaatcacgacctctcgagctgcaaggtctttctcagcgccatgaagacgccacctcctaaggtccagcagtcacacatccccatcagggatgaagacaaggaacagggagcgacgccattttcagatcgatttgttggggtaatcgacatcgatccccacaaaccatcagtcttgcactttctcgaagactatggatcatcgacaacaagtatgccgcatgaggtattggctatcgacgatgtcggcacgtcagcagcaccaatacggaagcggagaatcaagtgactactccggcccagcacatcagagccgtcaacacaatactgagggaaaccccctacgatcctgttctgaacgacgatctcgcacgttggacagaacgactacgggaatcaatgaccaacctcaacaacgcgttcgaagagaccgctgctgcagcgcacccggaacagccaccaactggcgatgctaatggtgaagaccctgaacggcgggaatcgcctcatcgagccacccctccgcctcgcggcaccggcgatctccgcgatcacctgaatggccgccgagaggcacgacgcacacgagacaacgagaaccgttcccggcgtcatgtctcttcacggtgtcatgatgacgaagatcgaggaggccgttcaagcgaagaccgagaccatgataaccgccacaatcacgacgatcacgaatggcaggtgctgggcgatactggtcaaggacgtcgccataatgatgacgatgatggagacgacgacaggattctcgagaacccagccgacgtcctcgtaataatacgctggaaccaagcgacccatcgtcatcgtcatcatcctcgtcatcttcatcatcagatagacatccacgaagaacgtatgatcgccgacaacccaccgcccccagcgctgggtgtagagctttcggtcgttcacttcgggatgtccgatggcccgaaagattccaacttggagcaatagagaaatacgatgggagcaccgacccggaagagttccttcaggtttagtccacggtactctacgctgccggagctgacgacaacgcgttggcgaattacttgccaaccgcattgaaaggctctgcatgttcatggctgatgcatcttcccccctactcgatctcttcgtgggcagacttgtggcagcagttcgtagccaacttccaaggaacttacaagcgccacgcgatcgaagacgacctacatgcgttgacacagagcccgggcgaatccttaagggattatgttcggcgctttaacgagtgtagaaacacaatccccgagatcaacgatgcttctgtaattcgcgctttcaaatccggtgtcagagatcgctatactactcaggagttggcaacgaggcgcatcacgactactcggagattattcgaaattgtcgaccgatgcgctcatgcggataacgcactgagatgcaagaacgacaaaccgaaaaccggagaagagaagaaaccagccaaggacgcacctgagtcaagcaagaagaaaaatcggaagagtgggaaaaggaaagctcaatcagaagttctcgcaacagaatacgcggaccctcccaagcgcccagacccacaaggcagcgacacgaagaaagcatagtgccctatacacaagacggacagacattctctagaattgcctcgtcttcaaaaagttgctcgcaaaacacatggcatcgaaaaaaggcaagcgagtacgcgtggttgagaaggacgctgaggcgcctactcaggaatcggagtcagcatacccagattccgatctccatgtctcacacattttcggaggttccacggcatactcctcaaagcgagaatacaagaaagtggaacgtgaagtctgttcgacgtggcagggggccgcgcccaagatgaagtggtccgagcagaagatagaattctcagaagaggaccaccccaagactgctgtcatcctagggcgatatccgatcgtggtcgaacccactattcgtaatatcaaggttgcccgagtactgatcgacgacaggagctcaatcaaccttctcttcgccagcgccttggacgcgatggggattccacgaagcgagttgacacctaccgatcaacccttccatggaatcactcctcagtcatcatccaaaccattgggcaaaattacgttgcctgtgactttcgaccaagcaaacaacttccgaacggaacagatcacctttgatgtcgctgaattcgatacagcatacaatgcaatcattgggagaactgcactcgcgaagttcatggccgcatctcactatgcgtatcaagtgctcaagatgccaggaccgaagggaacaatcactattcaagggtacactaagctggcagtacaatgcgacaagcggagcctcgacttggtcgagcacacgcccagcccgcctgccacaacagagccaccaaagaaagtgagcaacacaaacacgacgccgaaaccagatggtgcaatcaagatcattccactctccagtgccaaccccgacaagaccgtcaagatcggggcatcactaggcgagaaataggaactcgcgctcatcaccttcctccacgacaatgctgacgtgttcgcttggcagccgtccgacatgccgggggtacccagggaggtgattgagcacaaactcatggtgcgacccgatgccaagccagtaaagcaaaaaccgcggagatttgcactagatcgaaaacaagccatacgagaagagctcgacaagcttctcaaagccggtttcatcagagaggtactccatccagagtggctagccaacccagttatggtacggaaggccaacgagaagtggagaatttgtgtcgatttcaccgacctcaacaaggcgtgccccaaggatcattttcctcttcctcgaatagaccaactggtggactcaactgtatggcaaaagaggatgaggagaagataacattcatcacgccgttcggggtattctgctacgttaagatgccgtttggactaataactgcaggaaacactttccagcgcacggtccaaggtgcacttagcgaccagctcggaaacaatgtcgaggcctacgtcgatgacattgttgtcaagaccaagacaagcaactcattgattgacgatctgcgagaaacgttcgactacctccgacgatatcgcctcatgctcaatccagagaagtgcacgttcggagtaccatcgggcaaactactcggcttcctcgtctctggcagaggaatagaagcaaatcctgagaagatcaaggcaatcgagaacatgaagtcacctacaagactcaaggaagtacagaagctaaccagatgcatcgctgcactaagcaggttcgtcgctaggatgggaaagcgagcacaacttttcttcgctctgctgcaaaagcaagacaaatttgtatggacataggaggccgaagaggcattcattgcactcaagctctacctatcaaatccacctgtatttgttgccccccaacctaatgaagaattatttatctatattgccgccacaccatattccgttcgcactgtcattgttgtcgagagagagaaggtgcaacgaccagtctactatgtcaacgaagctctccacgacgcaaagacaagatatccacaaatccaaaaactgctctacgcagtaatcatgacatcaagaaagctacgccactacttccaagcccacaaggtcacagttgtctcctccttccctctcggtgaagtcgtgagaaacaaagacgttgtcagccgcattgccaaatggatagtcgagctaagccaatttgatatccacttcgtgccacgaacagccatcaagtcccaggtacttgccgatttcgtagctgattggaccatacctgataataggtcagacaaccaaatcgacaacgaaacgtggacaatggcattcgacggtgcactcaacagccagggagcaggggcaggatttatcttgacatcaccttcgggagatcaattcaagcatgcaattcacctcaacttcagggcaaccaataacacagccgaataccaagcactactcgttgggataagagttgcagctgcactcggagtcaggcaactgatcgtgaaaggggattccgaactagttgcgaaccaggtgcataaagattacaagtgctctagccccgagttatccaagtatctcgcagaagtcaggaagctagaaaaaaggttcgatgggatcgaggtccgacatgtataccgcaaagacaacatcgaaccggatgatctagcacgacgtgcgtccagacgagaaccacttgaacctggcacctttctggacgtcctgacgaggccatcagtgaaagaggcaaccggcacagacagcccggtcgcccccaacatcggctcgggggctacagaggcagagcgagccgttgccgatattgagaccacagacaactggcgtaccccactcattaaattcataggcagcgaagagttgcccgaggatgacgtagaggccgagaaaatatcccgtaaagcaaaagtctactgtatgatcggcaacgatctatacaagaaggcaccaaacggggtactcctaaaatgcgtctcgtccgacgacggcagacacctcctcctcgacatacatgaagggatctgtaggtcacatgccgccggtcagacattagtcggaaaagcttttcgacaagggtttttctggccaaccggcctcaaagacgcctgcgacatggttcagcggtgtgaagcctgtcaattccacaataaacatacaaagctgccagtgcaagcactcctgactatccctcttacttggccgttctcgtgctgggggctagatatactcgggccattcccgcgaggatagggtggctacaggttcctatttgtggcgatcgacaaattcaccaagtggattgaagcgacacccacgggggaaatcaaatccgacaacgccatcaaattcatcaaagggatattctgcagattcggattgccccacggtatcataacagacaacggctccagttcatcagtgccgatttccaggattactgcatcaggctgggagtcaagatctgcttcgcctcggtttctcaccctcagagcaatggacaagtcgagagggcaaacggcatagtactacaaggaatcaagacccacgtctacgacaggctcatgtcacatgacaagaagtgggtcgaggaacttccatcaatactatgggccgtgcgtaccacaccgacaacgtccaacaaggaaacacccttcttcctcatttacggctcagaggccatgctccccaccgagctacgacatcaaagtacacgagtacagaagtattccgatgagtatcaggaggaacagcgatacgacgatgtgaatctactcgaagaacatcgcgaacgagttgccgttcgagcagccagctaccaacaagcccttcgacgttaccacgagaagcgcatccaagcacgcacgctttcgatcggcgactacgtcctccgacgggttcaaagccaagcagggcgcaacaagctctcacccaaatgggaaggaccgtacacgatcacacaagttctgcggccaggcgcattcaaaatcgcaagcggcgatggtcgcgagttggcaaattcctggaacattgatcaattacgtaaattctatgtataagtcaatagtatccatacttataagacatcttacagcctcaataaagcctatttttcaggaacagactacaatcaaagtgttcctttccgatgatcccttacccagatgacacttagcattgaaacctatcctcatgttcctttacgccgtcttgacaaggcctccgaggaacctaagggaacttcggctggggacgcctagagccgataaggccttgtcggatcctgtagagacgaaagaccatgtaagatctggtcgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctaggggctagggagagtgtacaactcaaacgactgatcgaagtcgcgaagtgagaagacactcatacacactacatccagagtaagaaagcatagttagatagatttcttttctattacacaaacatttcttacaattccatcaaaatccaaattacactttttcctaagacatttgtcacaggacacggagactaccaggaaggtcaacgctagtccatcgactggaaaaccttctccgccagcggcgccatcgacttcgccaagccatctatctccgtaggagttctccgagaacgtgaaaacccttcgcggaggaactcaaggagcagctgcggacaatgatctcgtacgcaggccgacacgagccccccggcatatcagcttgagcgacgacactcctgcttcaaggcctcgtcgacacgttgaccgatgccttcgagctgggcgcaggccccattcagccacgagatgtatccggccaccgattcctcgggatccccatggggtactcggagctttctacagactctcgacatggatgtgcagcaactcttcagatacgagttgaaccacacctcatgaccccggagtgtctctatggcctggtcctttctcacctctagcatagtcctctcgagttccgcaacctcaaacttcgtcctccaatactggatgcgacgatcctggtcagcaagcgcactctcgagatctgctcagcatggaaacgactaagtcaagctgctcttctctcctaagaacacaacaaattaagtcgatccagacggaagggcaaaggagatggtaacaaagacaaccaacctaagggagtcgctgccatgctcgtttccactggcaaacttcgatctacatcgctttccggcacatgctgctcggacgcaagtaacggaacgaccactggcaactcaggctgcccgcgctgctggacatcatcgacattaacatctctacaaaggacaacaaagtactcgagatcaaaatgctaaagaaggttaaggcaatgatcgcacacaaagcatgactaaagagtacaagagagctaagaccctactcttcgaaaagcgggaggacggactcccccaaatcgccgacctattccatcacatccttgcgcgcgtcgctagtcgccccctgatccaagatcttccgcagatcgagttcagggtgcgccagcctcacacacgcaaggacttggcacgccccggtgtagatcccgttagacgtctcctctccgatcctggccgcatgcttggaggggatctcctccatcgccgtcaccagctccgcaagagaagacgtcagcgagaactcatcgggattcgccggaatggtggacttggtaccgcactccccggcgagctgatgcagaccagtataggtgacccgcaacgagccacggatttccgacaacttgttctcaagctccgacatacggtgctcgagcccctgccgttgtcgcttgttgctggccaccagttccctcatcttctagaggtcctcgcgaacctccgccagatcacgcgccagccgatcggcgcgctcgttcgccgacgacccagccgccaccctcgcctccgcaatctcgcggctaacacctcgagcaccagcttcgaggaggcaccccatctcaacctggagctcctcccaggtgaggacggtagccggcgaaccacgaccagccacgtgatcgctggccagaccgctaggtctcgcctcacggctcctgggcacggccacgacatccgtcgaggccacggcagaagacgcgctagaggtccctccagacctatcttgcgccgccttcgcccgcgccgccctgcaaaaggctacgattgagacagagttcgacaaaatcatgaaacgtcaaatccattcacttacttctcgctgagcgtcataagccgctgccgtcgcggaggcgggggagacgcgtccgaggcctgtagtacaatcgatatgatgtgaggtggaagttttccgactacgtgatcaaataacaggagaacttaccaaggtggtgggtgtcttctgatgatgtccaactacagaggagaatttcctcccctttttcggaacgtcgccgctactcgtcgtggcagcggcagcagcagtgtcagacacccccttggcgaccttctccttcagtgatgccgccacctgatggtccacgagcggcccgatgatatcagtcaaagggagagcctacgcttcataaagtcataatgcgatcccggaagaaaaatgcaaaaggaccgctaagtacacttacattgatggcagcgtcgctcggctacccctttctcgcaaaagggggacggggacgttgctcgccgttgttgggccgctaatcatccgttagccaacacagcgctccacggttgcgctatccaagcctgtagatcgagaccagaattcgataagccgggaagaacacgcacataagggagtcaatttaactaaaaaggaaataccccgaggagaaacccgggtcgcgtcctctggcctagaataatcaaaggcaggatgggctcgagcctgaagcggctggatccgcctaccaatgaagtcggcagcaacttcataccccgacaacccccgttctcggaggtcatcaacgatatcgatgaaagattggagggacggggtcaaggcaggtttagtggtccaagatggaatcttgtctggctgctcctcaggaacaacgaagacaggatccaaatcctctatctgaagatagaaccacctcccccgccatttgctgcgagatgaggggcactgaaaggggatgtatcgcgacttcagaccatcccgaagtcggaaaccaacacactcggacacctttttggattccatccagcgtaactcatagtaaaagcggaagaggtcaagaaacggctccaccccaatgtaggcctcacaaagatgcgtaaaaatactcaggaaggcgatggagttggggttcaaatggagcaaggaaagaccatagaaattcaagaccaaaaggagaaattcagaaggcggtggaagaaaaccgcagagaataaagtcctcaaccgcaaccatgcgacccaggacaggctggggttcagtacctcctacttccctctccgcggtcccgcgaccgggaagggcgccatcctcctgtagttttttcattgacgcactggtggaggtagacttgtcgagatccatggccaccggagatcgccggagaaaggaccgagatgagttggctagggtttttgcgagagcgaagaagacgaaggacgcttggaagctggagagtttttttaacaggcggacctcaaattagatccccaaaactcccttaaatagacgcacctccgccggtgcgaattccaaggaaaggagagatgaccgccggaaatttctaggtccgttacgcgcggcagtttttcggacttcaatttaaattcactcatgaccgttgaacttcacccgatgttgtcgatcactccttgtctctcggtcctcacaccgagaacgacgacaacttcgacatcagaagttgcgatcggtttcgcgagttcatttaagcagaagtcaggggctactgtcagggttacgggtaaggtataccctctacccttggatatacgtcacgtatcggtatggtatgctcacgcgtatacggacgttttcggcatacattaaggaaatacatcatggagttcacagatggaaggagtcctactcggtcagaactgggtcgtcattgtgtcgtgttcggtctggcctctccaagtcctacttggagacagttgacctgcggtataaaagggaccccctgggaggacctaaggcatcgaatctcagagccaacacacccaccacagcttacgaagccggagcttgtgagagccaagtcgcggggagatctagtcggatcaactcgactacgatctcgttggtatcgtcgagttctactattccctttgtaatctgtggtttccatcatataatcccatatcaactggattaggactattacctaccaaggggcctgaactagtataatccctgtttcctatttgcttgatgtcgtactacgtagatcctcgtaccagcgtaccccaataccctctatttccggtctacgggtatcccccgtcgacagcgattataaaacacatgttgttatgaggccatagcccaattttatttttaatagcttaggtataagattcagaattaactaatcaaggatttatctcctggatttttcacaatttggtccttttgaaaaacttttttcacaaatagattcctagaaaaacttttcgtggaaatagtcatttttggggcgtcagagtggctggcgccatcgtccaatgcctgccaacgtggtggccaggtactgacgtggcagggggagcgcgccagcctctctggcaccccccccccccgcgaatacataataccaaaaagtgtctcacaaaaactaatacgggtaatatccgtatatttatccgggtaatatccgaattttaccggataatccatatccgtcggatactacttcccgaacccaataccataaccaccataaaatactcgtattcggacccaatatccgtgaaaagtcccgggtacccgaatttatcctaaaatacccaatgtggctgggcgggcgggcgggaaatacctgccccatattcacccctactcctaagtgtgaaaaaatatgaaaaaataaaagaaaaataaaaaagttgcacatctctcctctgcactagagaggagaggaaaaaaaatggcgtgggttggacaggggtggcatcagccttattggcgtgctcccccgccacgtcagcaccaacccgccacggtggcaggaggacggcaccagcgactctagcgtccataaatgactatttctatgataagttttttaggtctatttgtgaaataagttttttaaaaggaccaaattgtgaaaattccagtaattatctctcggtggagatactaaatcttgctccgtgatgtacggagtttgttgagcaaaactctgctttgattgagcataaatcacagcttgaagatgcaaaagcagtagcacgttatgtacttttaatctgatgcgctatcacagcacaagactgaggtttttttttctcatattcatttatattgcccctcggtgtatagcagatcttccagtgatcattgttctaaaacatttgctttatacagtggcttcacgatcatccccagttcttgttgagtccgctgtatattggaggtgactcatatagtggtatcattgtacctacacttgcgctagcgatcgatgaaagtaagcttcttgccttgtgaatggataatttccttagacatcctcgtactgttacacaacattaaatttgatcaacaagcagtttcggaatatatttcggtaaataataccatctctcatatgggaaatggttgtcaccatgtatcaattactatcacaataattactagaaagatttttcttttcctactaactaaatactatcacaacaatattaggacagagatatatatatatatatatatattttttattcatgagttaaagacaaatttggtgttcactttctgcgcggattaattgtgcgtgtttccaactactaactactaactactgattatgcatcttatttttcaggcaatgattcaggagataagccaattttgaatctcatggtctgatcgatcttatcagataaatatcaatcatgaaattttatatttggaatcttaattacgtcaatagtctacataaattgcttgttaatgtgtactaccaatctgccctgtaattaacttttgccttcaaccattttatttaccttgtctttataacgcaggggtatgttgctggcaatccagtgaccgatagccaatttgatgaagatggtaaaattccatgtctccatggcatgggacttatatccaatgaactttatgaggtaatccataatccagtaattaataactttatatgtttcctatagtacattcagcaaatatttgtaggtattaattccaaaaaaaaagacaccggcctgtttcattatgaataacagatcacggcagtatatatctgaccaactaggcaatattctaattcttttcagctgaaaggatgaataggatgatggagtatctgatttttttttataatacccgagagcacgaactaataaattgacaattaactatattacaaagttgaaaagttgcttttaaaaacatattctaccaaccgtgtatatataatttgttttataaaatcataacgtttagcttgcgaagtgtgctgcccaaaatatttattcatacatgacattcgaacagggcaaaaggtactattgcctacgtgcaaaatctattgtaatatttcttacatattatatactgaccactcaaaccaattttctaccagcatgctaaagaaacctgcagagggaaatacagtgccccagggaatgctcggtgtgagcagtctatccaagctatacgcaatgtaagtattccaagaaaaactatactccctccgtcccaaaatgtataatggcgttgattttttatatgacgttgaacgacgctgttgactttttatataacattgaaccattcatcttattcaaaaatttagattaaatatgcaaaattataagacaacattataatttctttgatgataagacaagttaaaacaaaattaatattatttatatattttttcataaaatgaatggtcaaatattgtgctaaaagtcaatggaatcatatattttgggacataggtagtatcagtactagctactgtttgtgtgtatacaattgtcaataatgtaattgaaattgctgtgtatagttctctgttatgtggcctaattacatattttacaaattaatcagtgcacaaaggacatcaacatgctacatgttcttgagccattatgtgaagaagtctggagccccaggatccataacacatcagcgacagatggaatgagtaggctcatgctggagtctgctcgtgctgctgatgatgacattattgaattcaagtgtagagttgagtgcatgaaaaatacaacattaattactacatcccattgaattccaatttatctgctctagttttccttggatagcacttgacctaagaaagtctaatttggcttatttactgcagaaagcttcctatgtggttttaaaaatatgggcaaatgataaaactgtaagggagagtcttggtgtgcacaaggtatttctactatggtactatgtatgcttccattgacttttcaaagtatatgcactttgctactggtggatggaaatccaaagtttgcaaagtgaatatataaattcactttgcagttggtcttccgcatgaaattaggccgattatcatattacaaattcagcattgtccttacagaaggctaatcattctttgaatccttttatatcagaataattctttgaaccgaaactcagcctatccgctgtgaaggccaagggaaaggattaatttgcattgcatgatagttatgcatatatacgagtttaattcatagaagttgctatacaatacagggaacagttggaaagtggacaagatgcaattacgatatagattacattaaagatgtgtatagtacagtggagtatcatttgacgctaatgagagaaggataccgatcattgatatacaggtaattatatatcgaacaaataattgatcaatatgtacacttatgtcctctgataccgaactgttgcgtttctcttattcacaaaatatacatgcagttatatattcttacatggaactcaactactatacatattggaaactaaaattcttttataagattatggaatcctcggctacatcatgccatcttccgatcctttatatattaaatttgattgcaaccttgcggttcaaatccaccaaattgctcttctcgtcgatagcaaattaaacaggctaacccatggattattttttttcatttaattaattaatgatgcagcggtgatcacgattgtggaattcctttcactagtacacaagcatggattagatttctcaacctttctgtagttgatgattggcgaccatggtatgttgctggacaagttgccgggtaagaagtaaatatttccgttgacagtcaatttcaagagtgattataatttcgggggatatattgcactttctagtgtgagctactgcactttgtagcacgagatatgtttagtgtaaatattggtatatttcagtgccttcgtaaaaatgatgtaaaggaatcccaaattaacttcaaaaattacggtacccccattaccattccaagcaagagtatcatgcattaattttttttttagaattatacagtacaactcagacactcacaacgcacgcaaaccctacccctataagtatcttcgaagactgggccagtaaaattggagaaattgacgaagtcaccataggcgtttcgctatcgctgggtacgtcgcctcccactgggagcgaacccaggacctcaggtgctactgaggttcttgtaaccactaggctacagacccttttgcatatcatgcattaatttttaatacaatagaacacaatgtcaaatattatacgcttttggttagccgttaagcaaataccgttgtttctacagttaacctaccatgaggtgcaaatatattagcacaagaaataattgtactccatcacattataaatttgaacaaacttgatgaagaatttgactcccaaaatgacttacaaagggagtagtatctttcactggctttttaacaatagtaaaaattaataaatgtgaagattatcatacttataactaataaattctgacatatcatgaaggccagttggggaagtggctgatgagtggaatatgtatttacagttattttttaatacaatagaatttattctgttcattatttccatgaagctatacaaccagtattatagagttcaaatatgatgaataattgcgaattagaaaattatggtttgactaaaaacaagaaaactactaccaatattacctcaaaagacgaagttgtt

SEQ ID NO: 25005 - DNA, 1816 bp, Oryza sativa
tcatctatgatgggctttagttgtggcccgacacaggtcatctatgctcgatgagctgcacgcatgctgatgcagcatacatgaagatatactttcttcttatatatgtacagctactcacttcgtgtcatttacagctacaaactcacagttctatgatgccagatcaatcaggttgtgtaacctttggatcagcatgcatctgtaccaaacaaaagttcgaccaattatcctctcctatacaaaggctaaaataacaaaggacgttgcagccaacacacccttatttgccccttcagcccattcccagtttttcccaacacattatttttagataatggaatgaatcatcccggcttttgctcatgaaagctacagccaattattacaagaagtagcacactaaaatggcttagtccaaaattaaacaagcacatcaaccaaaaataaaagaaattctaacatgacaaggaaaacattattccattctattgatgaatctccatccatggttggtaaaaagttgcataaccgttgactcaaggttacgacatgcaacagacagtaattttccatcttcctcacacttttgtagttgggcccacagtcgaaaccaatatgttgccctgaaaattacctgcatataggaaatagatggtgatttgtcaaaaaccctatcatttctacacaaccacagagcccaacataaagccgaggcaccaaaaagtatcagtttactcttttccttgtccacaccctgaagccaactgttaaacatatgagatatacttctagggaggtataaaccaaaagaaaattaaaccgctctccaaataaactttgcataatgaggatccataaataaatgttgaatagactcatttttcatgtaaaaacaacatcgtcaacacccattccaatttcatcttgctaaattatccttggttaacacgacacccttaagcaagtaccacatgaagatcttaatcttaagtggcatcttaagcttccaaataaacttatttctgtcaatgtaaccattattaattaaagctaagtacattaatctaacagagaactagccattctgatgataattccatctaaaacaatcaaaagaatcatccaactggatatgagcaatagaagcacataaatcataccaaagggttaggttctgtccaactaaagctcttataaaagaaacatttagcggaaccaaggccataacactggcaatagtagcactcttccttctgacaatagcatataaagaaggatacttatctctgaaggccatgtttcctacccatttatcctcccaaaatcttatatgttgactataattcacaatccaagagcccatacttaaaaaggtgttttttattttcatgagccctgaccaaaaatgagaatcaccttgtttcctatccacttgggttatagagttattatgaagatacttcctcttcaataaatcttgccacacaccattctcattaattaacttatataaccacttacttaacaggcatttattttgaatctctaaattatgaacacccaaaccaccctgatctttgggttgacaaattatatcccatctagttaatctgtatttctttttatgatcatccccttgccagaagaaacgtgatctataataatcaatcttttgaagaacccctttcggaatctcaaagaaagatatcatgaacatagctaaactagaaaggacggaattaatcaaaaccaatctacctccaacagacatatgttttcctttccaactactaagtttcctctctattctttg

SEQ ID NO: 25006 - DNA, 21349 bp, Oryza sativa
  unsure (1)..(21349): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctaaaagcaacttgtaatttgcattttgcagccgaaagtaaatgcattcagatactaacttgttaaatatcatattatacgcataaatattgatcgctgttcacttttattatttttcatgtaattcaggacaattttatgggtcttttaaccttgtacagtactggtgtattgtgttattagggtaagttctacttagcattttgcactacaggagaagtgatctttactgggtcggctgattttcataatagttttggttctaacaaaaaatgtttttagtcccagttaaagaaaaattgatctttaatcccggttggtgttcttcagtcccggtttaaatttttttgatatttagtcctggttaaaaactaaagatgatatttagtcctgattcatcccctgtcagggggccgaggagctttagtcccggttgataccaaccgagactaaagatcaccactttagtcccagttggtactaccaaccgggattaaagattatttagatctttactcccgggactgaaaatccatctttagttccggctggtaactctaaccgtgagtaaatatttctctaccatatttgttcggttaagtcccagacgagactttcctcctcaccaaaatatctagataagattggatttgagagcctccaacacctcagatcccttcctcctctcgtcccctcccctcctgtcatccgcggcagcgggcaggcggccagcggcggtagggccgcgcccggcggggtgagcagcagcaggcggtgaccgtggtgggcgacggcagcccgcgtagcggtagagggaggcggcggcctgtgcgtggcgggtgacagcggccccgcgtggcgacggcgcggtggtagaggcggcgggcgcagggagaaggcggcgcggatgggaggcggccgctgacggatttgtggatttgtggatgattttgtgatgtaaatttgtggatgattttcagatatttctatgaagttacaaatgaatctgtgatgttgaatgattttgtctgtgtggatgaatttattattgacttcagtgcaaaatcaatatgaaagtagcaaaaaaaataaaaaaagaaaagagaaagagaaagcgctacgtggcgcttttatttttactcccggttggagtctccaaccgggactaaaaatccatttttaatcccggattttttcttccggttcgttacccgggaataaagggggttacgaactgggagagatgtgcatctctccagcagtgttggctgagaaaaaactagataagtcattagcgtataattttaatcaaatattagttattacaaacttaaaattagattaatataatttttaaagaaatttctatataatttttttcacacaataacagtttagtaatttgaaaatcattttaaagaataacgagtaaattatcgtttcaagtcactcgaaacgctaggaccacgatttggccagacctaacaccttcacctgttcagtccaggctattagacttctccctcagtcccacaaaatatcaaaccctataatcctaagaaagtagtggagagtaaaaatgaccaaaatacctatcattattagaaaaagtagtaatagtgataggtaggtatagggtatttaagggataaaacttgtcgttttatatgctgagagtagatagagtgttagaagttgattttttatgagataaaactcaaattccagaagttgagtttttttaggacgaagggaatatctctggagtcgagtcgatttagaccagcgaaaacccatagaactacctagtcttttctgacccacgtgatacaaccaaccaatcatatataagggcttgttaactttgtagccactttttaccctactaaaatttgccacatttgtacattatcaaattttaatactgttggatatgtttagtttaaaaccttacaatttgagggaattttcaatagtgaaatcttgtaagggcttgttcgttttggaggaaaaacaaagaatttggattcctaaagatcaattcttatgagtgtcattcaatttatatgattgaagtataagaaaaccaaagaaaaaaaattccttttctacaagttatatagaggaaacataagaattattccatccagtcaaatctcttagaaaaattccaatagattgatgtgtacaaacatttatattccttcatttttcctattcctatggattcaaattcctccaaaccgagtaagccgtaaagttaccaaatattggtaagatagcattgctatatatgtataagttcagttttttactttatcaaaagagtaaattacacccacagtacaacacgttgatacgtgggttctatttaggacaagaagaatgtgacgtctaaagtgcaataacttagcaagtgggtgcactttaatacaagaatttgataatttaatattttggtgcaataacttggctagatatgtgctaccttggttaatgagtgctatgtaagttttttcacgatgttaatatgtcatcacatagcaattccgtagatataattaatcttataatgtttgatgtaatctgtaagaatatattgttcacctaatttgcaccattgatttagatttttttttaccatctcaaatatcaactagaaaatttctacacagtaattttttttacttttaaatttttttactcagacttttagttactagaatgacaaagaaaatatgcttgtacaaatctacataagtttattaacaactgggtaagtaaaaactgtttacatatagccaaaaatacataattaagtttttacaccacttctcaagttattgcatcaaaatcacacccacctttcaaatagtcgtacccataaactcatttattaagttgttgtactacgttgcatccacttagcatgttgttgtcatagcatgcttatttctcaaattccttcactaaattgcaccaacttactaagttgatgtaccgtgaatatgcaatttactcatatcaaaatttaataggattggtagtaacgtcaaagtaagcaagcccataatccctgaatgaacgtatgcaaagaaaacctacggttcaaccgaagacctgaccgggtcaatcactggtcgggggataacactgcttatgcagatgatttataattacctgaaaattgccaaatgaaataatcaacatacaggagtactaaatatacactcgtaactagagaacctatcatatcggtgcttcattaatagcacataaatattaaggcaaatagttggtacagaaatactcaaattggcctctgtataatttctggactgtgaatagttctcactatggaaaagtaagccataatgtgaacattataatgaaggacgaagacgaatacaaataatacttccatgtctatcgaatatcgagaaggtaaatacaaaatgattttggcatgttagaacacaaaataatggaaaaaggatggtttgcgatgatataaggataatgtgagaaaatatatttttgatgatataagtaaaagagaaaaaaaggcacattttgtacctcaattatggtccttgttttgttcataataataaaaaagttagattatgggcctgtttaaatcccaccctaaaatattttaccctatcacatcgaacgtttgaacacatgtatgaagtattaaatacaggctgaaaaataactaattgtatagattgtgactaatttgtgagacaaatcttttaagcctaattgctccatgatttgacaatgtggtgctacagtaaaacatttattaatgacggattaattaggcttaataaatttttctcgcggactactggcagattttataattagtttttttattagtgcccgaacatcccatacgataccctatataatatacccgatgtaacacgctattacacctctagtaacgaaatcatatccataatgcttaaactatctaaattactgcacaattcacgaggtgagatgagttgtctgaatttattgactgagctatcagtctcagatgtctgaagctggaccataaggctataaataagaattcagaaatgtacacaaaccattagttcatcaaagaggatacagagagatacaataaatacatggttccaactttcaacagacatatcaataataacagaagtaacaccaataatgatgcaggatgctggcataaggccgacacagcaaacaccgatatgagatgtcatgtacccaaaaggaataagtttattcgaggtcccttaacttacaccgaatacgattttcatccttgaaccaaaaaaccggaaacaacacatccccaatttacaaaactagtgcaaacgagatccctcggtagtgctgaccccggttttggttgacgtgatgcctacgtggctcctttaactaagtcttcatccaacgtggcaaagacgtggcaatgtgatctggaaaataataaaaattgtaggcccacatgtcagttacaacaaaaaataattaaaatggaggggtccgcgtgggcccaacatgtcattctcactcccctcctgtcacatcctgattttcgtttcaggatttataaattatttaataaattattattagaagttatattaaatgttcattaatttacaagagaagttaaatgtgggaaataaaattttctaaataaaaagcatggctggatttaatttctattaaattctccatggttaattatattctctggaattttttcggatttttcggagctcaactcttaattttaaccatacaaagaacatttcagtaattattcacatattaaattaatcattaaatggtctgcttataatttttttaagtactttgagtgtccaagtattttcaggatttttcttgaaactatttgagcattggaagtatttttaacaattcaaagatcatttcagtgattattttaattggaaagttgttaaatcctctcctaagccgttgggctgatttcagcccaacatctctctccttcgcgcgcgtgctgtgcagcccaagtcggcccagccgagctccccttctctttctttctttcctttgtttttcagccagcccaagacgaaagtctaattgcgtcccgtatactgttcatcttcaagcttggacagaagcccgagctgccgtcctgtgctctagccgacgccgcttcctccaccaaatccgccgcatcccatgctccgcttgcaaaattagttgaggggaaatattcctcttatcctcctctatcttttcccccaagaatcggactttatcccgaagaaatcaacgcggaatcgaattcgttttcgagtttatctctccaactaaccctcggtttttccggcttcgattcctctcggttggagtccgatctcttcaatccaagcctataaatagcatcccctggtcgtcctctttcgtttgccccaactcccgagctcccccgtcgcccgtagagccgccgccgccttgctctagccgccgccgttgccggcgatcctccggccgcgttgcgctgccgcggtagccgtcgccgctgccgtccgtcgccgtcgtcgggtgcgcacggaggagaggaaccccgtccgccccttcgcagccgccgaagaccaccggagcgccatcgccgccgtcaagccgaaccgtgccgccattgaacctcgtcgccggccgtcgttcgtcgtcgtccgtcgttgttctttgcaccggtgagttcgcgtcgtcgtcctctacgcgtaggtgtcctcggatggcccaaccgagccctcttttgccggtggtcgtgacaaccgtgccatggccggcgatgatgacgtcagtgatgacgtcataaatccctttttctaggttttctttattagatgaaaatcgattaaacttcggaaattcataactaaatcatcgtaactcggattcgagtggttcaagttgctaaattcatctaaaatcaaaatctacatgttaaaaatatccacatgtactgtttatgcttgttttgtactgtttatttggtttttcttagtctttttcttcgttttgcgtgttagcttgtcgtttccgtcgttgcgaaggttcgtgagtgcgtcggaagtgttcaagaagattaattgaagaccgattattgcaaggcaagtcacacagatcctaaacacaatcctttgagcatgttgattctatatttaaattctctatttattttaactgtgcatttattttcgaatgtcaccgggtggtgtgaaccttttcctttgttatggccaatttgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatgacaattaaggaccggttcgcgagctactgttgtgaaacattaaccgtaccaaccacaagccagcgtgggcaacggctttaccttttgtatagcatgattcattgcggggcatcagactgagaagcggcgagaagtccgtgggggtcgctggggagtccatgcctctggttatatttatagagggggtgattatgattcaggaatggtgcactgtggtgagttgtgttgtgcagggggtattgtcacagcctctattcgggtactttctagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacatctcacaaataattattgatgctataactggtaataatttgtttagctcctggtttggaggtttgatctgtacgaccggggttggttgttcaggtttggttgggcctgtgcagcattggggtgctattcagtgttgattaaaattgatgattaattactctactgttttacttctcttaaatgtttgctaaatgttgtcttcgcaaatgaaccctatattatgccatccttcggaatccttgtgcacttgcatatttgctgtgtggcttgttgagtatgtcatatgctcattcttgcaataatcaatcaacctcaattaaagaaaaaggatccagaaggagaagacgtttggcttataccccagttgagctgcctgtgggagtggagctgaagccatcgctagactgttattccgctgctgttttcttttcttttgtaagtatgtaacgttattattatgatggatttgtatattaaattatcagtttgtgtacctcggctgattcctggacgaggattttatgcacaaattagttcggaaattattagtgaatttccgggcgtggcacctcctcttctatcgcctctgtcctggcgggcttcttcctcctctatctccccatctcccctctcttcatctctctcccctctcctttctcttctcctctctctaggcacgacggctgacgagcggcggggaaagggcggtggccagtggggagaaggggtggtgcaaagcggccgttaggagaggagcaagtagagacgatgggcgtcacgcctagagagagaagacggtcggtggccaggttcctcgatgaggagaggatggaggtgagggagagggagctgatgagcttgagcgatgcatcgtcccatcttggccgttgtgttcttcggccgcaccctgtcggtcgcgctcgcattgatggcaacctctcttcctcttcccttatacaagcccgagagcgtcggtggcgcgatgcccagacaggctccagctccgccctcaccgtacgtcggaggaggcggaggaggggactgagccacgtcaggggccacaaccagaagtggatgggggaacgaagaggggaggagggggagcaaaagtgcggccctcactcaagtctagggcggtggagttgtgttagcggtcgtcttcttccccagtcgtcgtgcccgccttccatctcacggtgagtggctcgcccacctccatgcctcccggtgccacccccgctcgccagcctccccacgcctccgctatcgctcgctggcatgccggtcgatgcatgtgcctgccacatctagggaagaggaagaagttgagaggggatgaggtggaggaagtggggcccattgacatatgtgccccactattttttaatcttattatttgactgacatgtgggcccacatattttgttttatttattaaattgttaaattttgctttatgtgccatgtcagataaataccgagttaaattagccatgtgagcaccacgtcaactgaaaccgctgtctaaactggcttgagacttattttccactggttttgtatctggttttccggttgaaggacggaaatcagattcattgacaagttaagggacctcggatgaacttatttctgcccaaaacaaccttactgtttgaagaaaaataagcagagaagcccatttgtatggctggccttagccctttagttggcaaaagcccaaatccgtgttggatcatatacaaccagcttttgccaaaacatgttgtttctcaaaacatagtacgtattttgttctgtgtgcacgcttttcaaacatgttatttctcaaaacatagtacacattttgttccgcgtgcacgcttttcaaactgctaaatggtacgtgttttgaaaaaaaattatatatgaaagttgctttaaaaatcatattaatttattttcaagttttttaagttaatatttaagtaatcatgcgttaatctattgctctgttttgcgtgcagaggagagaggtttccaaccctccaacagaacatcatgtatataaacctaaccgttaatttggcatgttccttctacagcatgtgagcatcaagatagggtttctagtcagatggtatataaagtagtatctttcaaacttaattttttttaagaatgtacgatgctcaaaacacgtagataaccaaaggtcccccgtcatcaaacctagtaacccgtcagcggtatattcatctttatcacatactgtattaaaaaagactcttcggtcacaaaagcaattgccatttactaaccatctgaaatgtaccattgtgtatacagttatgaaatgtcatgccgtttagcagttaactacaccttggtatcaaaatatagtaatttttagctatatgtctgaaatgcttgtctagataaatagctataaattactatattttgaaacagagggagtaacattttgctttgggcaaaactgtcagcctgataaaacaaaattaatacttccaatgacatgacaggaaggatttttgagttttgaagcaatagggcattgcggaagcaaaagattatggttctggaagaaggaatgaggggaggggcggggcatcacttacctattgttggaggaagcgaagcgccgcctctgggtgaggaacaagcggaagatgggcgagttttcacatcatagatcatctccaccgccatcgccgcggcggcgctggtggtggtagcctggctcgtcgctcgcttgtctctctccggcaaccgcgaaggagcaagcagactgagttggagacatcggaaagatgatcaactagttttggtccgggcctcggggccgtgggctcagtgaagcccagggacaatgtcagattaggattgttgcatctgatttagttttttttttgggggggggggttgtattgagggaaagtgttgacgaaaaaatcgaacacaccggcctgggagatctgcttaactccagtgcaggtccaaatatgatgagatgcgggcgtgccagtcagtttgatcctgcaactgacaagttgcagatatgcaaatagtagatcaaagcagccaatcggctgacaagccgatggagtagttccagccgatagccgataatagctgatgccgataccagccgatagcgatagggtttaggcaatcggctatatgtacaatgtggataatgatataaaggcaatcggctgatgatgatgtaataaaataacaatataatccaatataaaccaatcggctagcaatgatatgataaataagcatcgatccgaaggttaaatcacacatcggctggaggtccgatgtcatgaaatccacaagattagattaaacagtgaaacctttgttgtcatcggctcaatacaacttatatgtatatgcaatccttatgagccgatgcaacgtccagataactcaccggctgaaaccccgatgaaacccttattggcaatcaagaagtaggctagagattatggttctaagcatgacttactagatcaaacttaactgatgcaacactaagtatgaaaagaaacatgatatctagacaatcaagccgttgactgagttttcagggtggtagatgtctaagctaatctaatctagcaatgcgatttagccgataccggcagaaaccctaaaacgagaagcagccgatagagctaaattgatatgctaagactagattaacagagacatatgataaataggtaggaaaatatatcatccaaaccagagcaatccaagaggtcgaatgtactgatgcagccttgaacgacgccgacgtaaacgatacaattgcctgggccggcggaacattggacttaccccttagctggagatcgaacaccgatgcagccccgcatcaggtgccaagtcacgccgaaacataaaaacaaaagtagaaatggtaaaaggtggcgatgcgccaaattgtattgatcgtagcgatagattacatagaccccgggtgtacatatttatacccatgggttgatacaagtccttgtcagacaagaaagaaactaacctaaagataaaaggaaaatgtaaagtccttatcggacactaaacacactttcctaaagataaaaggaaactaacaaactattcctaattaatagataaactgccatgccgcatcctctttaaacttggtcacttagggataagcttcctttagtagattgattttcttaaccgaatatagcaggaatcttactattggcgacttgataactcccatcggctgattccgagatgttgcagccgataatgattataagccgatgacgtctttgccgattaccaaatttcactgttaacagaaagagatatctttttagtcacattttataaactaaagttgtaatttgcattcttaggtcaaattttaaatcttgtagtttctaagcaaaccattgcgacatatttcgcctcttcttaatataatcaaggcagatctcatgcctattggttcaaaatacttttttaataaacttaattgtatatattttctttcgatgcttttcattgattgaaaatgcttgaatttttgtgtattggaataactatcctagaagtaataatgttttaatacaatatttaaatagctgaaatgcttatatcttagtatagagggagtattatttaacttcccatttgtacaaaaagaagttagatatttaaatttgaagacatgctgaattcaaaaggataactagaagaaaaaaggaattgctaaaatactcagatctttgccgaaaagagctataacttgattatacacttcacttccaaaaataaatagatgaagggagtgtctctagggtcaagcgggcttatttgtcgtccccagccctaggggcgatcagaacagcgactctacgtccactaccaccaacccccttcctcctatcctctgcatcaccatcacccgaatggcccgttggtaaccgtgcggctgcaaggaaggcagcggtgaggctctctcttctactctcaagggtgctattaggctagggctctgaggcaatcgtgaagacagaggtggcgctgccggatccgagtctccatggctagatccacacaaggtgaggccagtggacggtggagggccgagccaacacatgctgtgattgaggatggcagagtaatggtcatagaggtggcggtggggatgctagatcaacatcctattgggcagatcttatgtccttctagacggatcctgtgtgtctccagtgagaggtacagatccttgaaagcaactcttgatgacgacgagaacgacgtgggtggtgggcatatgctctgcagacatggcgtggtggccggtagtgatatggagagaggcgtaaaacggtgtagccacggtgtcaagggtggccgtgggcattgaaggccgacgtgcagcgaggaggcagggtacctggagtttgggcattcagcaaggaggcaccatggagtggcatgatacagaagtcgacagcgtgtggtcatccctcttgggtgaagttggaagaaggtagcagtgcaaggcaatggcggtgggacttgtaagctagtgaggcccatcggtggtgtgtggggaaactggaggtggccagcgtgttgacggcttgatggagtctagcggtgagaagggcacattgttctgtctcgggaaggggcatcttgcctgatggccaaccgacggtaaagtgttggtgcggtgattgtgagctgaaggttgttggtatttcttatggtcacatataaattcgcaagcgcacggatatcgctatagcatttcacccacgagtactcccaagggtatcgtatttgtgcttccacagcgaagggggtggtataaagatatgtttttttatatctcttaatcaacctttaattaattcaccatagtctaaatagtggttaggataataaatgataaggtagtggacacacacagaagattcacctctataagaatatctagtagggacttatcattaggaaactacgattcatatatacttgaatactaatcatttctagtatacacttaacatatacatgctaacaacataggacttagttctaggcacacagatactaccgagagaccactcactactagtctgccagcatggttatggcatttatgcattcttacgtcatacttgaatgtgtaggaataaaaaggacggacatggctatcaccacctgccacctacctcactttccgtggaggcacacccggatccaacaacatttatttagcctatataccatgcttgtgcaagtaaacaatatcactaactcccccaagactctcaccctacggatgaataagttggagttaaatcaatctataaaggttattggaccgttaccgtagcatggaccaatatacaaagtctaggatgaagcatatatacaaagtatatactattcatagaacatatattaaataaagaaatatataaaccatgagcataaataaataaagaagataattctattaattcaactataatcttacacaaagagtaaagtactagagacatacccagaactccaagaagactattggaccgaagattctaaactttattcctactagaaactgaatacaaagcggaagaggggatttcttctttgaggtgtgtattgcaagtgagggagagctccttttatagcactcttatgatggttatatgacggttattggtccgccagccgtgcataactgccatcaggtgcgcaggaggaggtgacacgtggaggatcaggctgagcggtgctagccaatgttcggttgaacacctagttcggtcaaaccaggaaaaccgcctttggcgagaggctgccatgtgggccccttagtcggtttccaggtggttggccccactttgagtcgatttgaactgacttgtgagtcctttaatctgtgtgctcgcacgtgattcatcggaagtgtgtttcttcacatgttgtcttcatttctccttcactttgatgtatattctctacatccacatttgtttcccaatcctaatacaactacattatttgttgttgatatacatgtaacatatgctaatttttcctttattcattgtactggttggtgttcaaaatttgtacttaacaatcgtcaacaaatgtgctttagatagtaatgactgttgttttctgttttcgatagggactcaacaacaggttgaggtaggaagattgctaggcgaaagcctagcccgttctggggcggcagcgatgatgctttttgcggtagcccaacccctgttagggcgctgttgtggcatatctcattcctcctgatggttttgttgggagaaaatcacgccctgatcctcaagacgggtgatggtggtagtgttgtcgcatcataaccttcttggaggcgttgtttgatgatccatttcctaccaattccatctccagacagttgtcctcttctggtggcgcttttagccagcacgatggccacgttggcgggactatgtgggcgacagatatattctttctcgccctcgccttctccaacacaaagcgtggacaaagttgagcttgtcgggttgttctaagctcctgttttttcttcaatacgtgtttgtgttgtggggttcacatccactgccattagaggtaaatggcagaggtaaacagtaaaacgtgagggatggtacagtgttttaccacagctacagttaaaaacctctgtacaaacaatgtaaaatacctaccggtagtacggcattaatttactgttaggtactgtagcgatcgatctcatccatccacatctaatctaacggctgaaaatggctcatggtagagagtactatagctgtctgccattctagtttcaatggtagaggataagttcccaatgttgtgggtgagggcatggtgctttttttttcctttttctaattataattaaccttccaggattatgttcttatataatttttttagggcctgtttggtacagttccaactcctaaatattgcttcaggagttaagtctggagtggagttgtggagctgcctaaacccagctccacaactctagtatattttgtgagagagctccacccaactctgcttccagttttggtggagctgaaactgtttggctgagctccagctccaggaggtgtggagttggagctggagctgtgctaaacaggctgttactgtcatattgacatgaaacttcgtaatatctacacgggtcatttttttttataaaacaggtgattgactatacaccatacaactagcactctagcagtcctaattcccggcggaaggaatattggccagtccaaaaaaaccctaagtatgttgctacgtacttgagctactatatagtttcacaaatggattttataggaatttcatatggattatattagtacttgagctactatatagttccacaaatggattttaaaggaatttcatatggattatattaggcgcaattcaaattcgtgcaataatcaaggaaaaaaaaaccatggaaactacccaaaaaaacaatggaaacacagagaaactatggaatgcatcgccaatctttggcaacgtacgaggattcaacccaaatcttgtttgactcgaccaccccaaaatcgccgtcccgctcgttagtccgttacaaataccctacacacgcggacacgcctcgcctcgccgatcacgccgccgccaacccgttccccccaccgtcttcggcaatggcgcctgacctcgacgacgacctcatccgtgcggaggccgaggccgcgctcaggctccaccgcaacggccgccgcgacgaggcgctgtcccgcgcgatggacctcgccatccagcacaagcggtcctccccgctcgcgctcaacctctccggtgacctcaacatggccgcgcaccgccggaaccgccgccgcggccgcggcgccggcgccgacgacaaggcgctggcggagaggcaggcgaagttcgccgccacctgctacaagatgtcgctcgacgccgtcccggactgcgtcgagacgttcgccccctatgccgaggccctcgtcggaccgggaatgtgaaagccggcgtgggacgcgttcatgcgcgccgcgcgatcgcccaccggccngacccggcggcgcaccgcctgggcggctacggccggagcgcggggctgacgaggggggagagggtggagatggccaaggcgaggctgcgccgcgccatcgactgctactccaacgcgcgctgcgaggacgccgtcgccgaggtgctcgcaaccgtcgagcaccacggcgccgcctccgccgtgcacggcgcggcgaagctcgccgaccgctacccgtcgtcggcgcgggcgcagtgcctcccggcctacgtggccgtggagctagctcgcgagcgccgcggcggcgcggcgtacccggcgacggcggccaccccgaggcacaagacgctgcgccgcgcgctcgccacgatggacaccgccgcccgcaccttcgaccgatcgctcgtggtcgcgctgttccgcgcgaagctgctcgcctgcctccacgactacgacgccgccgaggccgaatgccgccgcgccctcgccgtcgataaccccgacgacccggcggcgcacgaaatccccctcggatctgcgatcggagaagagtacgacgacatggtgtcatccctcaggaaacaactctgtgatcttcagaagaagcttgtcttgttagccgtacacgattgggcatccatggaaagcgagaagcaatctcagatcctctccgtcagcatcgacgaactgcgcgaacactacagcaagatcgaccaaatcgcggcgaacacagtctccgaagcgcggcgcttctccaagacacacggttcatggtgtttctggatttgcccgcgatcttcgggccaatgtgcaggcaagaagttcctggacactgcatctttgctggaacatctgcgcaataagcacccggacgatctatgggtgaatttgaagtcatttcttgacacaaaactgtgtggaaaatttaaaactgagaatgcatcacaggatggctattcatgccacgatgagatgttacagtttcagagcatagatggtatgatcgagctagtgttaaacctacctcctggtggaatgaaatcagagaccctgtcagagatgaggaggaggaaatgcagtgaattagctgagatccttgacagaatcaagaagaagttgagggcttgtcctaaagatttatcaagctctgaggtctgaaactttgagcatcgtttcagtttactgttctctccttgtgttcattcttgttttgacaattatatgctctaattatcacggtttttttgcattgcagtttgatcaggttcgttctgaaatgcaagatctgtggctgaagtttaccgagttgtcggttttcgattaccgtgaagcagtcgtgccccttgcgaggatgtatcaatgggttagcttttatctgaaattcttgtcttgtccaactatccaactgtaaaattgcgcatgccgtgtgctcgttgattaatttaccatccgtgcagaaagagttaaagaaacgcatcagtgaagatgggagcattattgctgcttggagtatcgatgatatatttggtgatgttcctgcagaacatgcctcccttgatgaaaaagttggccatcaaactggggagaacaaagtgacaaataaatcagataacttgaaggttattcgtgctacttgttttttcattttacgaaaaagcttttatgtgacataactccaaattaatactatgtgttaacatgtttgcttatcgagctttttgaagtcggagtactaatgtatcaaattctctgcttctctgcaggcatgagctcccaaacaaaaggctcctattctccaacacaaagaaagggccagctgcgacgcaatatcccgatctttttctacattatattttataaatttgaaatcttgtgtggcactatgaacgagtgggacatgagaatagtttgctagcttttgaagttagctagttagtgtcacggaaaaaatgagaatatcaattagcttacgattatttaagtactcgctctatttaaaaatataatgcataactatttttttaatgtttcataattcaatgcatgtgacatatgtaattaactattatatttatgtaatgtattaattgggatgattcaaatggggtgataataattgtttcttttatctctagtttaggatggaggaagtattaactataataaatttgagaaacaaatttatttgtttttttaaaatacatatataattttttttttcaatttagccgtttgataaatgtgctcatgataaacgagaaattattctaacccaacgtaaccttaggacgcgcagttaaaaccttagaggagaagcgtgattggacatgacagcaagaagatggagtgggggagtgatagtggagggcacgagagaggggattggtagcgatggaaccctattttcatgtaaaagtaagagtaattattttacattaggagggaagtagggcagggaaagagaacgggacaaggtgaagcacgggaatagaatttacaaatttttggtggcttgctatagtggatacattaatatgattcatactaaggcccccttttattcaaaggaaattcataggaattttagagaattttattcatataggaatttttcttacaaagttctttgaatcaaaggaatgaaccctatagaatcttatgaaatttctatggaatgcctcttctcatataagttttggaggatttttaacaagaggtggaacctcatggaagaaatccttagtctttatctctcctcaaattcctgtgtttttcctgtggtccaatcaaacggtcattcctatgtttttcctgtgttttgcaatcctctattttatacttacattcctatcagaatattatgtttttcatattcctccgtttttttcattaacacattagtttttactagcttttcatagcaacttaagaaatcagtaatatctcccccttgttcgtttacgaaccggacagagacttgaagagtttgcaacgatccgtgatatccaacatgtagtagtaatacttattcagtcccaaaaaatggctcttatccgagacgaactacaggccgacatctaccttaacttctccatatatttaattaactgaaccctaccaacgtaccttacaaacaaatcgaacaccaccgtatgttgtctgacgacccaggtgccatcgatctcatggcgccaacggaggaggatgtcaccgtgtcgacggtcagcaccacggcgaccaccggatgccatatgctcaagatcgacggctacacgcggatcgccaacatgcacggatggtgggcaacttcgtcgagtcctccaagttcaaggtggccggccacacctggagcatcctctgctacccaaacgggaggacgtgtccgggtttcgtctctgtttccctcacgctccaccacatcacccaggcccaggccgaggtccggtttagcctggtccctcaacaccactacgggctgacgctgccgttgggcgagccgcacgagaagaggttcacgagggtattctactccggggtcacggaggggttcgacaggttcgtcgttaggaaggagctggagaagtcgtggtacctcaaggatgacgggttcgcgatccggtgcgacatcgccgtcgtcaataagttggtcgtgaaggagcccgtggttcggccggccgacctggagaggctggggatggtttgcaactgcaacgacgatatgtgcacgctccaccataccttgagcttcgcccaagttgccaagctcaagtttttggagtttttcttagggtgctttcctctatgagagtttatcaatattcaatttattaatccatagttgatattgtattttgattttaatttttttatcaatgacgaagcataattgtttttcttttctctaagatccgcaaacatatatagagaatatttcagtgaatcacgaataacaaatccataatattagcgccaattgtatgtctattctaattttatgacatttgaaaatatgaaatcgcttgatttatgtatattcgaatacaaataaggcatactttgcacattccactacgtatgcgacatacccacgagtgcaccttatgacacacgatgtaatagatcgagcaagatctaaatcactattctcactaaatttcatttaaaaagtcaccatagtaagtatattattcgtacaggctgtgacataaacactgatgggtggagtacacatgtaacaccctgaaaattcgatcgacaaaatcaaaactctaaaaatacggattttcaaaaactttttaaactaattgcatcatgccaatcttattcgtctattttatctggatttgatctcgaagattattaatcgtgagtaaagaatagttaattaggaataaaccttaaaaacaaattggtaaaataaatataaattaaaaataaagattgggtgtggatagtaataaataaaatattatcgcgatcatatttggatcaattaaatttaattacgatggaataagaattaaccctaattaaaactcaaataaattatataaaaataaaatatgagtaatattaatctagggtgaattcattagttaagataatacaaatattgagtaaaatacatatatgtaaaattaggaattgtagaatcaaattcatatggaaaataaactaaaatcgggataaatagaaaaatacactggtcattatggcgtaagtgttcgatgtggaccctagccttccccctcctctcccacctatgtgctaacccgcccgagcccagtccgcgcgccgtcattacggtgncaccgtcaacgcgcgtagccaccttgcgccg

SEQ ID NO: 25007 - DNA, 25935 bp, Oryza sativa
  unsure (1)..(25935): unsure at all n locations
gagagaaaagaaagaaaaagaaaagaagagaaaagaaaaaaaaagggagaaagagaaaaaggaaaaataaatagaaaaattaggaagaaaattaggggggataatagtttagaaaatttaaaataattagaatttaagtatagaataatcatggtcctagaattgcaaaatttaattattctttgtaatttctataagaaatcaattcgcggtagtaatttagatgtaattaataactaaacaaatagatgaattcttatagattattatagattatttttgggtaatccctataagtaatcaattcacggtagaaattcggatttaattactagggattttagccatgtgttatatttaatcatttagtcatagactaaattaaatcgtataatatttctaggatttcgtccgacatttagctcgcgatagaaatttctaacctattatatggatataatgctcgggtagattaaattaaaaacttaggacaacaaaatatttatacccgcaaaatagtttaggatattaaaactcgaaattgggtttgccttagttcgcgaataatcgactttcgcattcgactttcatttgaatttatttggatttttatttgaattctaaccgaattcaaatcaatttttgcacgtaactatagcgcctgagggagttgcggatccaagcgaaggccaagacccgcaagactttgagcaaggcaagtcatcactattccttgaacatgttgatcccaattgcgaaattattttgtttacaaataaaattgcatgcaatgatgaacatcccacttgtgattatgccatgccttgattattgttaacccttaaatctttgtaaccatgtttacgtatgagtctctattcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtagggccgagaggcgtgccctacatcggtgtcaccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccatgctcgcggttattgagcaccgggacatgtattacacttggctagactctaaaattcttaaacttgtgtgggatgggatctgcatgatgatttttatactgatggagccacttcctgagaggcgggaatgtggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctctgaattcctctgtcatgtgcatcattgctgtgatggcttgctgagtacggttggtactcacccttgcaaatataaaattaatcagaagcaggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccagaccgctcggtccgatgatttaagactatgcctgcgggcctatgatgtaataattcgtattagacactcgtgtatgtgcacttggtattccagctatgaattcgtgtgtaccaaactacttgatccagggaaatggtactgtttacacgattgattcctgttataaaaacgggggtctacagagctggtatcagagccatacgactgtaggaaaagaccaaaaggcgccccaccccttttctaagttggccaagggagaaattcccatttagtaatactttcaaaaataaaaacgctatgtttacaaaactcggtacaattttcatcttactcttaactattttctttacaaaaacaagttttaccctcaactgactttgggtttttcttaaaattagatggcagattcggattcacccgctacctgggagttgagcttacctcaatcagaggggtatgtcattgagctgcatcggatgttgaggcgtctgcgataccctgggttcccgtcataccgagtgagacagtgtggctcagtttgggaggctcgggtcgagattcacccccgagtcccttccaagttggactacagcttccagacacgtcaccaccgagacctgccagagaccgcgatgcaggatgccgcccgggaggccttcctccgactcagctctattcaccgagctgagttagtgagtaccaagtttgctcatcacccgttccgggaggagggcaactcagtttgcacagttcaagacacgccctgctgctacaacccgatagtgactcggttgtcacgatgggctgaggcagtagatgactactacgaggaggctctgttggagattgacgaccaccagagacgtatgggagagctggagactgagttgactgacctctcagtgcagcagcttcagttggaggaggagcaccaggcttggggcagtgagatggactcactgaaggcacagctccaggtccacggcgaccagttccagcagttatctgaccagtacaacgatcgccgcgggatgatggatactcttgaggagcagctgagagagagtcaggagcacgtcagccagctggaggagcagcttcgagcagccaagatcagcactacaggggcttctacttccacagcagtaggccgtgaccgctacttcttcctcaccccgccgtacccaccggcgttccacgctcttctgggagaggctagtatgctagctaccgagtcaacgccctacctagtggacccgacagcggcacagccacctgttccggagttggtgcacactccactgatccctacaccttctccacagctgggttccagtttggagactccgatccaggtcgactccgagacagagggaaccgacaccgagccagagatcgagccagacatcactgatcctttagaggatgagacccctgttccccgcatcaccttccttggaggccctcgcacccttagcactgctcgcaagagcacacgacctccgggcaagaggcccaagccagatccaggggccactacctctgagccgtggggactcaggtttgcgcgtgccagtgaccaccctctacctgccccgggatcctgcggatggctggaggactagactgacggactccttgaagcttcgatctcgtatcagatggtttttggataatatgcgagacaccccctcccttacctagattgacgagtagtttgatgattagttcgttgtatcttttggatgaaccttatttggactgcgtatgtatgcagtcgattgcatcatgattcatgtaccatttgtgaaactctgtgatgttatttatgatatctattgttgttgtattataaatgagtttattccaccatgcttgcaaaacaaagttcatatcaacataactcccttaatgggataaagccataggagctagttagaaaattaggatacttactccatcaacctacacagatggcaagccgacgttgggcaacaaccagcaatgacgaaactcagacacccgacttaaccactctggccggagttatggccacccaaactcaacttctgcaagctatcgcgaacaaccaaggcaaccgcggagggtcaagctttggagagtttatgaggaccaagccacccacattcgccacagctgaagaacctatggatgctgaagattggttaaggatcattgagaagaagctaactcttgttcgagtacctgaggccgataaagtgatctttgcggcaaaccaattggaaggaccagccggagattggtgggacatgtacaaagaagcccgagaagaagatgctggagaaccaaactgggaggaatttaccatagccttccgtgacaacttcgtgcctgccgcggtgatgcggatgaagaagaatgagttcaggagactacggcaagggaataccacagtacaagagtacctgaaccgtttcactcagctggcacgctacgcgactagagatcttgccgacgaggaggaaaagatcgacaaattcattgaaggcttgaatgacgagttacgcgggcccatgattggacaagaccacgatagtttccagagtttaatcaataaggtcgttaggctggagaacgaccggaaggtcgtggagcacaatcgtaaaaggaggcttgccatgaaccgcccgcctcagaccgcaccccagcgtcctaaagggacaaccccctcggcatggagaccaacagtggtgacaaccagtcgacctgccgcctccagcaatttccactggccggttaccattcagaatcgctctcctgcgccaaatcaggccgccactggatcagtaaggccaggaagctgtttcaactgtggagagtatgggcattttgccaataaatgtcctcatccaaacaagacacccattcgcaccggagctaatgcaacggctattcacgggactgctacccctgttgctggacgaggtctattcaggactccgcagactaacaggaccgctaccggatttggacgcgggcaagtgaaccacgttcgagctgaagaggcccaggaagatcaaggcgtactgatgggtatgttttcactcaactccactccagttaaagttctcttcgattcaggagcatcgcattcatttatatctttgaaagcaagtcaacaacacaatttaaccagagttaaactaagacaaccaatgttagtacattcacctgggggtgagatagcagtggatacagcttgcattgacgtacccatccgccttagggatgtggtatttccctccaatcttatggtgctaataccccaaactcttgatgtcattctgggtatggattggttagcaaagcatagaggaataattgactatagacgtagagaagttaccctgaccacaccctggggatcggatatgagagcaaccatggatcaagatcctaggctaaccgaacgtgttggaggtatatttaccatgctacccctaaagggaatgcccgtagtgcagcgatttcctgatgtgttcccagaggatttacctggaatgccaccagatcgtgacatagagttcattattgacctgatacccggaactgccctcatatccaagagaccatatcggatgccggtcaatgagttagaagaacttaagaagcaaattagggagctgcaagaaaagggatttgtacgccccagttcgtcaccttggggagccccagtgctattcgtcaagaagaaagatggtagcataagaatgtgtgtggactaccgctcactgaacgaagtaactatcaaaaacaagtatccactaccacggattgatgatctttttgatcaactcaaaggagctaaggtgttctctaagattgaccttcggtcaggataccaccaattgaaaattagaaccagggacatacccaaaaccgcgttctcaacacgttatggattatatgagttcactgtaatgtcgtttggtttaaccaacgctccggcatactttatgaatcttatgaacaaagtgttcatggactacttggacaaatttgtggtggtattcatcgatgatattctaatctactccaaagatgaggaagaacatgcagagcacttgcaattggtactcgagaaacttcggaagcataagttatatgcaaaattcagcaagtgtgagttctggttaaaagaagtcgcttttctaggccacgtaatctcggccggtggagtagcagtggatcctgctaaagtggaggctgtcacggaatggaaagcacccaaatctgtgactgaaattcggagttttctaggcttggctggatactaccgacggttcattaaagggttctctaagatagcccgaccaatgacacaactactcaagaaggaaaagaagtttgtgtggtcagaatagtgtcaggaaagctttgagcagctcaaagaaaagctgacctcggcacctattttagttcttcccgacatcaggaaagactttgttatatattgtgatgcttcaaggcaaggactaggaggagtactgatgcaggacggaaaagttgtggcctatgcgtcgcgacaattgcgaccacatgaggaaaactaccctacccatgacctagaactcgcagctgtggttcatgcgctaaagatttggagacattatctaattggaaaccattgcgatatctacactgaccacaagagtctaaagtatatcttcacccagtcagatctcaacttgaggcaaagacgatggttagaattaatcaaggactatgatttagaggttcactatcacccaggcaaagcaaacgtcgtggccgacgctctgagtcgtaagagccattgcaatcatctgagaatggaagggatggtccctgagcttagggaagaaatagctcagctgaacttacatatagtaccccgtggacagataaacaccctggacattcaacctcttttgagaacccaaatagaagaagcccagaaggacaacgaggaaatccgagaggtgaaggaacgcttagctgcaggacgtgcaaaggaattttcaaccgacgaaaatgatgttctatggtataaaaagagaatttacgtacccgaacagggtggactgaggggattaattttaaaggaagctcacgaatcggcttattcattacaccccggaagtaccgaaatgtaccaggatttgaaggagggctactggtggcccaacatgaagagagatgtggccgaatacgtagcactctgcgacgtatgccagaaggtgaaggctgaacaccagaggccggcaggtttgttgcaacctctcaggattcccgaatggaaatgggatgagataggtatggattttattgttggattgcccaagaccgcaacaggatatgattccatttnnnnnnnnnnnnnnnnnnnnnnnnngacggcgagattcattcccgttaagacaaattatagcagtgctaagctagccgagttatacatgaccaggatagtatgtcttcatggtgtacctaagaaaattatatctgatcggggcacactgtttacctcacatttctgggagaaagtccatgaagccgtaggaagttacctcgcatttagcaccgcttatcatccacagacagatggccagacggagagaaccaaccaggtcctggaggacatgctgagggcttgtgctatggattttagcaaggactgggagagatgtttgccctacaccgaattctcctacaacaacagctttcaagcaagcctaaagatgtcacccaatgaggcattgtttggtcgaagatgtcgtaccccgctaatgtggtccgagactagagaacgggcggtatttggacctggcattattcaagaagccgaagaaaaggttcgcttgatccgtgaccgtctaaaagtggcacaatcacgacagaagatttacgccgacacccgaagaagaatcctggagtttaaggaagcagattacgtttatctaaaggtttctccgatgaggggaacaaaaaggtttaaggtcaaaggaaaactggcaccaaaatatgtgggaccattccagatcatcgccaggcgaggagaagttgcatatcagttacagttaccagagaatatcgcggatgtgcacccagtcttccatgtgtctcagctaaagaaatgtttacgaatgccggaagagcaagctccgctggaagagattcacattagcaatgatctcacatatccagaacacccgatccggatattggatgaagccgaaaagaggactaggagcaaagtgtggcgtatgtacaaggtacaatggagcaatcatactgaggatgaagccacctgggaaagtgaagaatttttgaggacggaatacccgcatctattcgaaaactggtatgaaatctcgggacgagcattatttaagggggtaggtttgtaacaccctgaaaattcgatcgacaaaatcaaaactctaaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatataaattaaaaataaagattgggtgtggatagtaataaataaaatattatcgcgaccatatttggatcaattaaatttaattacgatggaataagaattaaccctaattaaaactcaaataaattatataaaaataaaatatgagtaatattaatctagggtgaattcattagttaaaatataaaattaatcagaagcgggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccggaccgctcggtctgatgatttaagactatgcctgcgggcctatgatgtaataatattattacatcgtattagacactcgtgtatgtgcacttggtattccagctatgaattcgtgtgtaccaaactacttgatccagggaaatggtactgtttatacgattgattcctattataaaaacggggtccacaacatagtaccaccatataggacatgtacaaaggtagagtcatggtggagtacacagtaccaccatataggacatgtacaaaggtagagtcagatatgagctctacattatttagatactagcatcctacaacagttagagacaatatggtttctaatcattaatgtatcaaaatactttttcttacttttattttctttcttccaccaccatgcaactaaatttgctctaataaatgctaagagtcgactctgaactgttgtcatgcataacaaccatacccatttctctttcttccatgtcatcgaatttgcttgtatgacaatagagagagaccactataaacggttgtatatgctctaatgcttgtgcttccccatctaatataggaatttaattgcataattggtgattttaccactgtccactgtggtttgtcgcgaccgtgggatgcgagcatagatacaggagggcttctttaccaggggagcaaggagggctacgatgggtttcttttttagtgaacctgcaacagcctcacattgtactagcggattcttcgtgctttgctgcaggaattactaagtaattttttatattatttttcgttacaattcagcgaggagtaaaaagaaaaaaaaaatctcaggacttatcaatatttatcatgaaacaaatgaaattcgtactttaatgtagaacatgttgataagtatatattaaatattataaaatgatagagagatttgtaaaactattggggaaatgatgtgagaagtggtgagtgaatatgtgttgatgaaaaaaacacacactggcctagtagatttgcttaactccagtgcaggtccaaaatcttgctcttgggttcaaaggcgtgctagttgatttgatcctgtaatcaacaagaaggaaaaacaagaaaaacgaggttaaatccataaacaatagccgattggcttagggtcgatgacatatcgttaatcattgagccgacgttattggcattagatcggcaatgaagattaaatcaatataaaattaaatctactcaatcagctgtagatatcaataatatataatattcctctcgaaatatatttaaaccaagtgattaagatagatcgaacagtaagtcgaggcagtataaatcacttatgcttaaaagtactttaagacgaatattatatatacactcatagcatagccgattagatagatttaacatgtgtcggctaatactctgataccactctatatcaagatattaaatgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcgaaagactagggcgacggccacaagcgcttgacggctggcacgagctagacaccaaagccttcatcttccaggaactccacttctgggtttgggaaaaattgagcaagactgagtacaaccaccgtactcaacaagacacacccacaagtgcagaataaatgcaagggagtacaaggggggttataatataaagggttagggtttgcagtaaacagcattaaaagacacttagttgctcaaagctattttgtaaacacgattctagagctatacaatattattaatcaaggccgtgaacccacacgaacctgccttaacccaaggcctacgatgattcagactgaactagcaacccgaccctgggtcccagctcgtcccaagccaacccaggccaaccattccacattttagttgttaagcaggttttaagaattaaaacattaacttgggtacattgctcggcttgcccataaccgagggcgcggctatttgaatagattatactctgatcagaggtgtacatctttacccacaagacacatcttcctcacgtgtaaccacgtgtcacataccaccacggtatacggacggaagatgtgacatagtttccaacccatcctagccatagacaagagtaccgacccaaccccacctacggccggaacccctaggacaggtaggcagaactgagcccctagcagcaggacaccggccctgtgccatgacatctcgactaccgggccgcagctcgtgtagctttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgagatgctactatcaaaaccatgcaccccgagcccagcctaaaaccattttgaggattttgaataaagggggaggtgtgaatccaattccacaataatccaaccattccatagtatccaggtgatatgaatatcccaaagtctagagttgtaaaaccgcctaatgttgcctaattaagcggcgaagcatctaccaaaaatcatactagtggtaccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaaaataattttataaactgggattcaatatattcaaggatgatgtgacttgccttgctcgctttccgaaacgtcggcttcaacctccacgaagagcggatcttctgaagctgcagcgtctacacgaccaacggaaaagaaaaggcttttactctaataaaatccatataacaagcaggaacaaagcacaaaaatgggttcttgacttcttaaggaaaaattagagacttgaacggtccaattctgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccatgggagtggggcccacgcggcagcctcacggtccacggtggaccgggcgcacccgggctcgcaccggccggcgccgtgggccccacgcgtcagccgcacccgagggcgcgtgcggctgacggtcgggccccacgcggcagccactcggcgcgcccgagggcggccaagccggcgcagccggcgggaggcagcgcccgcccccctatggtcaccggcggtggccataggcacggcggagcggtggccgagagaggggaagggaagggggaaaacaagcggcggtccatggctcaccctaggtcgacggcgaagacgaaaaaggcggccggagcggaggaaggcggcggcacggctcgggtcgacggggtcgacggcgtttcggcggtcgacgagcgaaacggaggggtggacgaggtcggtgaggatgcggtgaagccgaaggaggcgacgccgaggtgggcggtggtccggggcgacgacggcggcggaccggagcttggcggcgactgcggagagagagagcgacggcgcgagctcgatttcggcgaggaggaagggcgcctaggggcgtaatgccatggtgtgtttccggggagggtttctatacagccgggccgagagagggtgtccggaaaagaaaggaaaccggcgcggcgctctcgggctccatcaatggcgccggcgggattagggaagggtttcctaatgaatccaaggcagagatgtagggaaaattgggggaaaggaagagggaatcacgggaataattcccccctattgattgcacgcggggaggacggaatgcgncggattcgccgacgacgcgggcgcttggcgcgggcggaacgcgggaacggcagaagaaagggaatgacgggtgggccccacccgtcagcgagggtggcgggcgggcccgcccgtcagcggcgcgcgctcggggagaggccggatgggccgcgggggagaggagagagggggagggagatgggccggaccggcccaagggagggaagggggacttttagtgtttttctttttataaaatcattttaactttgtttatttcttaataattattatttgtgctctgaaaattccactaaaatttatttacgcattttaggcttttaggaaatatacaaaaatcctctaagccttatttggcttttaactttgcacattttaattgttggaggctttcacacggattttaattattctaggcatcatttaagggatatattttagagtcgttttgggacgtgacattaaagcagacaaaatatatcaaatagtaagcctaatatactttaatgcaataagatgttaatttaaagggcagacttagcatattaagtgaacatgtaaagattaaagtagctaaatccggtaagatcggctgaaacctcgatactgtcagggttacggataaggtataccctctatccttggatataggttgtatactgatatggtatacccgcgcgtatacggatagttcctgtatgcgttaaggaaatctatcacgtgatagaaacggagtccacagatagaaggaatccgactcgaacagaactgggtcgttaccatatcgtgaggggtccgatatctccgagttctacttagagatcaactgatccgtggtataaaaggtaccccctgggtaagacctaaggcatcgaatctcaccgccaacacatccaccacagcctacgaagccgaagcctacaggagccaaatcgccgggtgatctagtcgaaccaactcgactacggtctcgtcggtatcatcgagttccattattccctttgtaatatgtgattttcatcatataatctcataccaactggattagggctattcctatcaagggtcctaaaccagtataatccttgtctttcgtttgcttgatgtcgtattgcatagatcctcgttctaatgtaccccaataccctctatatccggtctacgggtttcccccatcgacagtagcgcgccatgtagggggacttggtgctcaaggttctactagtatgacttcaagccttcttgacgacagcgtcaaccccgccatcaaccaaggatcttctaactcaacgatgctggtgtggacccaagtcggcgaaatcgtcttcccggtctacaccacgatgccgatcttgactggcccagcaatggctggaagcgagagcgacgtggttacgaccccgacagactccatgtcgaaggatcctcccgtaaaagcggaaaacggaacatcgacaacgtctgagcccgagaaggatcctaatgtggcccaatcttgtccttccgacaagaagtacgagccgacaaggacaacttccgaggcaacaaggtcctggtgtcctatccataaaaccagaaaacacaccttgcaagcttgctgggattttctcgacgtacaagccgaaatccgtgcttgcagagagcgcggaaatcaatgaacttctttaacccgtgatgtctattgtcctatccacaagacaaagaatcacgacctctcaagctgcaaggttcttctcagtgtcatgaggacgtcacctcctaaggtctagcagtcacaaatctctcctagagatacggacaaggaacgagaagcggcagctatctcagatcgattcgttggggtactcgatatcgatccccacgagccatctgttctacatttgctcgaagaccaggcctcatcgtcgacaagtacaccatgcgacgtgtacactgtcgatgggactagcacatctagggacggcaacacggaagcggagtatcaagtggctacaccggcccagcacatcaggaccatcaatgcaatactgagggaaactccttatgatcccgtcctgaacgcggatctcgatcagtggacagaacgactacgggaatcagtggccaacctcagtaacgcgttcgaggaggccgctgccagggcaccgccagagtaaccggcggctggcggcactaatagggaatagcctgcgcagcggacgccacctcgtcaagctacccttctgcctcgcggcgccagtgatctccgcgaccatctaaaaggccgccgagaagcacgacgcgcccaaggcaacgagagtcgttcccaacgtcgtgtctcttcgcgacatcgtgagaacgaagagcaaggaggacatctcagcgagaacccagaccgtgataatcgccacaaccgccgcgaacatgataatcgcgaacaacgggtgcctggcgatactggtcgaggacgccgacgcaatgatgatgacgacggagatcagcgccagaacaacaatggtgggcggcgacaaggttctcgagaacccgagcgcacaccggaaccgagtgtagacatcggatagacatccgcggaggacacatgatcgccgacaacccactgcccctggcgacgggtgtagggctttcagtcgtgccctgcgagatgtccgattgcctgagagatttcgaccgggagcaatagagaaagacgacagaagcaccgaccctgaggagtttcttctagtttattccacagtacctacgctgccggagcagatgacaacgcagtagcaaattatttgccggaggcgttgaagggatctgcacgtacatggctagttcacctcctgccctactcgttttcttcatgggcagatctgtggcagcaattcgtcgctaacttccaaggaacatacaactgccacgcgatcgaggacgacctacatgcattgacgcagaatccgggcgaatcattgagggactatatttggcgcttcaatgagtgcagaaatacgatccctgagatcaccgatgcttctgtgatccgcgctttcaaatccggtgtccgagatcgctacaccacccaggagttggcgacaagacgaatcacgactgctcgcaagctattcaagattgtcgatcgttgcgctcacgcggacgatgccctaagacgcaagaacgacaagccgaagatagggggagagaataaactagccaaggacgcacctgagtcaagcaagaagaagagtagcaagagtgggaaacggaaagctcgaacggaggtcctcgcagcagaatatgcagacccacccaaacactcagacccacaaggcaacgacacgaagaaaatatggtgccctatacacaagtcggacaagcactacctagagacttgtttcgtcttcaaaaaggcactcgtgaagcaactggcattgaagaagggcaagcgagtacgtgtagtcgagaaggttgctgaagcaactactcaggactcagactcaacatacccagactccgatcttcatgtttcacacatgttcggaggttccacggcgtactcctcaaagcgagagtacaagagagtggagcgcgaagtttgttcgacatggcagggggctgcatccaagatgaagtggtcagagcagaagatcgaattctcagaggcagacgaccccaagactgctgtcaccccagggcgatatccgatcgtggtcgaacccactattcggaatatcaagtttgcacgggttctcatcgacggcggcagctccatcaacctacacttcgccagcaccttggacgcgatggggatcccacggagcgagttgacgcccactgatcaacccttccatggaattacccctcagtcgtcgtccaagccattgggcaagatcacgcttcctatgactttcagccaagcaaacaacttccgaacagagcagatcacctttgatgttgctgagtttgacacagcatataacgccatcatcgggaggattgcactcgcgaagttcatggccgcatctcactacgcgtatcaaatactcaagatgcctgggccgaagggaacaatcactatttagggaaacgcgaagctggcggtgcagtccgacaagcggagcctcgacatggtcgagcacacccccaacccacccgccacagctgagccacccaagaaagtgagcaaaacaaacaagacgccgaagccagacggcgcaatcaagatcgttccgctctccagtgccaacctcgacaagaccgtcaagatcggggtgtcactggacgagaaataggtactcgcgctcatcatcttcctccgtgacaatgcagacatgtttgcttggcagccgtctgacatgtcgggggtccccagggaggtgattgagcacaaactcatggtgagaaccgatgccaagccagtaaaacaaaaactgcggagatttgcaccagaccggaaacaagccatacgagaagagctcgacaagcttctcaaagttggcttcatcagagaggcactccatccagagtggctagccaatccaatcatggtgcgcaaggccaacgggaagtggaggatgtgcgttgatttcacagacctcaacaaggcgtgtcccaagcatcacttccctcttcctcgaatagaccaactagtggactcaacagctggttgtgaattgttaagctttcttgacgcttactccggctagcaccagatcagcatggcaaaagaggacaaggagaagacaacattcatcacgccgttcggtgtattttgctacgtcaagatgccgtttggactaataaccgcaggaaatactttccaacgcacggtccaagggaacaatgtcgaggcctacgtcgatgacattgttgtcaagactaagacaagcgactcattgatcgatgatctccgggaaacgtttgacaacctccgacgatatcgactcatgctcaatctagagaagtgcacgttcggagtaccatcgggcaagctactcggattcctcgtctcaggaagaggggtcgaagcaaatcccgagaagatcaaggcaattgagaacatgaagtcgcccacaagactcaaggaagtccagaagctaactggatgcatggcggcattgagcagattcgttgctaggatgggagaacgaggacaacccttcttcgctctgctgaagaaacaagacacaggaagccgaagatgtgtttatcgcacttaaaagctacctgtcaaatccccctgtacttgttgccccccaacctaatgaagaattattccgctatattgccgccacaccatattctgtgagtaccgtcattgttgtcgagagagagaaggtacaaagaccagtttattacgtcagtgaagctctctacgacgcaaagacaagatacccacatatccaaaagctgttttatacagtaatcatgatatcaagaaagctacgccactacttccaagcccacagagtcacagttgtttcctccttccctcttggtgaagtcatgataaacaaagacattatcggccgcatcacgaaatgggtagtcgagctaagccaatttgatgttcactttgtgccacgaacaaccttcaggtcccaggtcctcgccgatttcgtagctgactggactatgcctgacaacaggtcagaaagtcagaccgacaacgagatatggacaatggcgtttgacggcgcactcaatagccaaggagtaggggcagggttcatcctgacatcaccttcgggagatcagttcaagcatgcaattcacctcaactttagggcgaccaacaacacagccgagtacgaagaactactcgctgggataagagcagcagccgcactaggagtcaagtgactaatcgtgaaaggggattctgaactagtcgcgaaccgggtgcacaaagagtacaagtgctctagccccgagttatccaaatacctcgcagaagtcaggaagttggagaaaaggtttgatgggatcgagatccgacacatatatcgcaaggacaacatcgaaccagatgacctagcatggcgtgcgtccagacgagagccactcaaacctggcaccttccttgacgtcctgacaaaaagaggcaaacaacgaagatagcacagtcgtccccgacattgactcgggggctacaaaggcagtacacgtcgttgccgacatcgagaccacagacgactagcggaccccactcatcaggttcctgaatagcgacgagttgcccaaggacgatgcagaagcagataaaataacccgacaagccaagatctactgtatgatcggcaacgatctatacaaaaaggcgccaaatggggtacttctcaaatgcatttcattcgacaatggcaaacacctcctcctggacatacacgaagggatctgcaagtcacacgccgccggccggacattggtcggaaaagctttccgacaagggtttttttggccgaccacgcttaaagatgcttgcgacatggttcagtggtgtgaagcctgtcaatttcacagtaaacacacaaggctaccagcgcaagcgctccagactatccctcttacttggccgttctcgtgctgggggctcgacatactcggaccattcccatgaggacagggcggctataggttcctattcgtggcgatcgacaagttcaccaagtggattgaagcaatgcccacgggggaaatcaaggccgacaacgccatcaagtttatcaaagggatattctgcagatatggtttgcctcaccgcatcataatagataatggttcccaattcatcagtgccgacttccaggactacttcatcaaattgggagtcaagatctgcttagcctcggtttctcaccttcagagcaatggataggtcgagaggacaaatggcatagtaatacaagggatcaagacccgtgtctacgacagactcatgtcacacgacaagaagtgggtcgaagaactcccctctgtcctatgggccgtgcgtaccacaccgacaacgtccaacaaggagagacccttcttcctcgcgtatggctcagaagctatgctccccacggagctacgacatcagagcacacgagtacagaagtactccgacgagaatcaggaggagcagtgaagcgacgatgggaatctactcaaggaacatcgagaaagagttaccgtcagagcagccagctaccaacaggcccttcgccgataccacgagaagcgcatcagagcacgcacgctttcgatcggcgattacatcctccgacgggttcaaagccaagcaaggcgtaacaaactctcacccaagtgggaaggaccatacacgatcacgcaagtcttgcggccaggtgcattcaagattgcagacggcgatggtcgcgagttagcaaattcctagaacattgatcaattacataacttctatgtataaatcaatagtatccatatttgtaagacatcttacgatttcaataaagttgatttcaggtgaagattacgatcaaagtgtttctttccgacgatcccttaccacgatgacacctagcgctgaaacctatcctcatgtccctttccgccgtcttgacaaggcctctgaggaacttaagggaacttcggctggggacgcccagagtggataaggccttgtcggatcatgtagagacaaacgaccatgtaagatctgttcatgtaagagttcttgccgtgcgtattaaccaagctgtgtaattggaaatttagttttccaacttcacggctgggggctagggtcagtgctttttcaaccaaggcaggtcaggggtccaagagccttatcctctgagaacgattcttcgacgacaaggttgggggctagggagagtgtatgactcaagtgactgatcgaagtcgcaaaatgagaaaacacccatacacaacatatccagagtaagagagcttagctagatagatttcttttctatttcacaagtacctcttacaattcgtaaatattccaaaatatattacatgtttccttgagatattttctacaagatacaaagactactaggacggccaacgccagtccatggactgaaagaccttctctgcgagcggcgccattgactgtgcctgatcgtcaatctctgcgggagtcctccgagagcgtgagaacccttcgtggaggaactcgaggtgcagctgcgggcggtgatctcggatacagtccagcacatgccctctggcatagcggctcgatcgatgacactcctgctttagggcctcgtcgatgcgcttaccgatcccttcgagctgtgtgcaggtcctattcaaccacgagatatatctggccgctgactcctcgggattcccgcgaggaactcggagtttcctgcagactccagccattgccgtgcagcagctcctgaggtacgagttgaaccatacctcgcgacctctgagagcttccatggccaggtctttcttcacttccaccatggtcttctcgagttcggccacctcgagcttcgtcctccagtattggattcgacgatctcggtcggccaacgcactctcgaggtctgcccaacacggaaaggactgagtcaggttcttcttctccctcgagaacacagcaaattaagtcaatccgaacaaaagagtggaggaagtaaaaaccaaggtgcaaacctaaggacgtcatagccatattcgtctccgcggacaggtcttgaccgacatcctcctgcgacacgtacggctcaagcgcaagtgccgggacgattaccggcatctcaggctgcccgtgctgctggacatccttgatgtcgacatgtctacaacgacaacaaaagtactcggaatcacatgctaagaaaacaaaggaaacagctgcatacataaaagcggtcagaacctgcggaagtttttacagcgtgttgattaaggggtacaagggaaacaggatcctactcttcaaaaaggggaagaactgactcccccaagtcaccgacttcctccatcacgcctttgcgcgcgtcatcggcggccccttgatccagagcccttttgaggtcaaggtcgggatatgccagcttcacgcatgcaaggatgtggcatgccgcggtgtagataccgttggacgtctcctcgcagatcctggcagcatgcttggatggtggtcgtgacgccgcactccctggcgagctggtgtaggccggtgtaagatatccgcagcgagccgcggatctccgacaagttgttctcgagctccgacatccggtgctcgagtccttgccgctgcctttcgttgccggccaccagcttcctcatcttcaggaggtcctcgcaggcctccgctaggtcgtgtgccagcttgtcagcgcattggttcgccgacgacaccgccgtcctggcctcctcgatcttgtggcctacgccacgagcaccagctggaggatgcgctccatctcagcctggagctccccccaggtgaggacatcagcaggcaggccccgagcgggcacaaggccgtcggcggggccgcttggcgtcacctcccagtccctagtcaagaccacgacatctgtcgaggccactacaagggacgcactggagcccgcaccggacccgtcttgtgccaccttcgcccgcgccaccctgcgaaaaatttccgctctttcataaaatcaggcgatcaaggtttcgtgaatgaaaagacttccaaaaacatctacttacttctcgccgatcttcacccgcctctgccttcactgaggcgggggagacgcgtccgtgacctaagcaagatagcatggtgtgaggttaaaacattccgattatgcgttaaaaaaaagaggcttaccgatggattaggcgcctttcgacgggtcccgagtacagaggagaatttcctccccttctttggaacgttgctgccgcttgtggtagaagcagcgacgtcagatgcctccttcgcgatgccctctttcaatgaagccgccgcttgatggtccgcaagcggcccgatgacgtccgtcagagggagggcctgtgcaacatgaagtcacaacacgatcctggcagaaaaggggtaatggagtcatcgagtacactcacgttgatcgcagcttcgcgttcagccggacccttctcgcaaagggggacggggatgttgctcgctgtcacaggagcgctgatcatcacctggccaatgcggcgtgccatggtgtccctgtccaaacctgtagatcgaggacagggactcgatcagtcaggagaaacagacacatccggaacaaattctggaatacaagaaaaataccacgaggagaaacccgggtcgcgtcctccggcccagagtagtcaaaggccaggcacgagcctggagcagttggatccgcctacctacgaagtcggcaacgacttcgtaccatgacaacccccgtactcagaggtcatcgataatgtcgatgaaagactggagggagggagtcagggcgggtttggcggtacactctggaatcttgtctggttgttcctcggggacaacaaggacaggatccgagttttctatctgaagatagaaccatctcgcccgccatttactgcgagaggaagggcactagaaggggatgtaacatgacatccggccatcccgaagtcggaatccaacgcatccagataccctgttggatttcatccagcgcaactcgtagtaaaagcggaagggatcaaggaatggctctaccccaatgtaggcctcacaaagataagagaagatactgaggaacgcgatggaattggggtttaggtgaagcaaggaaaggccatagaagttcaagacgagaagaagaaattcggagggcggaggaagaaaaacgcaagaaatgtaatcctcaacctcaaccatgcggcccaagatgggttcgggttcagtacctcctgtttccctctgcatggtcccatgaccagggagggcgccgtcgtcttgccacttctttagagacgcggtggtggaggtagacttatcgagatccatcgccgccggaggatcgccggagaacaaagcaagatgagcaaactagggtttttttttgcgggagcggagaagacgaagggcgtttgaagaccggagtgttctgtggcaaacggacttcaaaatggatccccaaaattcctttcaataagcacactaccgacggtgcgtattccaagcaaaggagagagattgccgccggaaaattctaggtccgttacgcgcaacggttttcggacttcaatttaaattcactcgtgaccgttgaacttcgtacgatgttgtcgataactatgtgtatctacggttatcacaccgagatcgactagatgagaacgacaacgattctgacatcagaagtcgcgatcggttgcatgagttcatttaagcagaagtcgggggctactgtcggggttacggataaggtataccctctatcgttggatatatattgtatactgatatggtatacccgcgcgtatacggatagttcctgtatgcgttaaggaaatctatcaagtgatagaaacggagtccacagatagaaggaatcctacttggatagaactgggtcgttgccatatcgtgaggggtccgatctctccgagttatacttggagatcaactgatccgcggtataaggatcccctgggcgggacctaaggcatcgaatctcaccgccaacacatccaccacaacctacgaagccgaagcctacagaagccaagtcgctaggtgatctagtcaaaccaactcgactacggtctcgtcggtatcatcgagttccattattccctttgtaatatgtgatttgcatcatataatcccataccaactggattagggctattacctatcaagggtcctgaaccagtatattacttgtctttcgtttgcttgatgtcgtattatgtagatcctcgttccaacgtaccccaataccctctatatccggtctacgggtatcccccgtcgacagatactatctctattgatgatcataagacaagctagatattgcagttatgaatattacttaatagatcgaactcaatcgaagaagaattaagcataataataaatacaagatccaaacatgatgtgatcatggctaccacggatgcaatcattgctcacatcatggatgaacaagaagatatcgagatcaagtactccaagtgctggaatccgattcggctacctactacactgctgacttcaaacggccaccgaatctgcatacgacctccattttcggcccgtgagtagttgatggaaagctctcggagccctctttctaacggatccagcctcttctctgaattccatctcgtgtggccggaatcacaggaacaaggtgctgcgtcacctataatgggcttatgggcttgtaacttcatttgggaccccggcccaggtggggcccatgtggggtgcgccccaagctggtggagcacgaccctaggcacccctaggttgtcctcccacccctatatatagctagttaccccttcagggtttctggggttttgatagattaaagtttagccattgctacttgcttgcagtgcgcgtgtctgctagactgtccgtctgcttgttcttcggaaccccaacttatcatttgtatt

SEQ ID NO: 25008 - DNA, 10280 bp, Oryza sativa
aatgttatatttcacatctttggcgattataatgatcttggaatatattttgtgcatagagtttacatctgctcagatttagaacttcctgtacatgtggataaaacatgcaagctagagaaaaatgttcttgctaaccaaattgtctcgagtttgccttgtttgattggaagaaacaggttgttgtaaatggactacgcaaagagcaccatatggaaaaaccgaggacggttttccatgatgaaggggaggatgatgtgaccatggctaccacggatgcaaccattgctcacatcatggatgaacaagaagatatcgagatcaagtactccaagtgctggaatccgattcggccacctattacactgctgacttcaaacggccaccgaatctacatacgacctccgttttcggcccgtgagtacttgatggaaagctctcggagccctctttctaacagatccagcctcttctctgaattccatctcgtgtggccggaatcacaagaacaaggtgctgcgtcacctataatgggcctatgggcttgtaacttcatttgggaccccggcccaggtggggcccatgtggggtgcgccccaagctggtggagcatgaccctaggcacccctaggttgtcctcccacccctatatatagctagttaccccttcagggtttctggggttttgatagattaaagtttagccattgctacttgcttgcagtgcgcgtgtctgctagactgtccgtctgcttgttcttcggaaccccaacttatcatttgtattaaattcctatttgtaatatcatattgcttttatcttgttcttgcttgtttcttcgatttgcttgcaagaatagggttgatctgcaccggcaagatcaacaacccacggagaggtgtatcgatcgctaaggcgcaacacaacgtctcgtacggttgtagttggatcgtcaacgtttctcccaaatcatagttatcacaactcaccgaaagatcgggccaataacagccttgagtgttgagaggaactcagggttcatcaggtggtatcagagctttcgttgctcggtgagttttcatttacttataaccagaaaatagcccgaaaaaaaaaattcatacattacgtagccacatttgtgccattgcattgttcttttcagtttttgctttgttgaattttgtgttgcatcgtcacgtcgtgttgctggtcatagcgtttagttcgtttagagtttcgagttctggtcacgttttgtaccactgtcatcgtcgtcgtcgtgtgctttgttgtcgtcgggacctacgaaaacggaatcgtctttccgccaaggtttcatttttctagttttcagaagtttctatcggtcggttttgttgttgctgagttgcatctagttttttgtggtgtgattctgcgctgtcccgaggccgtgttgctgccgtgtgttccttttgccgtgcatgtgtgtgcgaggaagaaggaaggaggagagatctgtctagattagattggattggtttctgtttggtggccaacgtagaaaagaaaaaggaagggagggatttgtctctgttttcacatggagcctttccatagatcgggaatcaatctccacccgtgaccgagatctccagccacagtttcctctcggcattggtgagtccgactccctccatcccctctcctcacggtatagatagcttggtgaaaaattttcgtgtatcggattggagatccgtctgcaaaaacggaacctacgggacgagagcattacatttttatatagttttaattttgagtttggacatttacagttgagtccttgtattttttttatatttacatttgagtccctgtaaacttgctttatagtccttgaggttgtttttgttagaaaaatccaaaaaaaaaaggcagaaaggtgcataaaaaaagaaaagaaaagccgcaccaaaaaaaggaaaagagaaaaatcagttgtatctttgaattttctttcatatatcagagttgtgcataagttgttcctagtgctatcttgtggtaccgtttgtgtctagactcgtgtctctagtacgatctagcctaggaccagcatggtacttgactttgaaccattattcaactttgcattctctgatttgaaccattgctttcctttgctacatatttaagcctacccagagctccacaaatttgattgcagccgtacaacaagtgtttgccgaggcatcgatacatccaacctctattggggtgcttggttgagtcaccattccacctgcattggtaagatcttgtaagagcttggttaaaagcttgagtgtgtgtgagatttgagctgccactacctagtatttgataggagcgtgtatattcttgtatatgtttcttgtttgctgctaaccatggcaggattgcgcaaggggaaacaagatggtcatgctcaacgtcaacatcttcaccatcaacgagatatagcgacttcttcacgcatcacatatgaggtacatgataatgatcttacaagggtagaatctaaattgcctagttttgatggtaagtatgattccgccgcttatgttaattgggagctagcagtagaaaaacaatttgatgaatatgatttttctaatgctcaaatgattaaggctgctagtaataagtgtaccggttctgcatctttttggtggcatactgtgggaaataagcttgaaacttgggatgaatgcaaaatactgatgagaaaaagatttgtgttttcatactatagacgtgctctccttgagaaatttgaacatctaaaacaaggtgacaaaactgttagggagtactttcatgattttaaaatatgtatcacttatagtgatttacaagaatctaatgagaacacaatgactagatttttcagagggcttaattccaatattcaggctgggcttgttaatgtgacatataatcatataggccaattgttcatgcttgcttgcaatgttgagcacaaaattttggagaacccaacggagcaacaagctatgcttgtgcctcctatcactgatgttttgcaggaagttcagaacagtccccaaaatgagaagaacgatatgtttgagatgtcacttccttcactcgcgaatgaggagaaggctgatgcacctacattatctgaagaaggcataaaaggtaaattaaatggtgcagaaattactcaaggtgagtatgcttctgatgaattacatttttccactttccatgctgacctagagcaaactttagtggaacctacttctgaattgcctttgtcacaagttgatttgcattctgttccttgtgataaagaagagttgtgcaatagtacttcacttatatccattctacaactagtgaatgaacatgcttcttttaatcttgattctccatgtactgaatttaagtatgttattcacacgtccggcgagaatgatgaacttcaattgcaatcttctttaaatacattggggtattttatgtttgatggttcttgtgagctcaattgtttgaaggacaaaatatttgctcattctgatttgccatgtcctcgtaatgttatatttcacatctttggcgattataatgatcttggaatatattttgtgcatagagtttacatctgctcagatttagaacttcctgtacatgtggataaaacatgcaagctagagaaaaatgttcttgctaaccaaattgtctcgagtttgccttgttttgattggaagaaacaggttgttgtaaatggactacgcaaagagcaccatatggaaaaaccgaggacggttttccatgatgaaggggaggatgatgtgaccatggctaccacggatgcaaccattgctcacatcatggatgaacaagaagatatcgagatcaagtactccaagtgctggaatccgattcggccacctattacactgctgacttcaaacggccaccgaatctacatacgacctccgttttcggcccgtgagtacttgatggaaagctctcggagccctctttctaacagatccagcctcttctctgaattccatctcgtgtggccggaatcacaagaacaaggtgctgcgtcacctataatgggcctatgggcttgtaacttcatttgggaccccggctcaggtggggcccatgtggggtgcgccccaagctggtggagcatgaccctaggcacccataggtcatcctcccacccctatatatagctagttaccccttcagggtttctggggttttgatagattaaagtttagccattgctacttgcttgcagcgcgcgtgtcggctagaccgtccgtctgcttgttcttcggaaccccaacttatcatttgtattaaattcctatttgtaatattagattgcttttatcttgttcttgcttgtttcttcgatttgcttgcaagaatagggttgatctgcaccggtaagatcaacaacccacggagaggtgtatcgatcgctaaggcgcaacacaacgtctcgtacggttgtagtcggatcgtcaacgtttctcccaaatcgtagttatcacaactcaacgaaagatcgggccaacaacagccttgagtgtagagaggaactcagggttcatcaaaacaggttgatgaaaacctctaagagatggtagatatgctatataatctagattaacaacgatatctaaccctatcggttgcgttccattaatagatgttggccggtttagggttggattatgatactaataaagattatgaagcatataagataactcgacgatttacataaccaatgaagcataaagatgtaagcactaatcccgagaatgcaagccgtcataataagttttacctcttgttgaagatcgaaatcgatgcagctcaacctgaaagtaagaactcatcgaaacaatgaaagtagaaaaaggtggcgatgcgccgaaagtgttattgaactgtcgttagatgtttacatgggatcgggttatatttatacccgatatacatgacaggtccttgtagggcacgactcttatctctaacaaactctaatatacgaacaagttttcatggcagactcttgcggaacatatctgtaaagaaactatttaaaatatcctaattaatagatacaattgcctatccgtgagcttatctcaatcatggcaatccttgcatagcatgttgatcaatcccggagacaattatataaccatcttaacgaaatcggctacatcggatgtcttctgtctgatctatgtcagccgatgcagtctttagccgatgtcctcgtagccgatgtgcactctattttcagaagacaaatccgtatcaaatcctcttcgatcccgatacgaatctagttcatggcttaccaaatttggtcgttaacaatatgcttgcatgttgatttgtagaattaaatagattgtagatgctcttgcatgcttgcatgaggttgaatatgtaattattgttagtagatgatgatgttgaagtatagattagaaagagaatagcatagaacggtgacacaccaaggtggtcactaaggggtgttaagcgacccggctgattattcctgcaagtgaaaaagaaacggctaacactaaactagacgctcataaaagagtaagcgaggagaagaagaacatgaaaagctaggtgtcaaacaaagctcccacagggctggctgtggcctctgggctctggccaaaactgtcctttctacgcacaatctgttcgaccaccatagggccgcgaccatggttagaaatttcgtttcaaaattttggtaattcgacccccaccgacaaacacaaatctctttgaaatttttggttttttatcaaatatttttaatttgatcaaaatttattcaaattcagtcaaaatatgttaaaagttcaaataatttcggttaaaaaaaaccctgaaaatcataaaattttcaattttttggcaaccaccgaagcattggaaatttctgtagcaaccgaaattgtaaaccctggctgcgacaggtttaacaacttaattgttccaattagaggagtcaatggtagtactccgtccgtcccattttaagtacaaccataagtttctgcgctctctcaattttgatcgtccgccttatctaaaatttttttataattagtattttttgttgttatgagatgataaaacatgaatagtactttgctcattacttatgtttttaatttttttttaaaataaattttaaataagacggacgatcaaagttagacgcggaaaacaataactacacttaaaatgggatggagggagtaagttggtatgtcaagaacgacggctttgccatctggtgtggcatcgttgtcatcgagatgtcggtcgtccagccggctggttcacttggagagctgggaatagataggttttggtgctacggttgtttcgatgtgtaaaacatcaggagccactgtctcatcagcttgattatgatccttttgattgattatacggtttctccgtttcttcagtcaaccactgttatcctcattgggcttcccactagaaacctcactacaaaggtcatgatttcacacaatctgtcttcctacttagaaacacaacctttctatgtggcagataatagtctctctaggatgaaatttgcacatctataatacataagaatattatttcttggatctttaggtcatccatcgacaatgaaagggttaaacttaaccgcatgcaaatcaaatataattaataataatccaaaacatgtaagatttcagtttcacattactcatgaatacattgtttatctttcggtgtaattttgtcaaaacttttggaatattgacatgaccatgtgcgtagagaccaccatagttggagtacttgtaagcgaagaatatgcagcgaccgtcggtggtggagatcgtcggctcggcggtcgtcggcgaggccgtcggccggatatgctcgtacctcatcagccgcggtgaggaggaggtggccgccggcgatggagccgagcatgacgaggagaggatggaggtggcgctgctcaagattcaggccgccgtcgaggaggccgacggctggcacatcaccaaccgcccgctcgtgcggtggcgcgacaagctcaagcgcgccgccgacgagggcgagtgcgtcctgcgggagtacaggcggcggcggcggcggcgcctgtgtgtcgacgatgatgatgcgcgccgcctttggtttccgaggcgcgttgctcgggccgccggcaagaagctcttcgccttcggcggcggagacgagcagcggctgagcggcggcaccgtgcggcggttcgagcggctggcggacggcgtctgcgacttcgtgaagctcgtcgagagcggcggccgcgccaagcggtttgtgccgttccagccggtcgcggcgtcgctgctcgcgcggagagcggtgagcttctccgtcaagccgccggcgtcgccgggcgccacggcgcacgcgttcgcgttcccggacctcacatcaccgtggcgccgcccgcgcgcgcacgtcgtgttcctgtacgcggacggcggcggcaccggcgagaagctggagctgttcgtggagctcgacctctctgagagcgctgacgtcatggcgctcgctctgtcctccatggacgcgctgccgccgcacttccgcttcgcctccgccgccgccttcgggagcttccaccgcttgcaggccatgacgcaggacgacggcggcggcgaccacctcccagcgtgggacgcgcactactgcagccagccgtcccggtacgagcagccggagtggatggccgccggatacggcgacgagccggcatcggtggcggcgctgccggagcacgtcctctacgtggtcgccgagtgggacagcccggcgagggacgcaccgcgcacgacgccgccgccgccgccgcccgtccacgtgagctaccacctcgggcggcagggcgcggactgggcggtgcggcgggaggagatggcgaggcggatcatggacggccggttcgggacgcgcgcgcggcgcgtcgagaggcacgtggacgccggcgcggagaccttcaacggggtggtgatgtgcacggtggacggcttccgccggcgaagtaaggcggcggtggcggtggcggggcaggtggtgcggtggtgcttcgtgtccgggtgggtggtgtacttgtccgtccggggcgtcggcgccggacagccgtacgaggtaggcttccaaggatgatgatgccattgttgttgaatgttggtactcatcctctcacaaatctcattatgaattgaaattagggatacaagcggatcgatccgtgagtttaaataaataataatttatgggttttcgcatcgtggcctaacttgctgcatctaaatatacaaatggatcgatctataaacctatttatagttaaattcatagttaacccgctagttaaaccggggggttacgcactatttttgtctataagcgggtttgcaggtaaacccacttgcacccctaattgaaatcaaatatgtgctttgtgtactcttcgaagagaaaattgcctaaattttaaatattgagagggagagcttgaaaagcaatgagcaaagacaaaagagtctctttgatcatcatgtcttagagcaaaacaatgtataaagtgaaagtaggcattaatatgggcccaggtggataccaccattttatatggacatcttcacagtgtatattaaaaaagtgggcattaaggtggactccatgttcccaattactactactctctgcctcatcctcatccccatccccatcccgactacctcatccccatctactccgactccgagagagagagaccgcgagaggcggcagcgtggcggggtggcggcgtcggattggcgatgacggctgttgattcggtgacggagtgacggcggcggtggttgatccggtgacggagtggtggctatgtgcgaccgcgcgcgcgggcaaatccggtagcggtcctaagtggatctccggcggcgtcggcgatggtcgacggtggatccagcgtcggggacggtggtctcgagcagatccggcagccgtgtgagcgagcggatctggcgggagtcgtgggcagatctccgacggcggtcacggcctcgcgggtggatctccagcgacggagacgacagtggcgggcggctctccggcgacggccatgcaggtgctccccgtcctctttcactctcccatggtgggctcgttgctgcttctcctctcccatggcggtaaccaactactttggagagagacaaagctagagcaaataagatcggattgtttattccttatgggtggttcttatgggtggttcttatgcataatgctacctcaagaaaaggatagctataagaaccacctccacaatatataagtagacctatgagcataataccctctcttattttcacattgtgaatgcccttatatgtagaaagggagtcgaaggacggagccagagaattgttagcgactcaccacgcggagaaatttactcgtgaagggaaaaaggcaaccgcccaatacccggatcaggactgacaatttatattggaaccccttctattattgcatgctccctctaaataaaaaaatatttacaaaggcaccccaatatgctagtcgatacgcatacaacccgcatagttagggcttgtttagctcccaaacaaaatttttcacgccgtcacattaaatattcggatacatgcatagagtattaaatgtaaaaaaaaattacacagttcaccagaaaattgtgagacgaatcttttaagcctaggtggtgtttgaaactcttgaagatgacgatgaagtaaagattaagtgttttacgcaaaatgaggtggtaataacatgtgattcattgagttttaattacaacaaacttaaaaaatgattaatcttatattttagaacaactctcatgtaaagttttcgcacgaaatgcatagtttatcagtttgaaatgcgagccacttttatctaaaagtttatccaatttttattggagaaaagaacagggcccaaattgcgctatgatttgacaatgtggtgctacagtaaacatttgctaatgatggattaattaagcttaataaattcgtgtctcaattttcggatggaatctgtaatttgttttgttattagactacgtttgatatccgtatatccaatgtaacatacatgcatt

SEQ ID NO: 25009 - DNA, 1187 bp, Oryza sativa
aagtttagggaccggtgatgaactttactctttttctatttcgaatagtgacccaactgtagcacacagcaccttgcatgtttgcctctggaagcgtgacgcctgaccggccaaactaccagccacaggtccattattactactttgtacgcctttgtttgtcttgacaataatccaaaaatgcatgcttgcaatcatcctttcgcttatctacatgcttttttaaatcgctcattactatatatatcagtaaagaatgtggtcaaaagcaaatactataaaacatttgtacagatccttctatctataacggcctctaacatacctagaaatagcgggccattacagggaagtcatctcaatcaagccgaaaaagtgcccgattgagatatggtcgcacagacatattagatgggcatgaaacttaagcccgtcacggatgacacctatcagtgacgggccgtagtttaggcccgattgagatacattccatatctcaaacgggcttgaagttggggcccgtcacagatgaccatcatccgtgacgggcaccaactttaggcccgactgagataacattccatatctcaaacgggtcttgagttggggcctgtcacagatgacaatcatctgtgacgtgcaccaacttgaggcccatcacagatgactcatcagtgacgggctatatactaatccccggttgacatgacttaatctctatcgggcattaattaaagcccgtcaccaatgagtatttttccattttttatatgaaatgtttatatttgtaagttgaactatagcaaaataattaacttggagtataataatgtattttatgagtcaaaataattttacgggtagtaaatgatatcaaatggaaaagtcatcaacaacaaagttgtataactcatcaagatctataacttctattttggtcatttttctatataacattttttgaatagtttgacttttgaacttgaaaatatgacaacttcaaacaacaatttcaaatactaaatgatttcaactgaaaaaattatcaacaacaaacttaaataactcatccagatctataacttttattttggtcatttttctatataacatttttttgaaccgtttgaattttgaatttaaaaataagataacttcaaacaacattttcaaatgctaaatgattt

SEQ ID NO: 25010 - DNA, 546 bp, Oryza sativa
  unsure (1)..(546): unsure at all n locations
tacaaatattgagtaaaatacatatatgtaaaattaggaattgtagaatcaaattcatatggaaaataaactaaaatcgggataaatagaaaaatacactgttcattatggcgtaggtgttcgatgtggtccctagccttccccctcctctcccacctctgtcctagcacgccccgagccnccgtcccgcgcgccgtcatcacgtcgccaccgtcaccgcgcgtagccacctcgcgccgttcgcccgccgcgccgccgtcgccatcgtcgccgtcggcctcgcgccccgtgccgccgcctcgagccccgcgccgccgcctcgcgctccgcgccgccgctgccacgctgtcgccgcgccacgcgcccgtcccgtcgccgcgccatcatcctgtcaccgtcgcatcgccgtcccgcgccgngcccgccgccatcgccatcgccgccttgcgccccgcgctcgcacgtcgcgtcgccgcgtcgagccccgcgccacctgtcacaccgncgttccgagccccacgccgctatcgtgtcgccgcccgcgcg

SEQ ID NO: 25011 - DNA, 604 bp, Oryza sativa
ctagaatgacttacattgtgaaacggagggagtacctttcactcttcccctattggtggtcatcaggtcttcaggcaacatttcagagaatcaagttatttgcttgtaaaggcttaaaaatgaatgttgaaagttgaaacctatgacaatcagtgcaatatttgccaacaaactaaacacagaaattgtaagttacctggacttctcacccttccaccagtcactgaaggttcttcactgcttggtaagatttatccatgaattttatagagggcttgcctcacattgagggatatactgcaattttggtagtggtagattgtttcactgaacatgcccaattttaccctctgaagcatccaatttcagcagtcatagtagcagaatttgtcatggataatgttgctaaaactcatggtattcctacattaatagttactgatcaggatatatagattactcaccagtaattttggaacgacttgcttgcgaagcttgatactcaattgaacctagtaccgcactccatccacagcctgatggacagacagagcggattaatcagtaccttgaaatatacctacaaagcacactccatgaaacg

SEQ ID NO: 25012 - DNA, 3853 bp, Oryza sativa
  unsure (1)..(3853): unsure at all n locations
aagggaactggctccaatcagtgctagagtggggacacatacacacacaaaaaatatgtaaaccaacctgaccaatttttgttgtttgggatggacacgctattttgagcctgactcattgaagagatcaaatcccaaaagaagacatcaaatatgaataagaatattcttgagagctcacttgtgtatagccaattgataatctcatcgcatagtcatttgtgatatgttgcttctctgttcctgtaacagcatcatggtgctgagcaagagctagagcatcagctaaagtatctgttgtgagatttaatttgctttccccttaaaagaattccagaagccaagatgcctgaaaagtgaaaagaaataagatattaagcatatggcaccacaaagtaccaagggaacaagaaaatatatcacatttaaattggacatgtgaaagccagaataatgaaaagggtggtaaaaccaccaatcatagcacggactgttgttttaaggaaggtcttcttgtgaaggaaccagtccaggcattcgggttgtccgcataccaggtgtaagaaatacagtcaaatgcatgtgaaagaaacaaagtgaaattacccataccaattatgaatatgaaaatagaacatacaggtagaaatcatttgtcttgagaggccatggctcatttaagcatattttgcatcagtataaatggaagacatggaatagagagcattggcatggccaattaagggaatggaataaacacgttgaaatcatcatatcacaagttcaagatatctgcattatgtaatgccatgactgcaacttcatggtgaaaccaaaacaaagaaactaaacaatagtcagtattagtaatattaatgatcatctttaaccttattgacataatgaattagtttgtccatcattctgaaccaactttatccataatgataaatcataattgaattttgaagtctgtatccattgtaatcatggcatggtttgtcgtcataatatttgcctagagaaaagaaggaaaaaacatgaattaggatgaatcattcattcctaagcagatcgatagcttcaagttaaaatgttgatattcagaaataacttttgagtattaaaagcacaaaggtcgatgtatcatggaatacagaacagcaaagatgcattctcatcttctgacaaacacatatcactacaacatccggaaaatccagtgacattcaataaatagtttgcagttgcatcaatccatatgagactaatggatttacatgaaacgcacataagagagtgtacattggcatgaagaaaagcgagaatatttttggagtctaatgtacctgtgctagagctgcaacaaagtcgttcacccattgttcaacattataacaaaaaaagagggcatccagcatagaggcaagcaatgtagaataagttcaatgtagtatgtgttaactagagttctcattaaattacctggaagacaaggtaattatcatcaacttcgaaataaaactcactaggagatggttcataaatttttgggaagatatcagcaaaggatgtgtaagaaaatgtgcatatttcatatgaaatatggattcctagacttaataatataaaattgaggtgtaacatttactatcaaaaaaagagagaaggtttacttaaatcagctgacgagccgagagtcttggagcccctctcacaacctcgagttcttctgttccctttccgcgtatcactatcttggtaatcaacccggagaaaaaaaatcatcaattcctgcatgaaacataacaacatgtttgctgaaccatcccttttctattaagttcaatatgttagtcaaaacactggatgggcaactgttattccaattaacgaatgggttgtgttagactcaatagctatgttgtgtggtcaatgaaagggctctcggtggcgtcactctttaggggatagcaaggtacatatactgacattattatatctcaacataataaatatctatgacgggcaataagtgataacatagttactgttgtaacagcacagcagagttcaaagtttgtcttatcttgcaaactagctatatgatgaagtagcagtgcatcatatacaatatttgcgttagtttctgcccatgaaagaatttgactcgcattaactctcaaagcatagaagtgcatcatatacgacatttgcattagcttctgccatgaaataatttaattcacaactctgaaagtgaaagcatgatcacacaaatgggtttggcacattacttacgcacctaggcagtaatcctgaattgcagagtgcgaaattggatcaatctgccaaccaatccttggaatctgacccccaactactccttgatgaacctgtgccaaatcatagattcatagtcggtatatatatcatgttaatgtagcagtgcacagccgcctcagcatgcatgcacatagccccattcttcaacttcacaagaagcactgtgttcgctatagaatacagacatgagtggcaatgctaacatatagagtaaccaatggggcatgaaaggccacacattagttccagccatccagtgctgatgagcccctccaccgtatccttaatcatgggctatctccaccatttctgaaattgcctagaaccaatgaaaccattggtcaagaaaactcattatgtctacaagtagatgcacattgcttcctacccaaccaaaaaaatgccccccacactgcagcactaaccattttgggatttagtttcagtaacttcaaatcttagaactggtagccaggaaatggctgtagaaacatcaggaaaatagtagtactgcgctttctacacccaaattccaattacaaacagccggtgcaaattttacgagaagaaatcatgcccaacagaactaaactagcttcgctaaacccgtcaaaaacttctccacccaaaaatggggaaagaaatccaaggaccgcgcagcacgggcctgcacattctgcaagcaagccccctgaaccaaaaacacccagaaacaagaatcaaaacaatcaaccgaaactatgaggagaaccagatgattcgtttccaaagttcaggtaaaatttgacggggagaaaccatcaatcgtgcgtaagctagcttccccaaacccttcgaaacttctccccaaaaaacaaacaaagacgggggaaaatcgcggaaaattccaagaactgcatcgcgcagctcgctcgaaccaagtactgacctcctggatggagttgttcgaactgacgtggtagtactacgtcgtcgcggccttgcgggtgtggagcttccccttcaccacccctgccgacgtatggtagggatgtacacgcactccccccgggtggtgggcggcggcggagacggaggcaaaaacggcggcggcggcggcggcgcgaggacggtggcggcgctccatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25013 - DNA, 207 bp, Oryza sativa
aaagctcatgaccatttctagccgaccttgcgagcattctaccgagtaacaccacaccgctcattgtcagtgatgctggcttataagtgccatggtataaatccgttgagaaagctgggttggtactggttaagtcgagtaagaggaaaagtcaatatgcagacctaggagcggaaaactggaacctatcagcacttacatgatatg

SEQ ID NO: 25014 - DNA, 7903 bp, Oryza sativa
aaaattaactcttgcctgtcaagtgcccctatgtatgcaatgggtttttaccatctacctgagaagtttcataagataatggactctataagaagtaggttctactagtagggtttggggaaaaaaagaagtaccatatgctgaaatggaaagctctaatcagaccaaaggagtttgggggtttcggttttctagatactagggtgatgaatctgtgtttgctaagcaaatggatcatgagaattgagaatggagatcatgatatgtgtttacaagttctgagaaggaaatacatggtccagcctagtttttttttagagttctcctgggggggagggggttccagttttcgaagggtttgcatgactataagggttggctggaaaggttagtggttaaaaaagttcatcagggagggtgtgtgaaattctggagggatgtttggctgggtcaggtacccttgaaagttgctttccttgagttgtttgacataagttatcatcaagaagcgactgtgagtgaattatgggagaatgggactcggaatttggagtttagaacgaatctagatgataacagtggtcaagatttaattaggttgagaggccttttaaatgaatataatctggatggtagagcagatagagtggtttggcctaacaccagcaacaagatctttaatgtgagatcgatgtatagattgatcacttttgggggtgttaaagattctgaaatgatgagtatttggaagagtaaaattcctcaaaagatcaagcatttcttgtatatggcaggaaaagggagactaccatgttctactcaattggttaaaaggaagtggagagggggagatgagttgtgtaagctatgtggtaaaaaagaaacctcgaaccatatcctctttatgtgccctttagctagttttacttggtgtgtcattagggatgctcttggcttggacaaaagaccaagtaatatcagtgagggtttggatttggttaaggggaagaaaatgaatagggtttggggtggtgcttctggctactgtgtgttgggcgttgtggttggttaggaacgattgggtttttgaaaatgtgttgattaaatcccctttgcatattgtttacaaaactctttcttttgttcagaaatggtgtatcatgctaaaaggggaggagcaaggtatcttggaaggatggtgtgatcgtctgctggaaaaaatgggacaactgaagacaaatcgattgcctgaagatttgtaactgtgtagttcagttggcccttacctacgcctcatgggaaagacagcctgtgtgctgaactgtgtttttctgttttttaataagactgtttgtctgttgggctttctttcaaagccaggtcaatataattgatctgtttcaaaaaaaaaacaagaagacgcagcacctgccgcgcgagggaggtgccatccgccgtggcgcacgcctccttcttcaagtcatcacagattccctcaagcttggcatcgtcgacggcggagacatcggttgcggtggcggggaacgtcatcttcttccgtgcagtgtcctcgagccctaacgagacatctcggagcataatcccaagcgggcgtgccctcacaagggcccgagcatccactgcatgatgcgccagttgatgtccactgcctccgtcaaggcggagaggatgcgtccggcctcgtcctgacggttgagagatcggacctcgacatcaacgccgccgacggccgcaaggtccgccatggcattctcaacctgctccagcgatgacactagtacagtagataccaacacggaggtgggagaggccgaggaaccgaggctcgaggccgacaacgaggagacagaggcagaggcagaggtagaggcaaagtgcaccgcggagattggggttgaggagctcgccgtggcggcagtgtcaaggagtgcgcctaggaaggcgaaccggtgggaatcgaggcggaggcagagttcgccaaggctgtcagggtagcaaagctcaccacggcgatcgcggtagtggagcgcattgcgaggcggtcgaggttgaggagctcggcgcggcggtcgtggttgagggccccacaagtcagaggccttggctgtctcgcagtccacgtgaccatcgccattgttcctcactgttggatagtatagagagaggagaatactgcgtaacgtggattgattgtattgagcctctgggggccggtatatgtaggagtacgtggggaggagataaggaacgattacagatttggaaggagttcacacaaatcaatcatatcctaatatgactctaactaccatatactcgaacatccccccgcagtccatgcatgagcagcgcggacacttggactgaagaaaaaaccagcaagaatactcaacacgatgatagccctttatgccatagtcgatgtagataaagcaaaggagccgagagagccgtggtcgatgaagccgtgcgtagactagccgtggtcgatgtagccgaagtagggaagccgatgatgtcgaggtagccgagccgtggggcgcgcatggggcgctgtagagtggttgtaaacgcacgggagggcatcatggaccaatggtgcgcgaggacgtgctggagatgaagacggtgatacaatcacgatgatcgtggaggaatatgacgccgaagagccgatgtagtcgaaccgtgaagtacgagacgtcacgccgggtttgccagacccagggacaactcgggacgaacacgcgcaacggtgttgccaataccgcgtagacgaggtagggaaccaccatgaatcatacgccaatgtcggaggagactagcagagaaggccttcgagacggtcgcggcgcgagaacggcgtagaggcagaattgccgaagtagcacccgcagttgccggagaagagcgaagtgtagtcgaggaagatacggcgatgctggcaatgagacatgctggatgaagaagatggtgaagtagcaggaccaacggcctggacagcaacgtcggtagccatgtagaggtagctggaccaccggcctagaacggcgatgatggcaacttgcagacgcagcggcaatgctctaagtagacgaagaagaacccgagtggctgacgatgaccagtgcggatgatgaggttgtcgatgcgcgaacggtgagaaagaagacgaaagcggcgaaactgcggtccgagaggacaacacagctgcagctccatatcgatgcaacggcaagaactaaatcgacggtgaggccacgctgagaagggcctctcagcgttgcaacagccagtggacggggaccatgggcagcggcactgcggcccgagggaacaacgtagtggcaaccagaagattgatggcgtagtacacgtgctcgaagacgatagcagcagtgtgtcgtagccgggcgcataaacgggtgatcaagccaaaattgcatgaggctaggcgacgaagaggaagccggagttgatgccgatgttcgagatgtgcaaatgtcgacgaggcaatggacgacgcaaacccaatctctgatcgggggaaaaacacacacacacacacaaatacaagcagcaacagcactgtagcagggtagcaatccacacgctcgacgacagtccaagctgaacgcagcacagtccttcatcaagtcaacaagctaacctctctgtacgtacatatccacgtgacctctctcctcccttgcatgtagagctacgcaagttcatagcagaagggtacagatacagcagagagagggcggcctatggactagcggcgacccgttggcttggcaggggctgggccggctgggcgcaggtcgacggcggcgactggctgtggagcggagcagagaccggtggacagtgtcggctccaggaatgaatcgttgggtggtcctacttggcatcccaaattgtcacgatgttacaaaatcaagtcaaatatgtcaaatatagtggaaatataattcaaatattgcaatatagctcaaaacatcacaaattgattaaaaccaacatttaagccacactacaagaaaaatactctgtatagacatttttctagtactgtagaggcacttatcaaatacctttacaacaatatagaagcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcgtgatcttttggttaaatcattctaatctttgatacactaaccaactcaactccatgtcattacttgtatacttgttcctttagttacttatatttaatcctttagtacacattatcattctaaaaatgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttacaaaatgcctctacaaaagtgcctctatacgaggtttttgttgtagtgccaatcccatctcttgatttaatcgaatcccactttctatttcacccaattcaagtgcttccataatcttatgaacaaaacaaaattgaagtggcgcttcttaccataaatttccttgactgggaaatcatgtggataacattggtttggacctttcagaatatatgcacgctgaactgcgtcttgttcattgacattatagctcgcaataggggacctcagtcctggatcatattgaagatgattagcatcatactttggaggtgcatcttgctattcatttgttgcctcaacaactagagttggctcaggctgtggctcaactagtggcggctcatcttcttcaatttgagcttcctcatcaataagatctgccctcttcttcgcctttgcttcatgtttccgaaaaagcgatgcaatgtctccattccttttcatgtctcactgtaatttgcattacaaattaatgagatactaagttataatgttatattgactactaactaagttgttgctaaaagaaaattccaagtttcagttttcaatcacattttttcatccacatttttcattcatcgatgaccgatctattcaaagtatatactaaagacaaatgagtaactcgccatctcggtcttcacagaggggcagggagcagcaggggagtagggcactggaggccggagagtcgtcgactcgttgagtaggagggagagggacccgactccggtgcaccgtcgccgccgtgaggggcagcgggggcaaaatcgtggccggctggccgccgccggctgggatggtgctgcacgcccgtgccgggcccgggcggccgacggacgacggctgccgcctgcaagcgcaatggccgccgacgctggcacctggcgcagagcgagagtaggaggaggcaaggagcggggagtcgggagaccggagggagaggtagagatgagacagaagcagcgtgatttgggggaggattggagtggcgggcacgcctgcgcggtgcgcctctcctctgacctctgtcgtcctaaccctagcctgtggtgggctttttctggtttgggccgtcggggggagggggtcctcctaggccaaaatccagggtggtccagggaccacctggactacccactggagccgcccatgccggtggagagcaccgtccttggcgccccggcgaacagcaagaggcaagatcctatcggtcgcagagcccggtagaggtcgacggaccgtcggtgaaggaagtcggccggcaacggggttatccgtggtgtcgtcggtggcaggcaacgaaggcggaggtcggttgcagagcccggcggatgtcgacgcaccgtcggtggaggaagtcggccggcagcagggttgtccgtggcgtcgtcggtggcaggcgacggaggtggaggtcgaaggcgtcggcccacgcagtcacgtcgaagtcgagggagcccggcatagcctgtgaagtggagtcgcggaaagccggcggggcggacgacgtcgccgccagtcctgcgtgggaggcttgggtggcatcggcggcgaccgaggctacacgacggcggtggaggcagcgaccggcgaggatggctcgacgaggaccatggccgtgacatggccgcgacgaccggtagattcatgcgacgacattacagctgctgatgcttgaattgatgacgacgtgaggagaagatgcaggactcctggaaatcgatctctccaactcaacgatgacaacgaacgaaaaagatgaggccgccagaggggatcgggatcgatcttctcggcgacgaaccacgaacgaccaatctgggaactgaaccagatcgatctgatgcgaagacgaaaaaggaaaaaaaaggggtgaccgcccccgggagatcgctactcccggcggcggcggaggcggaagcagagagagggatgctagatcgcccgctctgataccatgttggatagtatagggagaggggaatactgcgtaaagtggattgattgtattgagcctcagggggccggtatatataagagtacatggggaggagataaggaaggattacagatatggaaggagttcacacaaatctgtcatatcctaatatgactttaactaccctatactctactccatccgtttcacaatgtaagactttctagcattgcccacatttataaagatgctaatgaatctagacattattatatatatagattcattagcatctatatgaatgtgaacaatgttagaaagtcttacattgtgaaacgaaggaagtaacactcacctctagctaagagtggtaatgggtcgagagactcatgaatgctttacaaccctatgtaaccctcatatattttaggtgaaaatgtataaaaaaaataattccatcatgctttagatccaatctttaaatttttcaggataaaaaaactcaagacaatcaccacacctacctgcggccatcgatgcatcccaaacaaggtaagtcgataatgcgccatggcgcacccttcctcattaacatttatagcctccgtcagggatctcccattagccacgtccacttcactgccgctcatggctcaccagatcctcctctgcaccggaacctagatgccccaccactttgtccgataattgatttattacaagtttaattctagattgttttaaagataattttaaaaggaatgaaattgattggcattgaaattaggagtagggtggtcgggtggagcttcatcaagatcaaagagtgtcatggcctcctccagctttaggatgttacattgaaatcccctctctttcagtgaagaaaaaaattgtattatagcaaaaaacaaaatgtataatagcctttgtttgaaaacacttttacacattagcccctcaggattgtagtgaagctcagccactgattagaagatttggaaaattcaaccataaaacaaagttaaatcagctgacgatccaaaaagaaaacattcgtcgacgatctttagggtctgttcggcaactacaaatataaaatactgttcttggtgctgcagtacagtaaaaaaaaatcgggattgctatatgtcattcgaataaaatttagggaagaaatcttacagattttggaccactgcattcatgccaagattcgtgcgtcggcttctctcctccaactccagcgggctcccctt

SEQ ID NO: 25015 - DNA, 8185 bp, Oryza sativa
ctcgcaggtgccgttgaccccttccggctagccggcaagcgggccggcggcacggtggggtggtgccggcggggatcgcgcgaggacggggtggcggcggcgtgcgatatgaatcggtggggaggaggagaggagttaggttaaaagggtctgcacgaatcttaaagcatatccaatggtccaaaattcgaatgatatggggtgggattttctgtcacaatatgtataaacagcccaaaaaaaatagcagccgaacagaagcttaatttaaaacaaaagaatgcaactacgtggcgctcgttaaattcttagcatacatgagttctggaggaaaacaacaccaaaaacactattcatctcttaaggaagtaatttgataatttctatgttttttcgcatggagctagcatccaaatagttgttcattgtttgctatcggtcgggcgcctacaatattgcaatttgtcagtctatcatcgttggatacgcatcaagatccatgcacaaaaccaggcttggcctgatgcaatgagtaacgggctgcatctgccctggcccgttaagccgtgggccatcaatttttttggataatggatttttcattaatttggcctctatatccatatatatccgtaaagaatatacatagccaaaaacatacacaagggcaatacacacaaacacacacaaaaaaaaaaaagctagaagacttagcttcaaccttcatcgatgacttattctattcatcccagcatgagaggggtatgaggagaaacaaaactagtttgtgctactcgtcgccgcaccatctccacctctatggaactcaaccataaactgctgcaaactgctatgtccgctttccaccgtcgccatccaaaaacccccttatgcagttgttgcattttgaacgcctatagagtaccacgaagccgcttgccgtcccaccaccatcttccgtggactatcaaactcaccgtagctcctagagcatcatggaaccatccagcatgatatacaccttgtctttactgtcatgagctttgccgaagatgcaccgctaccattcacatctatccgcagccagaccttgacgccgtcactcacatgacagctgctgcctctaggattactccgtcaagagcctccattgccatcatccttatatgcatcaggaaagtcgacggccatcgcacaccatcagcccagccatcgacgaccatcgtccactgccctcgcctgaccgtggtcagaacggggcactggagctcacctaagtcgtcggtgcctctaggacgttaccattgagaaccttcgccgccatcgtctcaacttgtcatggttgaaccaacaatcaacaagaaccttcgccgccatcgtctcaatctgtcatggctgaaccaaccaaccgtcgacagtcatcaccatgctattgtcccaccatcacaggtggagggctagatccctccactgttgttatcgccggtggcagagccgtcactgcccaacaccaccaccagcgcgctccctaccgcctagcaggttgccagcgtgcgctgccgctgccaccaccgcctggccggctgccagcatgtgccgtcaatgaggtatgcacactcagatgtggcaagaaatttgagattaagccatcgtccaaaacaggtttcgtcaaaatgccatcgtctaaaacgggtttcaccaaaatgcaatcctgcacgtaatttggtttcatccaaataccattctcaaacaggccacacgctaatgtcatttctcccttttattgattgttcgcccatcatgcagaacatataaattccttatcactatgtaggaaaattgaactgtatgctaagtagcaataaaatgtggcatgaagcatgtcagaacttcaaataggtttccatcacttgaacagatgaagttacaacattgttgaaacgcaggcatacatgagagcaatggtatttgcaactggcagaaacaacactttctacacacaaaatcattagcttctagtttcagtgtggcagttactgcagggctcaataacctttaagctaacactcgagggtactctcccctcaacatagatcctaatagcgaggagagccttctcagcttccaagagagcttccttgctcatttgtaaacattgacatgggtcaatcttgtcatttctcctgtcatagccacgggtggtgtccaatgtaaggtactctagagacgaagccttctcgagaatgtggttggcaagatcgatcatgctctttgcagaggaaaaaccggttatcatcatgttcttgagattgtcatggcggtattctgaagcacgcattggatgcatggagtcaccactcaatgcttcaaggatcgaatcatgtcttttagctggccgttcaatctgcaaaggattacgtcaatgtctgctttttttttaatgagcaaaaggtactgaataaaagttagccatattaattctctccctcttttatttagctactactttataggaataggatagtgatcaaggcaagtaatttagttgcaaagtttatcaaggccatcaatagtgtcaatatttattactagagttgcaacgtttttatttttttaaagaaagctcatcacatatattttaaagcccataaaaattatattatcatcatgccaattttgctgccactttgtaggtgtcagttgagttagccataggggtcagataaagatagggatgcaagcggggcgggcaagcgggtgtttttagcccgcttatctcacttgtagttcattttttcttctaaattttgtgctaccatatgaaaaatgaagtagtaagcgggtttttatgcgggtagtgagactacccacttgcatccctagacaaagtcttgtctgattgttcgtggaccacatggtaattgggtggcaaccaccaccagtaagcgtcttttaagatagtacatatgagatcagttgcatcatttgcagaacaaagaaatgttacatttgtccaattcaagaaataacaaaaaacatttgcatgaaacatcataacaaataattctttaagagaaaacaataaaatcttgaacataagtggtacctgataaatgatagatagctttgacatataaataataacttacacgcaggataaaagtctccaaggcaggagaagcatcaatgaaggaaaccagagaacaaaaatcatagcccggggacaaatctggtgtaagcagcagtatctccaagcacttgagctgcaggaatttgccaagtacctttggtgtattgactgtctgaagaaaaagaggccgcaaaaattaattgagtacagtagtatacagtgcaaatctagtgatatactccctccgtttctaaatatttgatgccgttgacttttttaaatatgtttgaccgttcgtcttattcaaaaaaattaagtaattattaatttttttctatcatttgattcattgttaaatatacttatatgtatacatatagttttacatattttttaaaagtttttaaataaaacgaacggtcaaacatgtgcttaaaaagccaacggtgtcaaatatttagaaacggaggaagtaacatgctattattatggtgtgttgagtgacaagtgcaattgagctaataagtaaggctaaaaccgacctcattacgtgttgatagataaagcttctgtatgtttggcgcaatggatggaagcttcttgctaccataatgtagcgcgtcagggcttccgtcacaaaacatttgcattttcttcacttgtaataatgcttctccaagtgagatttgtattggggggccagcatagatgaaagtagagagctttggagcactactgtcaatcacctccaattttctaaaatgcaacacttccaggtaattaagctccagcagatgggggatcttcaggacaacaatattatggcagtctgaaagtaacaatcgctgcaaagcacaggatttggatagaaagccgcataattcctcctcagtaatttttactgatcttaaacgcaaacttgtcaaggtactcatctgaccaatttgtatgccagggtggaaagaacagccaccaagtaaaaaagactgaattgagcttgctacccttgatagaagtgagcatgggaaatcataatccatcttgctaactcgggtcatttctagttcaaattctttgattcctggtgcaaacgcaatttgaagccagcggtcaacataactaggatgcagactgaaacaagggtgggttgtaagtttaaacatcttcactcctgtgccagcatgattcagcataatggggtcgactctactgatgaaatcaattgttagtttatcattgctaggtgctctcttatctatgcgtagtgtattaacattaagattgagcctggggtagaatctccaagaacgcagaaaacaacgagatgcacaggcggcacgagctgcatcctgcataggcatgagagtgtgtatgtgataaaggatgtcctgcacaagccaacaggagaggataaaaacattagaaaatggtttattaccactataataataactggcatactgctttttgggaatgaatagtagaggaaactatcaatatgctaaaagaacattttcaaattgaacatggatgcactgctgagttccgtacctctggaagctgcatcttggattccactgtactggcagattgagaatcatcgccacattgacaaggggagttgtctatttcagaagctgaagaagtagctccattacctgcaactaactaggtcatgatgcagaagggagcattttgtttgcacgcatataccaaagatggatagttggacataatttaaagataactataatacaacaaagacatatttttgtgcttgagattactaaatatgaagattaagtacgggcacttaaaacaagaaaaccattagctcatgattaattaagttttaattattttaaaattaaaaaaatatttatctgatattaatgcaacttctattctgcataaaaagtttcagtacgaaatataatagtttgaaaagcgtgcccaacggaaatatcttaatcggaaaaagaaggagaagggacctaattaaataagggttttcaactaacatagaaaatcagagaatcatcattgaaatcaaaatttgagcaaagtcacttgagatttaggccacctgatgatgcagagaagtgcagaacaaatgtgcacttgagatttgaacctagctagttagaagaatccgccgaagcggctgaatccaaccagtttgattgattttacccaccagggaagccgtgggagcccttccaaaggaacaacaggtaatcgaacctaaatctagcgggtgatttgatcagctacgaggggtgggggacaggaggaggcttacctattcgcggcggcggctggacgggcacctccagtatctccatatggccgctgcttagtacaaaacgatgaatctcccaagagggggaaggagcctggggcgatcgaggctctcgagaagtatcaggcgcgacgttcgccgggaacggcgggagcggcggcgcgcgagatcggcggcggcgtcggcggcggcggcgcggggaaattaagatcgcagagccgagacggatcggaggaggagcggctaaaggctaaagtgctaaacccaccgctcgtttgttttaagtgggtcccaccgagtccgactgttcttcgtacgagttcaccggattacggaaaacccaagagaaaaaggtaaaacccgatgaattttcaatcaataccatacagaaaccgactaataccagttaccgtacagtaacacatgtattataagatgttttgactttagccaaaatcaaatagcttcaagtttgactaacaccgtgtttagttccaaactttttttttcaaactttcaacttttccatcacatcaaaacttttctacacacataaacttccaactttttcatcacatcgttccaatttcaatcaaacttccaattttagcgtgaactaattacacccttaagtttataaaaaaaatagtaatattttcgacctaagataaatttattataaaaatatatttaattattaatctctatctctatctctactattataaaaattgaaaatgtttttgccagtactttggtaagtcatccgtgtatgagtcagtttttaaattcgatcgcttttggaaatacatagtgtatttaaataggtttttaagttcgttcgcttttgaaaatatagtaagagccgtataagaattctctttaaaaaaaactcgcatgctaacttaagacgatcggacttctaattatagctcatgatttacattattgtatttgtatataaacttagctaaacttaaagcaatttgactttaaccaaagtcaaaacatcttataacctgaaacagagggagtggtacgtattggtctcgcttttacaaaattcaaagactcttatcacattatcccatatcatattattggacttgtttggtgtgacataaattggccataccaatatttggcaattttaatagtgttttgtgggtgtggctatttggcgcgcgcactagctctccctccacgtgttttttttttccattttttcgctttttctttttttatccccctcctccccttgcgcgtttccttttttcatgttttttcccaatctttttaatcgttagcacatgtattttcaaaatatttgagtcgaaagttttcaaattttaatttgaaagtttttcaatctaaagaaacttttcaaatcttgacttgaaagttttcaaatctcgagtttaaagttttcaaatgtgagtcgaaagtttttaaatccaagttaaaagttttcaaaatttatcttacaaatttaaattttaagtttaaatttttcaaagtttgagttgaaagtttttaaatttgacttcaaagtttaaatcttagtcaaaagttttcaaatttaacttgaaagtttaaattttaagttgaaaatttaaaaattgagtttagagtttcaaattctgagttgaaagttttaaattctacgtatggcttttaatttttcgatagaaagtttaaaattttacatgaaagtttcttttagatatagatttctatcaatatgttagtaaaaaaaactaaggaaaaaaaggaaaacattcccttaattatcgtcattatcctaaactaactcggttagttatgggagaagataaaacgcgcgccgccactcgctttctcagtgttttgtgtcttttggtttgaagccaacttttgataagcctagaaaaatagaccatttcaatagttaacttaagctattttgggttttttttttttgcagggaggctattttggttttaatccagacacaatattgccttatcaagattagccatgctaaaactagacaaaatttagtgttgacaaaattggtaagatcaagttagactacaaaccaaaccagccctataattcataagccgaagaaaatttcacaagggaaaaatggaagataaaggtaccagcacattgctactccagcttgctaccagacttttaagagaagtcaagattcaagaataatataaaagagagaacacaaaagaaacacgtaagagagataagaaaacatagaaaataagcaaaaatcctgccatctaaggctaataataggcttttgctagagaatgcatatgctacagtctcatgcctgagtttacaggaagcagatttcatctgaacacaactgatttctgatctgacactcacagaaggttatccacggcaaaagaggtgagaaaatttacttaatataatctcagaaaagctgagagttcgacgcaattatgcctcaatatatttatctgtcttcctgtttgtacatttcatggcctgcaccacatctttacttgattacttctcactgtgcagaatcgaccaatctgcaatagaatagaacaattagcaggagtggtggaatagattagagagtcaaggtttcgcttcatttcatcatgccatctcatgctgcaagagacatccctgatccatatagctgacttatttgaatgcatgctttgcttatgatgatcagtgagcaaagctggaggcttccagaggacagcgtttcc

SEQ ID NO: 25016 - DNA, 491 bp, Oryza sativa
tgtaaaattcctcactccagaaacactagagcaccataaaaagagtatgggaaaaaataacagtatttgtgcagcttaacaataaatttcggactatcttaaatcaccgtactacatgattgcatcatgtgacaagttgagcatagaactacagctcaaattcccaatttccattaaccataatcctgtgataattacattggcaaaaaaagatcctaattaaccatgtcagaacatatcacagtatcagtgaactacagtcacaagacaactccattcccactgcagattaaatggatcgagtgtgattgtggcaagttacctgggctggaaagcaccgccaaaaggcattggggaatggggacagcgtgatatcatgccttctccaggacaaggcagcatgaattcccagtggcaaatccaacggtcaacctttgcgctgagtcaaaatggtcatccagtggcttaattgaacagcctttagcccacaa

SEQ ID NO: 25017 - DNA, 31743 bp, Oryza sativa
cactgggtctgaccaccctgccggcccgatccaaccgatatacacgcacctctgttacacgcttcaaccaagccttctgtctcgacgaccagcaatatgatttaagcctgcgtgccaaaagctgccgacgttgagtgcccttgctgtcgtgcgctgtctcgattccttgatccttctacgtccaaagtccgagttgaatatgcaaccgacttctcccttgtcacctcgtatatatcaagggcggagacatgcctagggcagctagagctcgagccagtggcggatccagaaaattgattcattggtgtcataacgtgtctatcggtgtcatagtacactaattatgcttagaatatgatgttgtaatatatgaataagtagttttgctataggttttattgaaattcgtcagtgtcgcctgacaccgatgactatactgttgatccgcccctggcttgagccctaggcctgcctctaaaaacttgcttaaattttgttgattcaccatgtaattttttcagaaaactaatactcaattagtcgagccatatcttaactctagtcttatataatttctggctccgccattgtatatatcgtgtactaacatgtatatatcgtgtactacgatgaagaatctgttacggactcctctccaaacagcacccaaactcaagtctgactagctcgtaaacaacttttgcacggtcattaatctctgtgatgtctcctcgttgcaaagtctctcccatctacggcttgctgccttgctgtatgcaagtccgtatcagctcgtgcttgcatgcgtactgcacccaagccacgtaatcaatgcttttgaccaagcacatgcccaatacaccaattaatttgcatgcagcccgtagtttttgtttgtttactttgcatatttacttgcttgattcgtcgcatgcatctcatgtgcgcgtgtagcacgtacacatacatgcttgttcgtgcctctgcacacaccgcagtcagagtcctcgtgttcaccgtccacgaccctatcgtcccggcccttcacgtccactgcgccgcaccacgctcgctggcttcgccacgtgggtcgggcacgttgtccatggcgttacccctccgatctctccgaacgccttcggccacgttcggccccgtcttccgatcatgttccgccatcgccggtctgatcgcgagtgaggtcgtcgccgccgcaacgtcctcgttgtcaccgtcaatctcatcgccacggctgacgacctcgtgtttcctgctccacttgtcttcttgatgcaatgctgaaaccttctgctctgatactacttgttaaagtgcgcagcccggcccacaaccgtaggccaccaggtcacattgagcctgttccaccacaggcccaaccggagccataactttaggtcctaggtctacacaacccaaaagactagtttgatgggtgaggaccgccctcaccttttaaatcgtgctcctccatcatcaattactgatgtgggactaaacccaacaatcttccccgtcacataaacccatgtgacccctaagacttgttacttgggcctcgggtctaacaattttccccgtcacatcaacccatgtgaccccgaagacttgttacctagcctctccactatgtgactcatggaaatcggtttgggttccaaaccttgggttctgatactacttgtggtggaacaggcccaatgtgacctgggtggcccacggtgggtgagccgagctgcgcactcgaacatttactactatgcaattcatttttattatttttcgcactgtctatcttcatgaaaagagctgcttgttgagtcactatatatatcctaggtagaaaatttgtggcacgatcttaatggagtctcacatggatacacctcttttcctctcaagccaagatacagatttgcccgtaggtattcaaaatctccctcacctgaagttagaacaaaggaactgctcttttgaactcttttgttagctctgttctgtagataacaagctattcaatcatgtttcaaagatccccttaacatatatcatccccttctcactgaacttgagctccttcctcatctgctccacttggacatcatcaccccgcacaagaatttcggatacattcccgtcatccgataaaatcattttgaccttgatctcttcttttcttgatgcctttgtccagtagtatacacccctgaaccatcaagaagggacaggttactacatttgacctggaaatttcattctaaatttctgctatagagttgcagagacatacgccaatgggcttaaggtcataagccagaaccagttgttgccaccctccgggactgcaattgatagaacaagaccgacgctgccaaggctaatgcaggtgcagaaggtaagaagtgctgcttgccccctgctcggcaccatagtgccctcaaaactgcgcaaaaaacataaatcgtgcctcattttgcattgcattttgatgtgaaacaaaatgcataagcttatgctagatatgcactatataaacaacatgggcagctttacactgtacttctctacgggaccagggcaaaactaataaatacaactgctatactagtttgggtttccattctattacaacttccaagtaacttgtgagtatcagaattaatgtaattctagcgtaaagcattgttaagtagaaaatattacttgttcatatctttgcttcaatcaagttctgtgtttgaatcaccaaattactatgattgttgttatggtggagatcactgtgaacctaaaggtacaacccacaacatttggattgcaagaagaataaagaagcacattaacacagctggtgtatgtgtaaaactgttgtacaaagtcccaatggtattgtcacaccgtgctaaaagtatagtccaaaggttatcctgtacttctgcatatcatagtcataactcagtagattactgcattaggatagaaatccgatctggctacttacgtgataacctcgccacggtcagagatggtgaagttgttacgggtgaagaacgagaggatctccccagccacctggttcggcgccatcgtctgcccttcctccttgacgaatgtcttctgcacaacctgcactagccaatttgacatagatgacaaccacacactattggtggacatcatgcgaacagctcaaaccgtcagaatgaaaggtaaccacaatggttcacgattggtggatggaactagcaaacactaatttactagtaccaaaaaaaggaattcgcacactaatccacagcacatctcgcttatgctgctgtagtgtttttacttctcgtacaacttttttatacttgtatatataacttttactcttcatgttttgaatgagactagcatgtctaatgccggttaaaaaaaaaggcaaaccacacaaccatgctactgttttcagcaacgaactaaacaacatcacctaaagaccgcacaattcagagaaccagcagccaaacataactaagtcaccatgaaatttctctattcgcatcattgactagacagatttataaaaaaggacgcaacgattttgatacagcaaagcagtcatgaatccctattggatttaatggtggttcttgcactgacaagaacactctgcaaagaagaacttgaaggaagtgaaaaagcaaagcacactcagccactcgttgagctatctacagaagcagcagtcacctccaaagaaaggaggaaggaagacagccatggtccaatgcgaagagctctcgaggctcgagcgcgcgcatggcgacgggcatcgccaacactcgtcagagcgagatggaggaagcagcagaggtggagagccgtaccttggacttgacggagcgcttgatgagcgaccagaggccagggacggagagcacgaagagccccagcgacgtgtagtagctcgcctgcgagtaccccgtcgccccggccaccgccgcgtacaggagcacggcggcggcggccgcgccgccgctgctgtcgacgagcgacgcgcggggcgggacgacggcgcggcgggccctcgcccgtctaggcacggcaccgcgccaccggcccccaccaccggccgccgccgccgcgccgccggcgagcgacagcggcggcgcgcggagaggcgggaggaggaggcgggtcgcggcggcggtggcttccatttgggtcgcgggagataaggccggggaaagtgtattcggcgatgtgttgatttcggttggagtgggcccacatgtaagtgggctgtgggccaggagttcgatgttgggaggaggaggataggacacgtggtagaacaagtgcgcttggttttttttttcttttcggacaaaaagaaatttatggcagttcaaaacaattccgaatttttgtagttagagaaaaccattgcctatgaaatactcctccgttctataatttaagggattttctcaatcaaatttgtctaataaaatcataagacagtattatattcttcacctaccaacttttatactagtttgtttctctaccatctcacatctacaaacttttatagtaccttattctttcacccattgccttgtgtcacatcagatatccttttactacttccttaatttttaccaaaaaagagtataattccttttattcacggatgaagagagtataagcttgcttttatactgcatatgataaaaaaaacctcgtttaaaatcagtacaatgtaaaatgtgttgatccaaaaacagacctgggagatctgcttaactccagtgcaggaccaaaggttggtgagatacggacgtgccagtcagtttgaccctgcaacaaacaagatatgatgagccggtcggctgacaagccaatggagtaattacagccgatgccgataccagccgatgttcgatagggttttgagcaatcggctatatgtatgtagataatgatataaagtcgatccgatgatgatgataaataacaataatataatccaatagaaaccaatcggctaataatgatatgatagataaacatcgatccgaaggttaaagcatacatcggctggaggcccgatgtcataaaatccacaagattagattaaacagtgaaacctttattgtcatcggctagatccgacttatatgtatatgcaatccttataagccaatgcaacgtctaaataacttatcggctagtaccccgataaaacattagcatgaacctatcggcttaacaagacttatattatcaacaacaatctagtagcacaaaattgtatatgattatctaatactcgatgagccgatagatctatctaatgtgatggatataacaaatctatttaggacaacattgtgattgtagagatatatcggctaagacagaagatcggacctaatcgagacagtcccaactaaaccgatgcgtctttaaatacaatgcaattagagatagaattgagatatcacgtaggcaaatatatcaactaaaccagagcgatccaagagatcgaagcgatgcagccttgaacaacaccaacatagccgatagattcatcagggccggcggaacgtaggacttaccccttcgccggagatcaaactgaaccgatgcagccccgcgtcaggtgccaaattccatcggatgataagtaaaaaccttaggaaagagggtggcgatgcgtcgagagtagttgtattgatcgagagataaattacaatgaccctgggtgtacatatttatacacatgggaagatactagtccttgtaggacaagaaagaaacttttctaaacataaaaggaaaatataaagttcttacactaaacacactttcctaaaaataaaggaaactacttcctccgtttcacaatgtaagtcattttagcatttcccacattcaaattgatgttaatgaatctagacatatatatctatatagatttattaaaatcaatatgaatgtggaaaatgctagaatgacttactttgtgaaacggagggagtaacaaactgtcagggttatggataccacatacctaatagtagttgactaaatctcggcaggatccaccacataccatatcttatacggaaacaaccttcggatagggatggagttccggataaggaaagacaacaagagttctacatggaaacgacaaggactactcagattgtgtccatattggttttcctagttctacttggacaaggggacacctatgggtataaatacaaggccccctaggaggagaggggatacggacaacatggaacaacagaagccacaacatacaagccaacatacgccaagacaagacgccggatatcgacttcagagataggcatggctagtcccctgcggtgcctacggataccgtcaggagagatatagcgttgtctctgatctcgccggatgcggattcgaggaggaaagctaccctgttgtcgactacgagtcagaccttcagaccgccatgtcgacaacagttagataggctaccccaaatattgtactggtgtgattatgatgaataagagcaacgaccggcttcggccaacatgatgtagggttattacctgacaattcaggagcccgaacctatataaaaatcctcgtctctgtctcctttactacaatctcgcatatatcctagtaccaacgatccccgtactatgtaaataccagaatcgcgacatcaaacgtcgacacaaactattcctaataacctaattaatagataacttgccatgccgcatcctccgtgaacttggactcttctggataaatttcctttaattgatccgactccatcaagaatacaactgctggcgatttgacaactcctatcggccgattccaaggctttgaagccgatactgactctaggccgatgataacttcgggcttatcaaattttggcgttaacaaagctatacttgtgttctaaccttttctcatatgatccatatgaaatgttttattagtctctctattttcttaatacatgatataattttagaaccactcatcttatttaaaaaattatgtaaatataagacgaatgattaaacatatgtcaaaatcaacagcgtcatctattaagaaaataaaatatattttatattttttacccggcctttatgtccaaccagatatatgcagccatttaaattgggtacttagcctcttaaacaatctaatctaacataatctgaaattcgctcatatggatatttgaacttagaaccttgggatgaagatatagaggataatgaagatagtatatctttatgtcataaaatctatgtggaatttagttatatatcaacaagccattgttgatcaattgattaatattatcaatttggttctgtattgttttgtaaaatagttgaaattaggtgattctgaatattcaaccataaaactcatagttatatcacaacaagttataacatctgatatttttcatacctcaattgtgcagagcaaggttctccgaagttcactctataatttatttcaaaacataataagaacgcagggtctattgctctaatgtagacatgaattatccttagctttgatatgctttttaataggtatggatttaggttaaaacaactcctttaccttttgtcgagccaatcctatatatgtacttgaattcttgttcgagagtttttatcgagggaattcatgtgaagataatagcatttactttttatatcgagccaatccttagtacgtacttgagtcagatattagcatttagttttgtaagtggtcaacttgtacccttaagagcacctaagaaccaggatattactccctccatgttttaatgtatgatatcgttaactttttttttatgatatgttcgactatttatttttctcaaaagaaaattatgtaattatcatttattttactgtgatttgatttatcatcaaatattcttttaaatatgacgcaaatattttttctatttgtataaaaattttaataaataaaataaatagtcaaacgttagttaaaaagtcaatgaggttatatatttattaaaatacctggagagtaataatttttcacgctcgtataccggccggtctctctcctattcttgctcgattctttctataaatcagttaatatggatgagatgataaagccgtgcctatatactcacaccttagaattaatctattaattaatacgttattaagcctaattgacgccggcggccacaaggggaacaacgacgacgtcaagccggaagtgttcggcttcggcggcggcgacactctcgccggaggaggcggtcgcgatggcgtggctgccgttcgatggccggccgcacatcgggctcgtcgtctacgacgacgcgcgcaacacggcggtcctggtgcgccgaggagggttcacggccggctcgctgccgctaccgttgccagcggcgcaggccgcggcggcggaggaggagggagtcgtcgtcggcggcggtggtggcggcggcggcgcgcgcgtccgctactgccactgcggcgtggagagccgggagaaggaggtgcggaggccggggccgacgcaggggcggcacttcttcggctgcggcaggtggacggcggcgagaggggcggcgtgcgattactatgtgtgggacgaggccgcgccgtcgacttttggtctcaactctcaaccaagtccaccacgtgaatagcagatggcgatgatgatccatctcgattgataatggcaaacaataataatgtcgattagttcatcattccacacaccattgttttttttattaatagttgctgtgttcaccagtaatccaagactacgttatccagatacggggatacggatatgcgatacggggatacgaggatactgcattttcttaaaaacaccgatacggggatacgtcaatatatatttaaaataataaatatatagaggtaaataattatgaggctgtaaatagagatagccaatacatgacatcaattgatcaatacaccaaatttttttagtacaggctcaccttagagctcccatgtctggtcgctagtactactaatgaatctgcaaagtgcagccgcatagccacgctagcagtagcagtacgtacgagtgctagagatgcactgccacttccaaaactcattggatttaggagaggagagaacacttagcactaagatgagatggggaaacacgcaagaaatgcagatcgagacttcaatgggaaagaaccaagtagcttggtggcgtactgatggtgttggtcttggcggccagtggagatgctgcacccggtggaggagatgaggcgaccggcggtggccctgcgcagctgcgctcaggggcggcgacgcgcgaggcgctcgagctcgattgcgggctggttgggaccctgcggcttggttggcgatgcggcggcggaacccgacagctagcggaggactcacgcctcgggcatggatgcggcgatggggaggacgtggcccgtgggaactgcatcagggattggagcaatagcaggcggcacggcgacggattggatcggcgcttcgtcttccatggatgggtttgggcgtatcaggagcgacgggaggggacgtatcaacgaagtatccgatttaatttattttttcgaaaatcgaagtaaataacgatacgtacgggatacgtatcggagcgtatccgatacggatacgtggcttttcagccgtatctgggtaacatagatccaaacatctgctaaaagcatttgtctagcgtagatggtgccaagtttgtcgtagcaatgccataccaggacggatccaagacagggagactcatctcctttttttcttcggccctcttcaatgatgatccagcagggagttcctaagctggatccacccttaatatcataattcacacatggaagttcctttgttttggctaccttccctaggtattctttccacagaaaatgcgttcttttggtttggctaattcctcaatttatataagcatacttttcaaactgctaaacggtgttttccatatgaaaacttacatagaaattgctttaaaaattcaaataaatgtatttttgatgtttttaataattaatactcaattgattatatactaaaagtttatatgttgttgcgtgcggctaatcatccgtttcaaaatgaactttagaataggtcctttaagtcgcccccaactttgggggctatttttaatacaaagatgaagtacactactaaaaagggttttttttcatgtggctaaatcatattttcataggcggagcccccaagtgtttgtgaaaaaaggaatttttgcaggcaggtagcacaacaacttgcaaaaagtattttcgcgggcgggtgttatgtcgtccgcgagcaaaaacaaaaatcgcaaaaaaaaaagctttttgaaaccctagttcaaatccaccctagtcgttgtcagatccgcgagggaggtggtaaccactgttggatccatgaggcagagggttgttgccatcgttgtcgatgcaatctgccgccgttgtcgtcgtcattgagacctcatctcacccgaggttgacggtggcggatccgtgagggagagggccactgtcgtcatcgtcgatgcagtccaccgtcgcatcgtcgagaccctgctgcacctaaggccagtggcgcagatccgctactcccgaggtaactgccatcagatccacgagggagaggtccgctaccaccagacctgtgaggggagccggtctctcccgatgcggcggagacgccctatggaggctaaaaaaatcatgagatacacttgctcaaaaaaatttacatatatatgatacttgaccaaaattattaagcatgtgacatgtcatcatttatatgcaatctgtacacaatagttgagcattgttttatctccaataatggatcaaataaatttatacgaatcttttttatccaggtaacacatactctttatatatttcttgctaacaaacaaacactaggatacaaattggtattaccatgaactattgtcctgtgattggtgcaaatcagtaagcaactactactaagcactgagatgcaagaatgtacctttcttgcaggctggcactctgaggagaacaaatcaaggatgctccgctgcttgacggagattagccccagccacattgctggcaacgccggacggcctgctcactaagccgttccgctgccgcgcgctgctccgctcgaggctggccgcgggcatcaccgtcggccactggccgcgcctctctgcccgtccagcgcgccgctggctgcgcctcttcgcctgccccgcgcgccgctccccacgcttctccagcgcgccgctagatccgccgctgccagcgcccgccaaaccgctgccccacgctccggtgaggaccccggcagacccctcaaaactgcgctcaacgagtaggagcaccacggcgctccagtgatgctcgcgacgatgacggaggagccgcacagcggcggcggaggttgagattggagtcgccaggagaggactgcggtatgggctcaagtgggaaggttgacggcctgttaggttagtttctttagaggatataaacgtgatatataaaataatatgaaacatctaataaacatatcatttgtagctcagtggtttgcacaccgcccctgaaacagaaggttgtgggtttgactcccatggccaacatttttttaagaaattttgctgagtaacgggttggcccatttcggggacgatgctgttgggctagcaccaggttggcccatctgtgggtgcagataggcggttcattacacacaatagatggcctgtttaggcttctataggtagcccaattagaacggaaaaacagattattaaaagaaaaaatgaaaataaaatctgatgtggcagtaaggcttgcctacatggacaaaagtatttaaaatagtacaataaataatttgtaacacacaaatacgtcttatgacatactaaatattgtcacttgatgacaatagactagctatatgacatttattgtgacacacaactttttattgtcattaagttgaaatgcctgaaataaaatgtcataaattatatgatatagtgacattatgacatgtgtcatattaaatacgtcaaaaagccacgcatatcttgtagtgacgttgttgccttggacccactgctgtcggagctgcagtccatcggcctcctcatgcacctccacgaacttgtagagtgagagaggatgaggagcagaggactcacccagcggcgattctcccatcgacctcaggtgaggagaggagtgggggtgagaagagaggagaggaggcattggaggagggggagaggaaagaagaaagggatgggacagctcttgtgccaagcggatatcttaagatggccacatgcaagaatcaatttttccatgcgggacttaactgaacatcatctaattttttttacatgccgacgttcttttagcccgcctacaataaatagggttgcgtctagaaaaaccgtttttaaagtagtggtagcaaacttcatattcttttttttttcgaggtcatactttttaattcgatgaccttgtatgcataaaatctttctattgtttgttcagtatagccaatatgtataaccgacgcaaaagtatatacattaacctccgtatcatagtgtagcaaaatctattatcggctagtatactgcatgatattgttgtgtgaaaacgaatcattagtgatattgttgacagttgcaaatagcaagagaacatatgcagtcatgagtcataagggaatatatataaattccttttaaaaactaaaggtacagaaaatgaattcaaaatgtttggggacctcaaaaagtgcgtcataccgtgtcgttcttgagtcacgcgcgcatagtttccgaaagatatttgaccagaaattaacgctgctgatgcgaggtcaaaattctcgtctacctgattcttttcagatttccaggcaattgccggggaaaatctgaaagcatccttacttaaatcagcgtacttgatggtgaatttacaccaaacaattttgattttttgagcgaaaggtaatttgtgtagctgcttgatcagcttacactctcttgaagtttctatatgaataccgcggcggcgcgcggaggcgatggcgttgccggcgtccagctccaggagttcgcctacttcgtggtcatcgacttggaggcgacgtgcgagagggggaggaggatatacccgcaggagatcatcgagttcgcctccgtcgtcgtcgacggcgccaccggcgagcagctggcggaggcgttccgggcgtacgtccggccgttgccccaccgggagctcaccgattactgccgggagctcaccggcatcgcgcaggccgacgtcgacgccggcgtggacctccgcgaggcgctgcgcgcgcacgacgcgtggctggacgcgaggggcgtcaagaacgccgccggcggcggcggcggcggaggagggttcgccgtggtgacgtggggcgactgggactgccgcaccatgctggagggggagtgccggttcaaggggatcatcggcgacggcaagccggagtacttcgaccggtggatcaacctcaaggtccccttccggcaggtgttcgaccgcggcggcgcccgccggatcggactggaggaggcgctcgccgtggccgggctggcgttcgaggggcggccgcacagcggcctcgacgacgcgcgcaacacggcgcgcctcctcgcgctcctgatgcgccggcgaggaggggtcaggctcgccatcaccggctcgctgccgccgccgccgcggccgccgtcgcagctggtcgccattggcgccagcgcggccgcgacgccggcggccgccgcgccgggagtcggcggcggtggcgcgcgcgtgcactactgccagtgcggcgtggcgagcagggtgggggtggcgcggaggccggggccgacgcaggggcggcgcttcttcgggtgcggcaggtggacgccggcgagaggggcggtgtgctcctactttgtgtgggaggacgttgatatgtctcgagcaaatccacggccatagctcatttcgtatttaataataataataataataataataataataataataataataataataataatgtttttgtgctaataacttggacgagctatcagcctatcacgctgtggctttgtaactgtgtcgcagatttacgaaagttttacacttaccgaaggcgactacagacctgtgggtttggcattggtctacttgagttgagctatgagtgccctcatgaaaaaaaaataaattacgtcactttgaattgggacactatcgaatcactagctctacaatggaggtcacgatgtagtattttggtagcttttaaaaaataaattatactatagtaagttaaaattaaatttaaaattttgactgcggaaggtaggaggaagagcaactgaagggttgtctacataaggggacataaggaagatggcaaaatttgttacatggcatttaaaatatatagttttgttgccagacaccccaaaaacatgaatttgcccaataacactttaaaaatgtggcattttaccctaggacacgtatgcattaaaatataatatacatctcattgatgagagagaaaacatgcaaaatgttagttttaccccctatcttctcccccattctcacagtcatcttccggcaataggacgacgagatccctgcgtagcacctgtgggcaataggacggaggacgagatgcccggtgggcgacgatgcacctgacacggctcaaggtgtggtaaatggtgagcaaggtggtgcggcaaagaggacgggtggaattatgacgtgcggagggtgaacaagcggacgctcagagagcacctgtcgtcaggtgatggcgagacgctcgcatcgtgtgaaggccaccggcgatggtcgagtgcatggtgtgcccatgcctggagaagatgggctacaacctcaacaaatcgtgccttgtcttctgctccaccagcgctgcccttcgccgtctctgctgcagatggcacggatgaccttgttccccgtagcggtatgtggcacagctcgaagctaccggccctgctgcctatggtggctagcagatcgggagcaacacggtaaaaaaaaaaaggtggcagccccctagggggcgacggcagcggaagcggtgagcggcagtcctaggtcgcccgctctgataccatgttggatagcatagagacgagaggaatactgcataacgtggatctattgtattgagtcaggggaccggtatatataagagtacttagggaggagataaggaaggattacacatatggaaggagtccacacaaatcaatcatatcctaatatgactctaactaccatatactctaacactcacctctagcaacggctgtccgggacccacgcccgctcctccctcctccaccgacgacacaatcccaatctccaaacctctccccctgcccccccaatctccatggtgaagaagagagggcaacagtgccattttgttaaattctctctctggctcgaatgaaaataatagtttaatggtgttagtgtccagcagcaaattattcttgagcaaattgacgttcctatggtgtctaccaacaaagatcactatagtgcgtgtttgctgctatgaatgtactaaaatcttctatctactaattattattttatcttggtttctattgacgatatgtcctattgtcctgtagaaattgacatgcttcactttgcaatttttaccatcatactttctattagtcctgccccatgttatgtgcttttggttttgttgtctatccgatcatggccgagactcgagaggtgaattgttcaagatcgattcattaggattaattaggagtgtttttaaactgttggtggtttgttgtattgcacataggttgctcatgaatctttgtgtaactagcgggcattttgttaattggagaattagtgataattttgttgatggcgggtgaatccgtcgccaacgaccatggggacgatggcggtgggccttgggcaaggcggcggcgacggcggcggtggcggcaacggtctcccagccttgggcgtctggatccgtcaccggcgaccgcggggacaacggcgatgggcctcgggcaggccggcagcggtggtggcggctggattagggttccaagacggcttttgattttcacgtgtgggtgcttcacttgcacgaaaaaatcggattttcacagatacttcgttccagacaggcgaaagatccgcacgcgaaaaccgcttttgaccgcatggaaaaatcattattgtactagtgtgcgtacgaagcaaactgggattgaaaatgtgatgccatgaatgcaatttaaattgaaacgatttaggatgatactttttttaataagtattcaaagacgaaaccaatttgattcagtatgagtggtacttggtctttcatttgtaataatcaactatatatactaattcccaaaaattttagtctaaactttgtggagttgacacctccaagaccattcttatgggtaaaaaagataagatgtgttacgaagataaaggttttcatgtggctcatattctgtaataggctaaatacgagaaatatgcttgatagaaaatattatccttaagaagatgcgaccttttatgagtgatttgctttagtacagaaaaagaaactcccatacaactttttcttttcttgtccttgcagcagaaattgttgggagagaattggtacaaaaatgaatgataacctagaactctttcacatgttggtcttggcaagaattagattcataagaaaggaaaaatgtttattgcaggcatatctgaaaataaagaaataggaagatctttgagaatattactcatggaatggaagtctttctttgtccaagatgaatgactctcttagctccctgaattcttcttggttacaatggttataattttatttcttttattcttttcttgtttgtacataactttttttaatatatataacaaataggcaaggtctggtagttattttttttaataaaaaggaaagtgaaaaggaaaggtaagagaatggacaatagtgtgacgtcagcatttgagagaaaatgccacatacaaatttttgatgcggaggaaagaaaagtaggatataggaggatgtcgtcatatataataactagagaataccccgcgtgttctccgggattccgagtcttaatgcaagttgctgtggaattccactataaatagtctccctttgtcccatatttcttgtcttccagatttagggcttcacactgacaccataatttacaatggtaaatcgataattttgtggttgcatttagtttagtaccaaatattgataatgtttatggaaattggtgacatcacatttattccatcatatcaaaacttaaacaattttatcaacttaccaaaaattttgatttgactaaattttaaaaaggtttattttggtagtaataatcttaaacatgtcctcgctaaagattgggggagacgtggagtacataggagtatgttccagtctttaggtgtgattgctttaagattggtgacgccacgtgtcaagattgtagaacgggcgtggggttcaagtgcctctccccaacaggagtacctcgtcggcgacctgcggcggcggcgatgtcggcggcggcggcggaggccaccgagcggggcgagccctcgggcggaggcggagagatcgcgtacgtcagctacggcggggagcaccacctcccgctggtgatgtcgctggtggacgaggagctcagcgagccctactccatcttcacctaccgctacttcgtctacctctggccccagctcaccttcctcgtacgccctctcctcccctcacctcgcgcgcgtgtttcacaagagttcgtgaggatttgatgcgttcttggttgatttgatttgggggacaacccctcaaaaggcgttcgatcccaaggatggcaagtgcgtggggacggtggtgtgcaagatgggggagcacaggggggccttcagggggtacatcgccatgctcgtcgtgctcaagccctaccgcggcaggggaatcggtgagccctccttcgattctccaagaagagtttctctgtttgtttgattggttgattgactggtttgtttcaaaagggagcatattcttccctttgatagtatctgcacaagtctgtcctgaaaggaagcgtagaccactcatgaatctaaataagaacttaagaatcctgctgattgggaggaaagcaaagggtttttcagtttttgttccaattcgatctgaaatggctggcacctggtggagtggtgggcgatttagtacggatttacaatcttccatcgatttcgatatgatatccatatgtactaaataggtgtttttcccttgttatgcttgcacaaacttaattgagtatcacttttacatgtgtcaagaaattactagctataggtcttataagtctaatttgtttcatgatcctttcacactaccatttacttgttttttctctgtaatagttgctttgtgttgatatggtattatttttgtcttaacatcagcaagtgaaatatgtctgtgtagcagagtggaacgaaaactagcttactaagtgttactggttttctaaaaacgatgccatgttaagtatttagtaggatttctttgttctttgcctgcttgatttgcagaaaggaaaggcatttttttatttcttttatgggtacaatagccttctattgttcccttctcttaaactatataatcttctctcatcagtttcaattgagatttgtgctattattttgataaaatgttagttaactttgtttaggtggttttctagttttgtgtaggagtaggtattgtgttatgaaccaatattcccatgtttagttttccctgtgacagatgtctcgtgttgggtgcttcagcgattcagtctgtggcacatgagagcattttggtcgattagttctttatggttggagccatttagcacttcatctgatgttgtagtatgcagcctaaccttatcgttacatcaacttcttgcatgagatgatttcttcttagtgtcatacacttggaagcgtgctgactataattgatgtagcaataaataggtgtggtgcgacttgctaatgcatatatcctgtgtggggagtacatttttcataatacttttatcatgaaatgcacactgatatttacatatatcttggtacaatggtacagatagtctgtttatctgaaaaacattgcctttgttgtttctgtaatgacattcgcagcaaggatcttgacagctttaattgttgaatcctgcctgacatgaatgacctttctcgatgtatgaatagagtatatggtagctttgtcatctgttaagagtattgcgaaagctccagcttcagttcgaatagctttcctgaagtatacaagtgctttgcttttgcaaatggtccccatttgtcttttttaattttatctgtaataagcaattaaatggacactatgttggcctttatcagctaaccctctgtttcttcatggtacagccaccgaattggttacgagatctattcgggtaatgatggaatctggctgtgaggaggtaatcaccactgtgttgttatcttctcacccgatgaaaaacttattattatcctattgtcgttttggtacccatcacttgactttcttggtgtaaaattgcttcattgattattcaattatgccctagactaatctgcaatttccataataacaataatatctttcgtgaaattagtacaaaaattgaattatttgatatctgactcactctccaaccaggtgacacttgaagcagaagttacgaacaagggcgccctcgccttatatggtcgtttgggtttcatccgagcaaagaggctgtacagatactatctgaatggcgtcgacgcatttcgcctgaagctgctatttcctcgccctgatcctggtatgcatccaatgatgatgctaggcaatgagagagatgaccagcacatggattctccttacttgtgataccattctggtcgattgataggatgagttaggatccaaggcattttgctcttttatgtcagtttgatgatgcttttgtagctttgctgtaactcttgtaacattgatgtgttcaaagatagtatcttatttgacatggcattatgtttctttcaatccatgttagacggttgaaaagaaatgcttatacatactccctccgtttctaaatattttacatcattgactttttagcatatgtttgaccattcgtcttatttaaaaacttttgtgaaatatgtaaaactatatgtatacataaaagtgtatttaacaatgaatcaaatgataggaaaagaattaataattacttaaattttttgaataagacgaacggtcaaacatatttaaaaaaatcaacggcgtcaaatatttagaaacggagggagtatatttcattacttggcactaggaagaagagtagttggggtatgaatttgtataccgtttcgaatatttcgatccatttcctaaatttatggattcattgatcttactggctaacccctgcatatgcggatatgccacacatcagcatctacccaactacaaactgcaagattcttcatattcattatgagcctaaaagtccttgcaaaacagttaagcctagaagttactatattataattcattttgatttttttcccacggcaaacttatttagttttgatcaaatttatagaaaaatatagcaatattttaaacataaaaacaaaaggccatcaaaatatattcagtgttatatttactaaaattaatttggtgctataaatatttctatagttttctataaacttgatcaaaggtactatcaagaagtttgacttaaataagtcaaagcaacttataatataaacaaggagtatttacatataatcttggctcacacatgcagctacataggatgccaccaatctagccaagctacatgtaggagacgaatcactctaataccttatgcacaaaaattacatgataaaattatatggggaggttatggccaccatcgatgatacgggatcgctagtgcatccggtggcatatgtgaagctcaggaggatgaagaagcagcagcacttggtctgagaataacattgttagcagaaacatcagttggccatggagtaatcactggtatgctggtggtgctgcgacagcatatactgacggagcagcagccacattgtttccatcacaggatgctgtgttccctgggtaggagtagatcgccgaggaagctccataacagtagtaggttccaggtgcatgagtgatgtaagtggctgcctgctcgaattggctcccctcagatgaatgtgccgcagctccaatcacactgcttggcatagacccataattcctaacgagttgtaagtttgtcatagctgccccagttgctgaagcacttggagtagccccagaattacaaactagttctgagtttgtcgcagctgcctcaggtgctgcggttgcaccacttggaatggacccataatggctaataggttgcaagtttgtcgtggccgcctcatgctctgtaccgtaggtaattctgaaattgaagacagtagcaaggaacaagtaagacttccaagtagctgcaagtaatgttctttcagattttagacaaaatcgcaaattatggttctctattgcgcctgcaggctgcaagtatcagttcattaagtttttcaaactatgtccagtaactgaacaacatagttttgagacatcaatgttgtcagcattggcctacacgctaaacataatttaattcggttcggagaaacagccaacacattataaaattgacaaacaggaagtactagaaccataaacgcgtacctctcagatgtagttcctaagtagtgtgatcttggaggatcaactgggtgcatgccaatttggtgggcggcataatatggggcagtatagtagccagtagccgaaacatgatcagaaagagattgttggccatagagattgttggccatagagatattgttggctgagggcaatgaactatatgctgtgtgcgctgcttgatatggatactcagctgttgacatatggtaaggaggtgtagtgaactgcatgtttggaggaggcatctgagcatatgaatgtgcataagattcaggtggcatcggatgagcagtcaaaggaggaatataagaagtttggtgctgctgatgcacataagcagctggctgtgatggatgagaagcaggaggtaggtaaacagcaggaggaacaggatgcctgtcactgtcattatggaagagtgcagattctggcattacaataattggacgaaacaatgctctcagtttctcaacctacagcagagtaacaagaatgatgaaaatagaataaagtagaagtatgctatagttcaaaagtcccataaaatttgatgcagaagggaaaaaatggaagataaaggtatattgttctttcctattccatctcaccgccagactattaacaaaaagatttaagaatagcacaaaagagagagaaaacaaaagaaaattataaagaggtacatgttcttatcatgccccacttgtgtttctcttctaatataccagcaattaattttctcagcacaaaaaacataaatccgttactacacaggcaaaatacaatcagaaaatttattcattctctaaagtaaaagaatatgagtttgactggaatataaaaaaaaaaagtgatgtgatctgtattatgtaagcaatacatggaaaataataagcttcaggcctcaaaatccaaacatgatgaaaattcacatgtgagtatgtcacacaagatttcagaaggaatatgttttaaggtctttataaaaattaagattgggtccaatttgtttcatcttcacactgatcataatatcaacaaatggtgattcaaccttacctgcacaagggtaagttctgggctgaacttcccattggaataattctcttttatagcagttcttaggctactctctgggataggcatgaaatcaccatcaactgtaaatttaacctgcacaaataaaatgaacataagtggtcactgatatttctatatcgagaataaaatacagctaactaatgaaattttattattaggattcgttaaaatattttaattcgatagtaaacatcacaaaacgtgaggtaggaggaacacaaatgtcaggaaaatactaatagcagacaaattagttcatgtcaggggggctcctaacatgtctgcctctctggctcctaaaagagataaagttgtggaaacatgtgccattcattgcatctgtaattagttctggtgaagagaatgttaggcctctctcagggcccatatgttcaccacataaggtaaatgctaaaaaggaaaaaaatatcttgatttaatccttaatgttagatcttgcagtcctaaattacaataggccagcatgattttgctgcactatatcagtttctgcagccaagcaagcgcatggtctaaggtaacctagcaggccaacattggactcagtcacaactcacaagcaccagtaaaggttcttcatgccatatagactgttagttaactcatcacggaagtaacaaagacattctgcaaaactactcatcacccaatttggcttcatgtgttcaaaatgtgcccctgtataacagatgtgacagagataacagtaataccagtaattgctcatgttggatattttatacaacaggtcatttgaattcacaattttctcctttatatcgatgaaatgcattattcaccacaaaaatacctgctagaattcttggaacttcaaaaccgagcatatatttgaattcaggataacatgtagtatgctactcctaggatatgctaattcatatttcctttgcttagttcgatttgacagaagaattccacaaatgctagagcaaccagaagaagaatggtgtgggaaaaacaacagtttagaacaaaacaatgagtttcggattatctaaatcacagatcaaatttgcaatttccatcaaccatcactgtgagtattgcaatgacataaagatcctaatcaaccatgtcaacatatatcattacttggtgaactatagtcacaacaaaaacccgcttcctctgcagaataaacacacatagcacaacgacagagaattacctgggcaggaaagcggccccggaaggcatccgggacgagtgtgaggccaccattggaatcggcatggtagggcccatagaggtgcttggcatcgaagtcatagagaaagagcgctgtgccacgcctgatccgggacaccacgtctagactccccagtggcaagcccatcacccggtgcctgtagcactcagctttcgtcacgccattgcacatgaagatgtacccagcaggcgatgacatggaggacccactggagcaaccattctcatcattctctgccgcagaatgtggtttgtcacacaccagagaaggtgcagtaggggacatggagcactgcaacgcatagatatgaattagcttcatgtggcaccagaagagcagttagaaaaggaatataagaagtttgatgatgcacataagcggctggctgcgttggatgagaagtggaaggaggtaggtactcagcaggacgagcaggttgcctatcatcaaaattatttgggagtccaggttctggttgcacaataattgggcgaaacaatgttctcagattttcaacctacaacaaagtaacaacaatgatgaaatagaacgaagtaaatatattatgtagttcatgagcccaataaaattttgcacaggaggaaatggaagataaaagtattgtcctttcctattccagctagctgccggactattaacagaagtcaagattcaagtataacataatagagagagctatatgttcttattataccccatttgtgtttttcttgtgttataccagtcatttcttttctcaggacaaaaaacataatttcaatactaaggccctctttgtttaggcttataagctagcttatgagttgaaaagtctaagcctaagaaaacaagcagcgttttgcagctttttcatttggcttttttaaagccataagccactcttacactgttaagccaaaagctaggttggagaagcttttttggcttatgtgaggtagaggtatgactccaacattaaacttgggactcttaatctattggcttataaatcatataagccaaaaggctaatttaaaagcctaagcctaaacaaagaggccctaaacagccaaaatacaagcagaaaagacatattcaatctatgtaacaaaagaatatctgagttcaagataaataaaaaacgcagaagtgtcatataaagaagacactgaaaagaataagcttcatgccttaaagcccaaacatgatgaattgtcagtacattgcaaccctcccaacctcgatttgactccttattcacaagtggcacaggaggaattttagaaggaaatgacaatatgttttatgatacttatagaagttaatattagatagaatatgtttcatctttactctgatcacagtatcaacaaatgctgattaaaatttacctgtgcaagggtaagttctgagctgaacttcccattggaatagttctcttttatagcacttcttaggctactttctgggataggcatgaaatcaccatcaattgtaaatttgacctgcacatatacaagaacataagttgacactgaaccttcaactatattgagaataaaatacagccaatctacgaagttggttattggacttcattatgatttttaactcaaaagtcaaaagtaaaccgcatataactgccagggaaaataaaaggatggtagacaggttaattcatatcagtagagcacttctaatatgtctctctgattcctaaaggagctaaagttgtaagcaaacctgtaccattggttgctctctttttttcttttgaagagaaccatttgttgcttgtggaattagctctggcagagagaatgtcaataaacataacccagccgatatattctcaccacacaaggtaaatttcaactatataaagaatctaaatcaaggtgagtttgccatcccaccaacacctcttatggcttgtaataagattattttgctgctatgcatgcaatcattgcaattgtacaacttatgatatttgattacagatacgttgcgacagatgggtatttggttagtaggaaaaacaatttttcatcattaaccttagattctgctgtcctagaccataatagctttttacaattttgctgcattacaccagcaaggtgctgcagccaagtgatcgcatggtctacgacaatccagtggaccaatgttatactaaaccacgtgatacagcaaggttcttcaagccacaggctgttggttaactcatcagtcatcacggaagtaacaaaacattatgcataattactagtgcaatgaacatgactgattgtcaacccttctgactaaatgtgttcgaaatgtgctcctgtataccagatgcgacagcactaacgtatgttacatttcgtcctgccggttataaaatatgaataatggctcacttgtggatgttatttacgacaaaaatttcaaatgcaatgcataacgtagcacaaaaatacattctcgaactcaaggaactccaaaaccgataagatgtatgaactcaatgaaagatgctaatccttggaaacgtgtgtacgtatttcctttgctatgtttggcatgttgtactcctacaaaaataatgaatttacattcccttaaatagtacattataatcaccgcatagaatgtgtagtaacatgatggctcaaattaccaaattttccatcagtcaccattccgcgagaaatacggttctataaaaatgattaccactccaattccacagcattctcaattcatcaccgttctccaataataacaaaaacgatatcctaaccacgtgacgtcagcatgtgtcccacacaaccgcattcctcctgctgcttgcagatgaaacgcacgggggagcgcgacggcgcggggggagggcgagttgggttacctgggcggcaaagcggccaccgaaggcggcgggggcgaggtcaaggccgccgtcagaggcggcgcggtagggcccgtggaggtgcctggagtcgaagtcgtagaggaagagcgcggcgccccgcctgatccgggagacggcgggcagcctcccccgcggctggcccatcaccccgcgcgcgtagcactccggcttcgtcgccccgctgcacatgaagatgtaccccgccggcgacggcgacggcgacggcggcccgccggggaggccgccctcctcctcctccgacggcgaggcgtcccgcggcctcttgcgcggcggcggagacgtggccgccgtaggggaagacgaagggtggtccgccatggatggaagcgaaggggagagagaggggtttttagggtttttcgttggatggctgcggtgggagtggatgagtgaccgaagcgtgacggctgccgcgggtgtactcaggtgatgtctgcttttttttttcttttttcttttcgggtttattaaaaaaaatactccttccattttagattatactccctccgtcccataatataagggattttaattttttgcttgtattgtttgaacactcgtattattcaaaaaaaatttggaattattttttttacttactttattatccaatgtattttaagcacaacttttcgttttttatatttgcacaaacttttttgaataagacgagtggtcaaacagtgcaagcaaaaactcaaaatcccttatattatagggacggagggagtaatttataagtcgtcttgattttgacccaaattaaattgctccaagttttaccaaatttatagataaatatacaacaccaaattaattttattaaatatataattgaatatattttcgtaatatatttatattgggttgaaaatattattactattttctacaatcttggttaaacttggagcagtttaactttaactaaaattaaaaagacttgtaatctgaaatgaagggagtaagtaaaatttatattatataccgacttaaaaggcaatatttgaaaaagatatttagattggaaatatcttaaatttaactctaaatttaaattttgagaacaactagttattttttggcaaacgaggaggcgttcgttacattgatagcagtcactatgcaatttactatgaatagtactcatctattttatattataagatgttttgacttttcttttaagtttgatcaaatttatcaaaagatttagcaacatctacaacaccaaattaatttcattatatatatcatttgataggaaagaaaatcaaaattacccctgctactgtagaagtacgaattaacctcctcaattcaaaaaccagacatttttcatcatcaactttttatattgaacgaattaccctcctaaccaactttagagtggttttgatcctacgtagcgcacacgtggtagtcagtcagcaataaaaaatactccctcattgtgaatgtggaaaatgctagaatgacttacattgtgaaacggagaaagtatataaaaaggttaaaaaggtagggcccacatgtgttgacggcagaaccaagtacaagtatttgttcatcataatatattttacagtatttatttttgagtctgacaagtgtataaaagttttactagcaaatgattttttatttgctaaaaagcaatttggataagatcatgaataagatcgatggcactgggctggttgtttctcagctggaagagaagagaagaggggtacacttgttaaaggtagtgtttttagaatggaattttactaattttgggtggcaatattacaaagtggcattttttctggagtgggattatcaaattttgcccacgttttaaaatggcaaagaaactggtgtcctgcttggaacttggattgtgcctacctaaataatctgacaggtgggtccagtttgtcatccacagtcacagacgcagctcaatacatgccggtttcctcactgtccagaataagaaaggggttcagaaccaaatgacatggagaccaaaagtttcagtcacttatcttcactgaaaccgagctcaacttaaggtgaagccaaattcatttacaagctacaaacagggctcagtggttggatgctaccagtgcatctctgcattcggtcaccaatcaccatggccacattatttcttattgctcatcaccatgagaagaactcaagctaaaaataaaacattggtgccaaggccatgtcacccctcacatcaactgtttgccggactgcggggcgaaattgatgaggaatgtgcgtatctccatggggcccagatcaacgacgagcttggaaggatctacggggcctccccggacgatcttttcatcagcaggagggccttccaccttccacttcagcctctttttctccatggctgaacgttcttggttcgctgataggcttgtctcaacaatcttgacaatctggagaggtgaggatggaatgatcgaataagttgataatggtcatgtatatcaaacatagatgtatatcagaaaatgtgatgatgatcaccttcttgtctggaaatactctcttcaggtcgacgctagctagagctgaaagatccttgtgctctccagcctataattacacagggcaagactcagaaaataaataaaaaggaagatcaaggtataccaaggaaaagtaaggatgatagcacaagacctcgtataggtgagccaaccgaagaagaacagttccgtcttcaagttcctgtccaacgcaggggcatttgacacatataacttttaaagcgacatcgtgcaacacttgcccgatacagatttagaaagcattttcatcaattttgtacatgagcacatttttagctaactggctcattactgtttgtaatcaatgatatcaagcaggattggggcaggacaaagaactagcttgcaccattgcaaatggttaaaaataatataaatattatactgcataaaggtgaaccaaatcagcgatagttgggtagtcgataaccaaagatgggaataattctggttcccacctctagaatcaagtaatccatcagggctttcaatgtagttgttagtgcaaagacaagcatttcatttttacttttaagagaaacaacagtggtccatagcacgcagatacctgaagagtaagcaatgcaacattatcaggcaagctgtaggccggatccattgcagagaattttgtaacgtgtgaattcacccaattacctccatcctgagtaaacagcaaggacatgctcagaactagcataaccttttggtcaactattttataaataagttccagtttatacctgctctgcaaaagcaataagaagaggggagtatatttcctggccaaatgtccgccgccacctagctccttcaccttgtggatcaattttgagataatactttccttgaatctgtgaaataccataataagatgttttccacagtatttttgcacacaatcaatgtatttgaaaacattatagaacaaaaacatctctagtgacagttggcacaacatatatatcttctctttatactccaagaggactttgttatagataagaaaatatttcaagagggcagaaacgatatattactttatagcactaacttattttatttaagtatgctctaaattttcttcaaaaacaagggatcccatattcttttgctgataggatctcagtagctgacatcttattttgacttatatccagaacagggattcaagaataagctctgtttacttacaactagtccttcacattgattatcaaaacaggttgtttcatttaatgcctctgcaacaccacgaccatcatcatgaagtagtctcctacaaagagtgacaaggatttaaaccattcagaggtacacaaaaagggaatagttaaaaaaagggcatgtcacataaaaacatttttgaaccggtgcaagttccactacagcaaaaattatagctactaaaaaaatcctcaaacacaattattagctatatagaaggacatgacatacattcatggaaaagttcaagacaatgactcatatcttctgcgagataccaaatgataaatatgcaccatcttagacatgtattttattttactggaatttgtaccacattatcaactgatatgcccccaaagaaaaatatgaaagaagcaacaaagtattgtactatgttgtttgagttgaagatatacctgtgtagcattagct

SEQ ID NO: 25018 - DNA, 19965 bp, Oryza sativa
  unsure (1)..(19965): unsure at all n locations
acaattatgcgatgcattttctgttgcagtcctcttctgtgcattgtttagtccttgtccccttccaaaactagagataggagggcattcacataattaattcagggattttttttccagtactatgtttattttcattgtagatgtatagtgcggagtgtagatgtgctttaccagaaagaagagtgagaacacatcatacccttttgatgaagtcacgtccactggaatcagtgtaaaatgttttgtttgttgccatgtttgtaacgacttcagtggatagttcttttccatttccatcatccactggtattggtccaacctatccgtaagaacaattatttaagcacatgtccgaaatctcatccaaagagaaataaacaggatataaagaaatcatcatgcaaattgcaaaatgtgaagactttaaagaaaccatctttagcaatgaaggtacatcatattggcatagcacttactataaattcagtctccacatagtcctttcctttgtaaactctgttgatctgtgcaaagaattgaaaaacaaggcatcaggaaatgagcaacagcagcagcataatttcccattcattcacaaagattgagagagcagaataaactttaggtgtggaacagaaaggagttaagaaaaggtaatgattgatgatttagacaagcaattatcatagaaataacctgatatatccatggattaatctgctgatgcacttcgtccaatatggacccacggagaactgtcagaggaaccttgaagtgggcaacataacttcaagtaagacttacgtgcaattttaaaatctctcaacagatgctgcagtgtaaatgttattctcggaaaaaaaacaatggaaattcttaaggcaaattactgaattagatatcttcttcatacctgtccatcagtcttgataggaactgtgccattagggcgaaatatgtatgctccagaagcctagggtacaggaaagagcaaataaatgccaataatagtaaatgttgctgaataaattaattatataatttgtactgcacctgaggatcacttccatttccatcctgtcctatgtaatacttgtacttctgctcaaaatttgcttcaaccttggaatgtgttaatggtgttagagtacaagtgagtttagatcatatgcaataattaaagcaagaagcaatgaacacatggttttctagggcaaataacatactggttcttactccctccgttttataattagtatttttattgttatgagatgataaaatatgaatagtactttatgtgtgacttatgtattttaaatttttcaaaacaatttcaaataagacgaacggtcaaagttgtgcacggaaaatcatggctgcacttaaaatgggatggagggagtacttcttagctagctactagcaacaacaaatcttacgagtacactactttatacctttacaatgaagcaaaggcaagtcctgtaagagaagaaaaggttccagattggaggtagtgattaacctttggcacattacctgggtcttactattggagtacagagataatgctccagctgcattgtattgaagtttcaactgtccttgcccaatttgcatgttactattttcacttccttgagatgagtgcagagtggacatcaaagagactgatgctgcaatatatgcagtgaattaagaaaaatcgtcaaacttcatggcaactcttaactaagttttggtgaagaaagaaattaattcacctgatttcttcccgcttgatataaagtacgtattgaaaccaagaggtggtacagaaactggaaaagcaagccaaaacttgggttttgcagctggtaacatgcctaggtaagccttgacatgtttctcccgcatgtacaaagatgcattagctataggcagaagttgtgattcaacttctcttccctcagaatcatgaacaacaattgagtcactgatgacctgttgataaattggcatattaattaaccatctaaagcaaaagcagtttcatggtagtagcacaatgcatcagtgcatcacacatcttatgcacaagcagaaaattccgattgatatatgccgagcaaattaaaacaacaaaatatgttgcttttcagggaataacatttgcataccggtatgcgaaggacatcctcccgtttccacccaagagagttgtacacaagcacaacctgtaacataaaaggtgggaaaaaaataaagctatatgtttttttcttaaaaatatcaatcaactacaaacaggtagttcatcttgaaaaagagttgtgtgttgtgttaagaacagaactcaccaaacttttcccttgagaaaggtccatctcggaagggggggcatatgtatatttaggagcggacactgaaaggagatatantgataaaggaaatactgcatcatgtataaatacaatgcatgttgagaaagcagaccccacgcattacaggggaagggagttggctctaaccagtgccagggtagacactcacacacacaaagatataaaccaacctgttcaaaattcgttgtttgggacggcaatgtgattttgagcctgactggctcaagcaagagagagaggatgaaaccagcttctcggcctataaaaaaatcgaactcattgaagcgatcaaaccccaaaagagaacatcatctatgaattaacagtactcttgggaactcacttgtgtatagccaattgataatctctttgcatagtcatttgcgacatgttgcttctccgttcctgtaacagcatcatggtgctgagcaagagctagagcatcagctaaactatctgttgtgagatcagagttgcttcttcctttaaagaattccaactgcctagctgctttgaaagtgaaaacaaataaaatattaagcatatgaacaccacaaagtaccaagtaaccatgaaaatatataatactgaaactgcacatctgaatgctagagtaatgaaagatgaaaatttaccaagtaatatccactcataacacgaacgtatcgttttaaggcaggtctgcttgtgaagtaacctgtccaatatgcatttgggttgtctgcatacctgatggaagaaatacagtcatttgcatgtgaaagcaacaaaaatgaagttaattatatcaattatgaaatataaggttagaacatacgggaaaaaatcattagtcttgagaggccatggcacattttcagcatgttttgcatcagtataaatcgaaggtgtggaatacagagcattgacacggccatcctgaggtaatggaacaacatgttgaaatcatcatcattacaacttcatggtgaaactaaattagttaaacaatagtcagcatttgtaatatccatgctgatcttaaccttattaacgtagtgaattaatttgtccatctgtctgaaccaactttctgcatattgatatttgaagtctgtgcccattgtaaacataacgtgatttgtccttgtaatatttgcctagagaaaagaaagaaaggagcatgaattaggatgaacaactcattgctgagtagaacaataacttcaagttaaaacgttgtcatttagctaatatctttgaatattaagagcagaatgatcgacatatcatggaatacggaacaccaaaactgcattctcaatttgtgacaaacacttaacactacaacatccagaaaggcagtctaaattgaataagatgtttgcactttgcagtagcatcaatcaacatgactaatggatttccatgcaatgcatatggctccatagagggtctacatcagcatgaaaaaagtgtgaacatacagtttaatgtacctgtgctatagctgcagcaacaaagtcatccacccgttgctccacattataatcaaaaagaaggggatcatcctgcatagaggcaaggaatgtataagttcatgtctggtgttgaatgatatgcattagtagagtactcattagtttacctggacgattggggaagtatcatcaacttcgaagtaaaactgaccaggaggtggttcataattttttgggaagatgccagcaaagatctgtaagaaaatgtgtgtttcatatgaaatatggaatccccagagtttaagaacatcaaattgaggcataacattaaccgtgaaaaaaagaggtcacttacgtcagctgatgagccgaaggtcttggagcccctccacacaacctcgagctcttttgttcccttccgtgtgtcacggtcttggtaatcaatccggaaaaaataaaaagcatcgaatcctacctgaaacataataaaatgctagctgagcaattacttttctggtaaatctaatttcacttaaacaattggattgtgtagattcagtagctacattgtgttgtcaacaaaagctctctgtggcatcactctttaggggatagcaaggtatacataatgacatttttgtatctcagcacataactacctatgatgggtgataactagttactatcgccgggctgataactagttactatgataacagcattttacatttaagtcgaattaaacactggaaggacggcatcaatgagttcagtggattacttctgtgcctaggaggtaagcctgaactgcggagtgcccaaacggatcaatctgccaaccaatccttggaatctgaccaaactcctccttgatgaacctgtgcccgagcgtagtctggtctatcatgtcaatgtagtgcacggtcgcttcatcatgcatgcacattcccccgtttctgcaacagcaaaagaagcatgtcattctctatacaacacagacatgactaccaatgcagcatacatagcgatattcgatttaaaccctacattaattccaatcgtccagtgctgatgagccccttcactatatccttaatcatgtcgctctgctgtctccaccatctctggaagaatgcctaaaaaccaaagaaaccattggtcaatttcagtcaatgtgtctacaagtggttgcacattgcttcctatccaaccaaaaaaggactcccgacattgcagaattgaccattttggatgtagatagaatagcttctataacttcaactcctacaattgtcagccagaaattgcttgtagaaacaccaatatggttacagatagtactacattgcttcctacccgccgcagttccaattccactcctccaagcggctcaaaattcaattgctgacaaggacaaacttccaaaggcgggatttaccccccaaaaaaatactccctccgtttcaaaatgtttgacaccgttgactttttaagacgtgtttgaccgttcgtcttattcaaaaacttttgtgaaatatgtaaaattatatgcctacataaaaatatatttaacaatgaatcaaatgataggaaaagaattaataattacttaaattttttgaataagacgaacggttaaacttatgctaaaaagtcaactgcgtcaaacatttcgaaacggagggagtatatgttacctgctcaacatagacgaacttgcggttctcatccttgagcagcgctggcacgagcgaatccagcacattctgcacgcacgccccctgcaaccaaaaacacccagaaaaaaaaatccaattcaaaacaagcaacgtgacgagaaacgagataatccgtttccaaaattcagcgcatcaatcatgcctaaactagctcccccaaacccgtagaaatttctccccccacaaaaaacggggaaaaaatcgcggaaattccgaggactgcgccgcgcagctcgcgctctcgatcgaaagcgcaagtagtagtagcaacctggatggagttgttggatccgacgtagtactggtcgacggtcttgagccacccgacgtcgtcgtgggtgtgcggcaccacgtgcacgttgagcttcccccccaccacccccgccgacgtgttgtaggggatgtacacgcactccccgacggcagcggcggcggcgaggaggagcaggagcagcgccgcgaggcgggcggcggaggcgcccatgggcctcttcccgaagcttctagaaggggcgtggaaggtggagaagggaggtggtggatggaggtcgttgcggccggccgcggtgaggccggggggtggagtgagctaagaagaagaagcggagcggggtggtggggcccacctgtcggtgacacaagggctcgcggccgcggcgtgccgggcgggtagttgcgcgctgtgccacgtcagctacctagcttttatcgcggttattgagtgaattttcagtatggccattcgagtttcctcgatttgtggattggggtcttgttgcgtatgagactttttttagggtccgttcgatctagatgttccgatgagctaaacagtaaaccctacgtccctaccacgtactaattcatttgatcggtacatgattaattgactatttactaatatgggtttagaaattgatttatttatttttaaaaaagaaacttcaatataaatttttttaaaaaaaatacattgtatagcaattcgagaagtaatggagttgctcccccaaaatagctaaaaagccaaaattattttttttcacgtatagtgcaatttggatgaacacaatccacgcgcatcactaaatgcatatatatgcatgtttgctctttaagcatacttgaaatattatcaaaggcgtcaaacatccctcccctcttcacgcgaactcatgcgccattcttcgaattaaattagtcgaatcaaaaacaagccctacaacgtatgtccagcaatgcttttttatgtagcataaacatgctaacttgatatgtacatcatgagctaattttgccgaccatgcatgtgctacggctctagttttagtttgagagagtcgacgatatatcttatataattcagggcctgttcactttgatgtcatttttaacattgctaaattttgataaagttgctaaaaaaatggctatatttagtttgccgctaaattttggtaactatatcaaaaactatgccaaaattttagcaagttaccaaaattttgatattaccaaaatttggtaaggttttttttttacattaaagtgaacagaccctcaaattatggcgcttacacggttctaaatatgctcctaatgtcgttgagctgtagccttataatctaggctatcggtaagcttcagatctctccttttgacaggtgggaccccgatctctcctttgttatcatatttgtttatgttgttatcggtaacttgttgtaatggttatactatggtataatacaaagtagccatgataataaacaacacctcaatttgcataaaagacaacactctatgatcttaataggttgaagagaaatcaattggaagaagaagataaacctctctcatgtcactactactgaattggttttcctagacgttgcccccttttggttccatgcccccgaattgactggcgctaggttgtgaaccacatgggaaaaatgtgcggtcctcttaaatgaaccgcacgggaaaataagtcgatttttttcgtacgaacgtactaagagagccgcacgtcaaaatagtatttccctcctacccactttaaaatttcctctttttccgcgcacctcggtcctcactctatcttcttatccagtcaattctcttattcaactcccaaaatttctcctctcctttctcacgattctcctctctcctctcctcacttatgcctctcggcggcagcagtgccccacggcgacggcggcgcaacggtggaggcgcgggatccggcgggcggcggcagtccccgcatggatccggcgggcggcggccgtccccgcatggatccggcggccggccgccctcccccgccacggatccggcgcgagaaccgcctgccctcccctcccctccccggcagcaacgggagcgcgcgggcggcggatctagcgggcaggcgggcgacgacgggcggcagcggctcctcccatccctctcccctcccctcccctccctggcggcaacgggagcacgcaggcggcggaaccaacgggcgagtgagcgacgacgggcggcccgcggccgtccctgcacggatccggcgcccggtcgccctccccccgccacggatccggcacgggaggctggcgggaggcgccaatgacgaggcgggagcggcgacgctgccgccgccgccgacgaggcgggagcgacggcgacgacccgatctagggttttcttttttttttgaatttttttcggttttctgtttttccgtgcggtggcataagcaaccgcagatttcgcgattttcccaggcgatttgttccagacaggccaaatctctgcacgcaaaaaaccgatttaccgcataggaaaacgcttagtgtagtaatgtgtaagcataacagacaagcccgtgatataattgaacttatatggcaatgttgttttcaatatcagtccatcagacaagtcaccaaaagtccttattttatttaattttcgtcatcaagcacaagcataaaaaaaatatagtatatactccaggtatcgcggatgaaacaattcatttttgccattgaaaggtcaggctatctatcacctgttactattatgggactgttcactttgataccattttcaaccttacaaaattttggtaaagttataaacaagtagctacatttagtttcctgctaaattttagtaactatataaaaaatcctgccaaaattttggtaatgtttttttcattaaagtgaacagccctacatatacacataatttcatcttaacagccgcattagtgctagtatcatttcctatcaggagcgtagcatgatttagtacgattggaaggtctcattcgcaaaaaggcgagatgcgaataaaaataaatagcccgtgccacggtggggcgcctcttccggataaggaggccagaacggggccccacctgtcggtccctatccagatcgatccgctgcaccctaccaaatatgaaacgccgaacaaccagcggacggcgactacactacgaaaattgttatgcatacggcctgcctcttcgacttatatacgactaaatttgatcaacatcaataattataaacgattataatgtatataaacatattgtctcgttcttttatccaacaagagttggatgaaaattaatattttcgtggcacacttttcaaactactaaacggtgcgttttgtgtgaaaactttctatataaaatttgctttaaaatcatattattctatttttcaagtttataaataattaaaactaatcaatcatatgttaataccacctagttttgcgtaaaaaaacttaatcttcatctttatctttatctttaggagaaaaagaacaccaccatagttgactaaatttgatcagcattaatagtgagtatgaatcgacatatatatatatatatatatatatatatatatatatatgaatagattcatatttagaattaagtgttttttttctaagacgtagcaagtatgaatatgaatatgaatctagatatatacaaatgtgaatatggatatatacaaatgttttagaatatacttgctacgtcttagaaaaaatatgaatctggattcatatttagacggcgtactcgcgttggcaaagctgatgatgagttgctgttccttctcggcgcgaataatcctctccctgtcttatccgatccatcttctttgtcgctgtcgcacctcgtggacttccttctcttgttttttcggggaccctctcggactaatcatacagttatgtattattcggtgctcttgaatcttgattagtgatggctaccattattcttttttctcctgcagtaagtttcattcgggaagtgatttgtattttttttttcattttgggattcgacagaaaatcctcaacagatacagtatctgtacaattatagtgtatagtgtagtttctatataactacatgtaagtagtatatatgtgacttgagtgtagtgtaaatagaaaaacacgtactactccgtccaaatatttggacatgtacagattcattgctagtattggtctctttttttttttttttgacagcggtctagtattggtctctttttttttttttttgacagcggtatagttcagtggagactggatatgtgcacttgaaacttagaggctgcgggttaattcgatccctgccctaacgtgtgtaatatattttaccctactcacgtagcacaaatctcaaagcgcatataattcgaaagttgcatagcaatcatattttatttttagagcttttcaaaagggtcatgctgcaaacgagttctccacttaagttaattgtagagcacagaaaacgataatgttatactcccttcctctcaaaatacaactacttattatgctattttttttctaaaaaaaagacatcaaggttaaagtgagaaatggttgtgatttgttgagttaaattaattaattaattaggaaaatgttgtagtagttatattttgagaaaaaaattctagaaatagctatattttgagagagtattatacctcgacgtaactcttcattttcaaagtttggtcaattattgcaccatatttagggcttattaatttgcagtgccatgttttggttggtagcaaagaggtgggtacgatgaacgtttggattgttactaattttggcgtggagttcttttttgtttgcttggcatttctaaattttgacaaaatagagaaccaattcaacagtaagttcgttgcaacaaggcaacttttttttttttcacggagtactctttctattgcatctttttatttgtttgttgcttacctgcttgtttcaatgctttatttcgataaagaaaaatacgatcggagaatgcaataattgctgtggtcacattaatgaaagtcgcagcataactagagaatcaggaaagtacgctttctattgcatactactccctccctgttgttacatattaattgacgttttagacaagattaaggtcaaatttttataactttgaccatcaataactttaaaaatatttagtttaaagcattgaacaacatatatagatttgtctttcaaagcattataataaaagcaatatatattatatatatatattataatagaaaaataaggtcaaaagatatattttatagaccgtgttattgtctaaaacgtcaattaaaatgaaaccggagggagtactattttatttgtttgttgcttggcttgtttcaatgctttatttcaataaagaaaaaaacgattgtagaatgcaattattgttgtggtcacattaatgaaaggcacagcataaataaaaagaatcagggaaaaaaatcaggggcattccgagaattgaattcgggacctctcgcaccctaagcgagaatcataccactagaccaaatgcccttttacgattacttttcaaaattacggtacttgaccaaggttatttggctcgacagacgataattacccatgacatgcattcgccgtcgagcacgccggcgaccaatccgccggcagaagacggcgccttctccggtgatctccagcagaccaacatttttctcaagatgacagcaattattgacccgagcagatgatcttttacaagtggagagcactggttgcagagacaactcacattgccatagttttattctcatttccattccattacatataagtattatttgttcagacttcagacattatgtccaaagccatatgaaataacggacgatgcaaagattcaggtacaatccaggatgcttcaagtctaataacacaaacacaaatcgttgccaagcaacccagaggtacagaagttgcagagatcaagcttgatttttcatggcaggaagcaaatcacaggatcctaaaacgactgaaacaccctaatacaaagctggcagaaacttacacggatcaaatactgacagaaagggaaaagaagagaaaaaaggcgaaaagcgcgacaagcatcgactcctaaggttgaaggtggcatcctagttgtcgacgacgagcttccgccgcttgaagttgaccatcacctcgtccttgatgccgacgaccatggctttccagttggtctccgggaagggggagaccagctcgaactcaaagttcctcagcaggtgagtccatatggccttgatctgtaggtaggcgaagggctcaccgaggcaaccgtgcctgccgccaccaaaggagatgtacgagaaggcgcccgctgccttgtcctcctccctgcctggtgcgtagcggtcggggtcgtatgagtcggggttcttgaagatgtgagggagcctgttggcgaaggctggagatgtcgcgacgatgtggcccttcgggatgtcgaactctttgccatccttcgttgtcactgagaagtcgttgtgtgactggcggagcagcatgattagcggtgggtgaagacggagcgcctccttgatgcacctgtagaggacatccatctctgccaagatgtcatgatcgatcttgtccccgtgccgcttcatgacctccttctgctcctcttcggctgctgcgaagtactgcttgaagcgaagcatgtaggccccagtccaggttgaggtgatagagctagtgtgctgtccagcaaatagtgctgcaataagtaggccggttatttcaccttctgtggttgagcgtccactcttgtacttcgaatcaatgaagcactgcagcatgtcttcctcagcccgtccagaggccttgcgggacttgatgatggtggcgaagatttccttcaaccgttgccgtgcccggtcacggcggcggtgtgcaggaattgggaggtaggggaagatgacactgactggctgcatcccattgtccagatcatggaagagagaagaaacatcatcaaagagcttttctcgcacctccctcccgagcaagcaccgactagcagtcagaatgatgagatgctccagctcatacttcagatccaccgttccactttctccccacttagagaagtactcctgtaggcaaggttgcatttgcagttgagattaatcatccaagatgtatgcaatgatgtaatgattgatgaaaacaagacagaacacagtaagacagtaaaaaagccttagtaacaggatttatcttgacatgctatctaaacgctaacatgttactacaatcatgacactgagtgttcaacatcaagccaaatgtccagtgacttgcataaagatggtctgtataatctattcataaaaactatcgatataatattattatatgaaaagaaagcatgcaaaaagtttatataaaattatgcctagctttttctttatgaacaaaccatgttattgtgaacaaggatgaataagatggagtgccataaaattggaattgcaaaggaaatgagatgatgcacaatacacatgtgctgtggtatgcacctatttgtaaagcgaatataacagaggaacacgtcaattcagtttcttgttgaaacaacagttgctgccaattatgtcctgttttgctgcaccaaaaagtttggagtcttatggtgcatttcttgagtacatcttaagaaaaggtacagttgacccacaggtcttggttaagtcagatagatacaagaatgttggttgtgacagcctgacaggatgcaaacattttatcattgacctccagaacttaacgtcacataacaaggtttagtttgtttcctcagtcaactaaaaaacaggtctttgtaactcaagctatatatcagcgctgtgtttagttccaaagtttttcttcaaacttctaatttttccatcacatcaaaactttcgtacacacacaaacttccaacttttccgtcacatcgttccaatttcaaccaaacttccaattttgatgtgaactaaacacagcccaagcatgtccaacgtttatacactattgatcaaactcatacaagaaacaaattaacaagaaaaagctaagcataatttgatatcataagatctcaaatacaaccagcagcagttcaaatctctacaagacttcagaaacaaaacatgtcacagttgtcagtgtaaaatatggcctgttctgattaaaagattatggtgctggtgtggacattcattcataattaaaagatgtcattcaaaagtggagaaaaagaagcacatagaaacagtatagaaaaggaaagataacacgtagaaacaccatcaagccaaaattcagagtagaaccggaaaagactaacttttaaacgatgaaaattagtaataaacaggaaagatgtgcaagctttattctaaagaactaattcactaaaaaaagggtggcaaaaggcataaagcaaagcacaaacggataacagcatactcctagcacgaactccatgccactggaaaacactgttgacagtgatgcacatatactgatatatttgggtttgagaaaaaaagacaaaaggtgatgtatggtagccacgttctaacttccagaaaagccacgcacaacatattagacgtgttgatacacaccatgacaccaacatgttgagtaatcaaacaggattaacaacagctctgaattgacgtatacatataagaaaaagcaatcatgctgaatattagatcaccaagctttcctatcaaaattgacatagcacatctatatcgagattgtatccttttgtctaagggctaactacaagttcaatgcataatgatccgcatgactgatcttcgaaacaaattctaccacacattagcctattacaatcaagtttgatgatatatccaagaacaagcatctcatgctaagttactatgcgacaaccatcctaacaatatatgaacaattgcgtgaaacggaagcgattctcacctcagcctcgacaaccatctggtcgacatagctgcggagcttgttggcgcggagcgcctcggtgaagaacctgaactgctcctgcctgacggagtagtcgacgtcgaagacgacgccggggccgaaggtgggcacgttgaacttgtagacctcctgctggctcatctcggcctcgttccccttgaagaagtgcgccgacacctcggggccgatgaggaaggtgatcttgcggctgaggatggggacggtgaagacgctgccgaggcgggcgtactcctcccggatcatcgggatcggcccccgcatgaagcggagcagcccgcccaccagcggcgccgccgggatggtcggcgggaggcgcttcttgccgccgccggcggagctcagcagcagcttgatgaaggcgagggtggccaccagcagcgccgcgccggcgatgagccggtggtttgggtcggcgagatccatcatcttcgtcgtcgtctgctcgaccaattgccatcgattagatcagggataatacagattaatcaagatgacacatacgaaaaagaaaaaaaaacaagattccaaagcctcgttcgcatcgaagacactctaggaaagaaaaagaacacaaatgcagcatcaaaaacagtggaaaaaaatacaattgttcttccacactcatctttccacatgacaaacaaaagtcactttttgaaagaaaaaaaagaaaagaaaatctctagatcggagagaacagcgccggaaattctctggtttttggccatgtgccgcgcccgggacatatgatagagaacaaaaaaaagaaaagaaaaaggaaatcaagaaacgcagtaggatgatgagatccgatcttggatggagcataccttctccctgctgctgcgggtgtgggggggggggtggaggggagtgtggagtggaagtatagactggagaggggtttatataaaggaaagcagcaaagattcctccgaggagaggtggtggtgggaatgaggaggggtttactgcgggcggagatgggaaaccggggcggcagagatttgcagaggagaagagaagggaggatgcgcggccggggaagaaggaggggattttgggggggccccacctggctgtgacgctagctggcgaccacgtgtgtttgcacgagcacacgacgtccacatgtgcaatggtgggtgtgggtgtgtcatgggcgggggatcgtgagtggagccgggagccgtagagaagggtcgctctctcgccggccgccgatggcgaggggggttttgccggcgggccacgccagctgcgggtgagcgaggcaggcacgggacttgaggatcattaataacactcagacaaaataacactgacaccgtgtttagttgcaaatttttttttcaaactttcaacttttccatcacatcaaaactttcctataaacatgaacttccaacttttctatcacatcaaaacttttctacaaacataaactttcaacttttccatcacatcgttccaagttcaaccaaacttccaattttagcgtgtactaaacacaccctcatgcaggtgcgcgagttagacaattagactcaccctctaaataatctagtcaatttaatagctaatatatataataatttttaataaatataatagttacctctcaaccacgtatactataatattaatatctgatctcacctatcatacacattgtatcttatagtctatggtcccattgatcttctctcttatttttttatcttcttgatacatgtttatagcttggcttatagtgtgctattgtacatgctctaaacagtactccctccgtcacaaaataatacttcatctattacaaaataaattaatcttagtacgagacatagcctaatactaaatctagacaggaacatgagtcaaatcctattataggttaatttattttacgagggagtacatttttatgctctttaaaatatcatataataatatttttgtttaacaaaattaaaaataatttaccgtgcgttaatgattttgttgttttgcgtctaacgggacgacagtgtcactatcgacaaacgtggttatagcacaagtcatgttcatcaattaatcatactacagtactactagtaccggtactagtacgtgtacgtgtttcagttattggtgcacggttgctgcaatagtacgttaacgtgaagatgtacgtctagttgtatagcctaatttcgtggttttagctataggacatcgtttgaagtgatttttggcagaatacactatgtaaatgtaataattttttaggagacaccacatccattattttaatgttttcgtactgacgacctagatggtgcccactttttaggtggcatgatcgaattgtgtttgtatgttttgtttaggataactggctctgtgcatggagagaatgtactccttgataagctcatccatattagaggtggagctactatgagcgaagtcgtacttgacgctagcggtagtggaggcgatgagggaggcaaaccttcctccctacgtaaacgaggcgcaggtcgcggctgtcctcgtggtcggcaagaggtgggcgagcacggtgcccttcatatcattcaacgccgagtatatgccgagtgcatcaatacggttcttgagtcggtgactctcacaaagaagtggatcctccgaggcaacatgtaggaggacacccctgtggcgttggcagtgtcaccgggtggtctatcagcacctctcgggacagcggcatgagggcatgataaggcctgtcaaggcgacccttcaagggtcggcagtgcttgcaaccaaagtcgttgacgtaggatatgtttacattgagaccgttgcagtggtggcggggaaatcatggccggagaggagaggaggatttaggatgtagaggggtaatttggtttcgccataaaaaaactgaagcccatatcgtgtcgtcatcacaaaaatattaaagtaatgggtgtggtgttatatttacatagtgtatttccatacaatgatacaagtcatttcatatagtattctacagctaaaactataaagtcgtgatgtcttatagaaaaatttgcccctataatataaaagaacgggggagtgaacttatgggttagacaagagacttttgtgattattcatttatttcctttattttttacaatttcggtgttggctattgtcttttttaactttgtccgttaatagtttttaaataaacaaaatgactagtgctgtctaaaacactaccaaagttgcaaaacaatattacaacaagtttaataacaaacccaggtacgggctataatccatatccgccaaattgagagaatatggatattagatttgaacaatacaatagtttacctataatgttgccttcactttactcttttctctctctcacttctccatttattttgtctcttgttctttctctgtatcctttcccaatttaatttgtctatttttaagcacattcttgatcttatataattaagaaccaactctttttcctttctctggtttctctcctcgacatgtccagaagtataatataatgaagtactccaggagtaactataagcttatactaatgtgctagctcttgcaattgcgtggaactgttgaaagaaatattgatatttcttatgttttatacaaaactgccattagatttttccttacatgagacaaaaccactactgcgaaaacaatgttcctagatgaatcttaccaattaatattgccactagctcaccaattaatattgtccgtgttcttcatttggatcctccttttgcattcataaaaacttaaccaccattaacgtgtggcaaaatacatgtttatgtgtatttattaaaaatatttcgagcattctgttaaaaaaggaataaactcaaacagtgcaaatattaaaaacataataaaagtatttgaaaaacaatacaacagataaaacaataaaaaatatatacaactatctatacaaataaggagtcttaaaaaatattatttttagagccctgttgcgagcacttgaaaggaactagtctcatcggttgccaaaaagttattataagcagtaacgacttattagcgactataaaataatttatttgtaaaacttttatagctaatgctgaaaaagaaactacattaaaaatatcttaaaatcaactttaaaattaaaaaaataaattttgaaattcaaattttagctttggctttgactttttataccaaccgatggggctctaaaataatgatactatgcaactcaaattctttgtaactagctgaaatcccgcgcgttgctgtgggagtttaacatgataataataagtaaaaataagatagctagacaatataagattacgcaagttaacgtggtttataataatttaaatttaaatagtatatagaatggtaattcaaatataaaagtaaggtgatatgactttgtgaaagaagaaaaatattgagatagtttggactgtagattaatcatctagaaactaaaaataattgaggtgatatggcttaatgcgagaggaaaaggagaaagataatttggaccatagattaatcatttaagcactaagaacaattgacgtgatatggcttaatgagataagagagaaataacactaactaagtgatgatgaactatataggtacatagcatattataaaaaataatagaaatacatattgaatattatgtgaattatgtgggatgatgatttaacatgcttgtatttcaaatgctctaaaatttaataaattataaattatagataatataacacgttttcatgatgtttaaatttaattattgttagtggatgatgatgtggcatctttgcatatcaagctttaggagttaggccgggtttagttcccaactttttcttcaaactttcaactttt

SEQ ID NO: 25019 - DNA, 15374 bp, Oryza sativa
  unsure (1)..(15374): unsure at all n locations
acttatttagacgatttgaaaccttaaggattaaaatgagcccgaagcaaaacttcaggaaccatattagctattcaccctttcatttatgtgtcacttttaatatattaaatgggtgaaatggaagtatggaacccctgtttgtgggggaaccacaagctttttccatcttacaggggtaccccttcacctaccatactccatgtcatggaacgtattgttgtttgtgcttatgttatgttacaaaggctatgctacacgtagggttggtaactcagaagcttgagtttagctgtcatagtgtgacatcaccagctacatgcaagatatcgacatgttatagcgaggccccgatgtagctcttgagctaggctgatcttaatcggtgtttggtgggttgaaaatttacttgtctttttttaagttattcaaatctaaaatttggttttcttatttcgctgtttcttttttgttcttcagatccttgaaccatggtccatgttttttcattatctcagtgagagccaatagatgttttatttgaacgaattaaaatgtgtgggtaatagtaataggtattgttctgtaatagctactcngttnggcttttcgtatttgaagacaaatgcatcggatacaattattatggaaaaactggtcttagtagtagtggagagtttgtgtgaaaatgactttcagctaccacttttttcatgaaatgatcaatttgtaatacaaaattttcatagtaattcaacataaattattttgaaatgagcagacaaccatatcgttcctgtacatccagaattggctcgattgctacttaaaaacatgtgcaattttttaagtcattgtagaatgtattgattttagaggattaagaaatacccaagctcacaatatggctagttagttctgaacgcgcaaagatgtagcctagaggggggggatgaataggctttcctgaaaattacaaacaaatcgcagcggtaaaattcaacaggctcggaacctccaggtgtagaacaccggaacttccgggttgtctgaacagaccggaacttccgaaaaacctaataaactaacagggacttgagctgattttgacgagatgaactacgtgataatagagcagtagcacaatcacagtagcatgcacagaaacatcacagaggagaaaaagacgattttttcccgaagttcagattttgcaatcctactcttcgttgaggtgctccaaggagccgggtctcgattaaccctttgcttcacttatgcaaagatcctagaagaagtccacggccttcaactcaacacccctagcttattttcaagaattgagtgaccaccaagatccaactcacaattccttctagagaagaccacaagtacaagttgctctacctaggacaacctctgaaaactcagcacaagaatctttactcacttacctcgtttccttgcggaggtgaggagtaccttcacaaactttcctgggacatccacaagatctttggaagctcagggtgacacctaaccgtctaggagaagatctccaagagtaataagcccaagtcacagcccacaagatatccaaagtgctcaatcaaacctaatcttcaaaccttctccaaatcactcatgcactctcatctattctctcaatctcacaagataggctctagatttgagtggaggaagcaaatggatcttgggagaggctagaaaaccctagggcatgaaagaactgaagtgaaatggccaaagggtgagctggggacgatctggatatatataatggctaggtgatgtcatctagccgttactcacatttttgaactggaaagggtccggaacttcctgaccaccggaagttccggtcaacacttaggaaaatttcgccacacaaggtccggaacttccggctagccatctctgtccggggtagggctatttccaaaaatagcccccaaaaatattttagcacttggatctcactaagagcacttgttgtatcccagaaccacaccttgaacccctcttaatagtacggtttttcctaaaactcgattgcaaatattacactatcctatgcacccttcgagctccaactccgcttgcatgtttgttggggggggggggggtctcgatcacttacaaacatcttgggactaaacacctgagtatcctcaataaaactcattagtcccttaaccctatttgtcattaatcaccaaaacccactagggggataaatgcaacttcaagttctaataaaaaacaatataggatggtcttaggaagataaaatggatcatctaacaaagtgtccaagaactgaaactagaatcgattgtcaagttcgcatgggtgttgtactagatcaagagaaggggaaatataaagtggctgatctagttttggaacacaatcacatccttcagttgttagaaacctcgcacttgatggtgtctcaaagaaaaattttagagttacaagattttgaaattgagatagccaacgatgcaggaattgggcccaaagcaacacataagttggctagtatccaagttggtggttcacttaatctcagttatactctccgtgaccataaaaattatttgcgtgtaagcgtcaacgagagatggcatatggtcaagcaagaagcatgctcatgcattttcaagacaaaattgctgagaacccgtcattccaatatgcattgcagatggattgggaggaacaaatagcaaacatattttgggttgatgctaaaatgatcaccacatattttggtgatattgtctgttttgacactaattttggaacaaacaaggaaagcaggcattttagtgtatttgatgggttcaatcagttcagggaaacaatggtttttggtgttgttctcatgtacaatgagacatagaccctcctaaaagcacataatggcaagcaacctaaaacaatctatactgatcaagatgctgcaatgggaaaataggtaaggaagtgtttttagaagcatggcatggtttgtgcacttttcatattatgcataatgttgtcaaacatctagctgaagccgacgatgaagaatctagtacttctcccaaacaaacaaccgaagacaatgagaaagaaccaagtattcttgcagattttagtgcatgtatatttgagtacgaagaagaggaaacatttgaacaagcatttaacaccataagagcaaaggcgagcaagcaaagttggttggatagtatatacaaggtgaaagaaaaataggctgaatgttacatgaaggatgtgttcacattaggtatgagaagaacaattgagtgagtctaaatagtgaattgcagaggcatttcaaatctgattttgatatcattcgatttcttaagcattttaaaagggtggtggaagataagtgaaaaaaaaaagctaaatgctggatttgaatcaaggaagaaaatacccagaatcaaaatgaggacacctatgctaatccaagctagcaagctatacacaccaattatatttgaagcttttcagggtgaatatgataggtccatggtagcatgcaccacggcattggacagcaacaattgctatcttgtggcagttggcagtcttgaagaaaatttagctttgagaaggagtacagagtttttgatgatcctttagggcaaactagtacatgcagctgtaggctattcaatagaactggaatattgtgtggccatgctttgaaagtccttgatctgataaatatcaaatctctcccatcacaatatgtactgaagcgatggacacgtggagcatgtagtgggacagtacaagacaaccatggacgaaatataatagagaacccaagattaaatgatttgcttcgctacaaagatatgacccgcaaatttctcaatttggcacttcgagctgccagccatccggagtcatccttgttagtaaacaacacacttgacatccttagcaagcaagttgaagaacaaatcaatgcatgtactgatacaactgttccagtcattgctcccacaagtgttactcctccaaatgatttggtgagtatagcatgccggaagaaaaaggaggtgcaaacaaaaagctcgaagcgaaaaaaaattggcttgataagatgcactccacaaagaagggaagtaagaagggaggtaagaaaaaggaaaatggttcaaaggtatgtgataacacaacatatatttgattctctttcaccgtgctcaatgggaacatgttcagttttatttcttttatttgaaggaacaagaaactgcaaagaagggaggtaagaaaaaggaaaaagaagcagcaggggcagaaacaacagcaatacaagacactgcagcagtgcaagatatttatcctagtacttctttgctcatggaagaaatatctcaaccatacatggccatcaataccttctctcggatattgacgataatatttcaaactaatacaccattttaatatactatacatggccatcaatacattctctcaattgttcatctgatccttttattttgcagggggcaatcacagatgatgttattgctgatttctagtagtatggatatttcctgtaatctgaatgtctttttgcaaatatgtatcaatgccttttggagaatagattgtttatgagaatagcttttggagaatagctattgtcaatctctgaacagaccattttatgcatctctgaacttgcaacaatcagcattactttttattcaattccaagaaaatttacaacacaatatcaatctatacaatttgcatgatttttgctgctttggatacaatcacaagttacacagtcttgttcccgtgctcctagcctactatttcttcaactttgtcggctgcaccacctgttggcaagaccttgaggcagagcagagcagaccacttgttccgtgagatacatgacgattatccctcctacgctcctctgatttgggacgcacagcaagctcttgctccctgataatcagaacatagatgtgtcactacaataaccacaacgaacagcaaacttcaatgaaccaaatgatgtgacataacatacattcattcatctgtaaatggacttcaggtcggagtttcaatttgatgatagaatttctgagtcacttactgatcaatgcctttggtagctatctatgtaaccccctaatgtaaaccggcttgcttcctctctttgaatgaaatcggcagtgctcctacaacaaggtaatgcacagacgccagcaacatacttcctccgtttctaaatatttgccgtcgttgactttttaaaatatgtttgaccgtttatattatttaaaaaaattaagtaattattaattcttttttatcatttgattcattgttaaatatatttatatgtatacatatagttttacatatttcacaaaagttttttgtagaattgaatcacaagaactaagccaaccagaggggggcgtgaatggttggtatacccaaaaacccaaacttttagcggaaataaaagttaccctcaaattcgatgtagatcggtctgaccgaagttgatccgccggtctaaccgcgctcgcgccgccggtctaaccggtgttgatcactcggtccaaccgcctgaaaatcgtctgccgcatgtgaagtcgccgccggtctgaccgcctcgctctagccggtctgaccgctggtgcgtcgccggtctgaccgccgatgagtcgccggttagaccaccgaaaacccggtgaaacacaaatcgaagaactctcaaagtagatgacaactttattacttctctctgtgtttacaaagtgcaccaacaacactcctcataaaaatctcgactaaactcgaaaccctaactaaactagcaactcaattgctctcaaaagcgataccgggaagccccacgctccccctctatttatacatgaggtaggtagcctaaagccacgaaccaaactcatactaggagtcctaaacaccttaggaaaccctctagtacaagacacaaactttacataaccaatcgtaccaaattttgactccttccaaattcaactccgcatgccatacgcacacaatacctccatcgtatgccatatggaatctccatcaaccacgtgcatcaactctagccttagtatcccgtatgatatctgaccatcacggacatcgtcttaccaccaagccgattcccggtccatcaccgcaaatactctcccgaggcatcaagtcacctacacatgaaataaacaaagaaaccatattccgagaccaagctatctccaacttgactcattagtagcaaacaacagtattacatacgtatagtatccatctagaagccataaccatgaaacaatcacggatatccaaagaaacaatccgaaaccaaaactgacgcagcatcggccggtcagaccgcgggctgcgccggtcagaccgcgggccgcgccggtctgaccacgcaatacacgccggtctgaccggccacactagcctggtctgaccggaccacaattcaacagtatcctcctgtagatcacctgtgaaatccaatcatctccaaaaccacttcgtgaataaattccaaatatcaaaatcaataatcacagatgccaattgttcatcacagaataagaatcaaaacacacattgatcttatatttttaaataagataaacggtcaaacatatgttaaaaagtcaacagtatcaaaatatttagaaacggagcgagtacaaaatatcttgatcaatcaaatatagctgccacattcagcacggcatgggcgctgggccgcacgcctccgatgtaatctgatgttgcgcccggccgtggttgctacggtgagcaaactgctgacctttcttggcacaaatttatcccgttggtcttcgacatcgatgagatgccgccctccaacctcctctattacgacgaccatagatacaggtcagttatggtcgctcatctccacaaaatcccaaatggaaatcgaaatttagggaaaaaattgcagtcattgggagtgtgttcgattcttcaattgagatactcacatgtgtatattgtggaattttttattttttaattttattaatagacctttctaaaaaaatatttttaaatccgaaccttttgaccacgccagcccgtctggcgtagccaaaaaactatatcactccagccggtgtggcaggcctttgccacgccaacggttggcgtggccaaacaacactgccaagccagccactcggccggcgcggccaaaaggttcaggttttgaaaatattctttggaaatgtgtaataataaaattataaactaaaaagatctaaaaaataaaaaaaatcttgattgtgggaagatcaggtcttcagaaaagaattattgatatcaaagcttgaggtgaaggaggaagtcactgaccaggctcttgatctgctgatttcaagttgaacctgtggcagcggccgcagtagctgttctagaaccgagcggcaccgactgtagactgtagtacaagcgagcggactgcggggacggctgtacaagtagtaagcagtatttggtacttctccgttctaaaatgttggacgccgttaacttttttaaaaatgtttgaccgttcgtcttattcaaaaaatttaagtaattgttaattctttttctatcatttaatttattgttaaatatacttttatgtatacatatagttttacaacggtcaaacatgtttaaaaaatttaacggtgtcaaacatttagggaaggagggagtattttggtttagttcaggtggttgcctaacttgccagtacttggtttttagcttcttgttcagtaaagaaaatattatatatactagagatataaatatagattctaaccacactgttgctgtaaaaaatgtttcgtaaaatatttttgatttttcaggttgcagtcggaatctagctgcaagaaatcagctcagatttcctagggctatcaagaagacactatactaccaagttgctcgacagtatttgtttgcaagatcaatcccaaatatatcttaggtgatttcttgccctctcagaatactgcaaaagaaaataaaatttaagattgttgtcttgtctttgtgcctttgactggagaagaggctgtgcctccatgatcaatattccttccttctacatttttaacaattgagttatattgaatggattgtccgtaccatcaagatccagagattgattaagagcgaggataatagtatagctcacttcatactattagtccatcttaaaatcaacatacatatataatatattagctataaggttgggtataatttccttctcctgtctctatctctcacttatacatttaatgtatttatcttagagattgtgttaagctagctcttgcatgagagccaacccccttaatttttttgttacatctcttctccacataagcttatagtgggcttatagctcagtattatacttgctctaaaacagttcaaaactggaattggtgaaatcaatgagagtctttatgatttgatggctgcatatcaatgagttttttgtaattcgccacctcagatcagattgaatctaggatgtcacccaaaattcagagtctgcttcacctagaaagtcacccctaattcgtagtgtaggttttttttgaataaaaatttgatgacattattagctaatgtctaattgaattgatacgtacaattcccatatagttctttgtcactgaattttctatttttttcctcaggaatgaatatgatcagggtagaacataattagtgctctttaactccaaaagaagccagaaaacaaagggaagctcaatttgtggtatgtcatacatgtactctttgtccattgcatcacaatgttaacatgatcaaatttgacaagaccaacccatgtttcaggctgttcttccaagtttaaggcagatatacctgcatttgcactgtttgaggaattgagaaaggaggctgaggctgtgcaaccagtgccagtcaactactaccttctagcatttcacttctggtcaaaggggtcaaatattcagaaagacatcagtgcttctgttgactacttcactccacttacaaagtagtagtatattgtacaatataccaaaatgggacagagggagtagtgtgaaaatgggacggagggagtatgaaagtattgctctttacttcactttattattgtacttagactctcagcatggggaacacaagttagataacaggaaatcacaaggacggtttatacagtttagtgctatgatttttctgttaacgcagtgcttgcaaaatgtggctaataagcttgtgctaaaattggtttcctatatttcaaactgattatctagacaattttatcacaagcagggcatgcttcctctcctttttttaagcaacccaacattgctggttttatactaaagagagggtagcactgtacaacaaattataattaggaacctagagaaaaacagaaaaatgtaggcttcagcatagtgccacgccgcacctactgtatatcctatccttgaaaaagaagggtaaaagcctaaaatgtttgccaaattattctatgtagatttgaatgttatagttagatttattttacatgtggtggatctgtattgcccccataaccatgtcctccctatcaacaatcactgacaagatttcctcgttatgttggtggtttctatggtacctttctttacatcggacaacattatgacttgctatgcttttgaattctctcttctgaaccttgtttagttttaaaacaaggcagctctagaatgactatttgatactgaagataacctatacaacttggttttcagagaaggtaagtttcctcatgtcccttaaatcaggttgtttcatgcagctaaatgattctacaaaatagaatcttgcaactggaacctggctttgcatccctcgaagtttactctgtaactgatatgttttctttaactgacaacaaatgatactgatagctacccaacattccaagattttcaacttcatgctttttaatggattttccatggtgtgaattgaccttttgtaggatcattctttatacaatgaatttgtgtggatggagaaattttggagatctagagaatgatggctttcaggcttgccaacgaagagatcctgcccttcaattgtttatcatacacagttgaacttgaggtatcgctacaatgccaccatatttccagtagtgtctgttgattgcaaagcctatgggtagagagaaaccttgttcatttccttcttttgactgaactcacaaggttcctctctgtccatattatgattgtgtttatcacaggcatatacaaaggtagcagatattagaatgaagttaatggaacagccatcagatgctctccacggcacaatgcaatcacagctctgaatatagcagcaatgaaagtaaatggagagaaagggtaattgtatactagatgatctcattagggaggcttgtttcattttgacttgaaagatgatactgttggatgtaattttgatgaagaaaatggtttatctattttaccttggttcaaatgaataatataatagaagaacgtcactcacaatcacattgtatgatgtacttactgattattatgtttatatagaaaaaaaatatataaataacacgcttcttccaaacatagcacacccgtagcgatagcacgggtattttactagtaaggaaaaatgaatgacaattcaagccacaagaaagtgaaaagaaataataggcaactttcaaatagataaccgaataacctatgctatatatgtagttgcgttgcacaagcaaagtagttttgagtgacaatcacttgatttgctcaccaactgctagtattttagaaagaattgagcacatctttcaatcttccatcagacacgtctataagtataagcttaattaagtgctactccctctgtctcattttaagtgcagctataagttttcgtgcctttcttcctatcttaattacattgaatgacctccttcagttattccggcataagtttccgtgcctaactttaatcgtccgtcttatttaaaatattttttaaaaaaattaaaaacataagtcatgcataaagtaatattcatgttttatcatttcttaacaacaaaaatactaattataaaaaaatttaaataagacagatgattaaaattgggcacggaaactagttgcacttaaaataggacggagagagtacaaaattgtgcacttctgcaaaaccaaacacaaacagaattaccagtgggcaacaagcttccggatggaggcggcggcggtgagcgcgtccaccggggcgctgaacaccctcctccccaagctcgccgacctcctcctcctcgtcgccggcgagcaccacagcagcaggcgcgcggtcgaggacggcgtcgagcacctcgagagcgagctgaccagcatgcgcgccgccctcgagaaggtgtcggcggcggcggcgccgcccgaccagctcgacgggcaggtcaggctctgggcgagggacgtccgcgacatgtcctaccacatcgaggacgccatcgacacctacctgctccgcgaggccgccgccgccggacgacgaccaccaccaccaccgtgctgctccttcgtcgtcggcttgaccagctcggctcgccgccggagccgagccatcgccgccgagatcgagcgcatcaagaaggaggtggaggaggtgagcaggcgccgggaaaggtacaggatcgacgaccacgtcgtcgccgtcgtcgatgacgctccggtggaccgccggctgccggcgctgtacgcgaacttcgcaagcctcgtcggcgtcgacgcctcagtggaggaggtgatcaagctgttatccatggaaggatatcaaggtgcagtgatgatgaggcgaaagctcaagctgatcgccattgttgggccaggaggaatcggaaagacaaccctagctaatcttgtgtatcagaagctccatggccaattcgaatgccaagctttcgtctcggtttctcaaaagccaaacgtcaaggctgttcttagcagcatactctgtcaagtgagccaactcaaatatgaaaatttcagttcttggggtgagaaggaaatcatcgacaaaatcagggatgttctcaaggatatcaggtatgtaaaccatcactgaatttttgggtgtctttggaagttttagatatggaaaatgaattgcatccccggcatctgcatctataaaatgcactgagtcaaggtgtctttggagtggctaaaaaggtcaatttcgaatccctgggcttttgtggaaattggaaaaaaaaatgaacctgaatttctaaaccaaacattaattcaatctaatctactgaaatcattcaccttttaactttggttacaatttaattggaatgttttctgggtgacatgtcagcctctggaaaaattattgaatttttaaaatagtaaatgcttttcagaacatacttgaaaaattctagaattgcacttgaaatatttacattacatatattatgttccattttttagacactgtttttcatgggccaactatttttaaatttatgtactaatgttctaagttcagatgtggttacaaagtgggccacatcagtgacacttacccaaaactaatctgtgtttgggacaatgtggaaacgaatgattgtttctagcttaaggtttaatatactcctctttctatgtttattattgtttatcatatttgtacaatttaggttacaactaaatcactacaagtatatgtatgtaacccatgcaaccatttatctaagtcactacaatgcaaagctctcctgcacgttcgaaaaataaatattaatccttcttcaactaacatactttgaaattataggtacttcattattattgatgatatatgggataaaccaacatggcaacttctaaaatgtgttctcatcgacaatgatcatggtagcaaaataatcaccactactcgcaacatggatgttgcaaagttgtgttgctattctgatgatgttgatggtaccatacaaatacaacagcctctttcagttgctgactctgaaaaactactatatcacaaagtattccataatgaaagatgccctcctcagcttaagggcatatctcagaaaattttgaaaagatgtggtggcttaccattagctataattactattgctagcttatttgcaaataggcagacacaaactgaggaccactggaactcggtatgcagttctttccatagcggacttgaaagtagtactgatgtgaaggacatgcgctggataatatctcttagttattgtgatatgccttctcctcttaaaacttgttttatgtatctcagtatatttccggaggattatatcatcgacagagatgacctgatatggagatggatagctgaaggttttatccagccaaaacaaggtacaattctatatgaaaaagagagagatactttgatgaactcattaatagaaacttgatccaaccgatatgcattgatgtgcatggtaaggcacaagcttgtcgtgtgcatgataccatattggaatttatcgccggtttatcaattgaagaaaattttgttgcaattttaaatggtcagtgttcgacgtcggatctaccgaaaaggatctaccggttatccctacaaaacagcaaggatgatattacaatacctgatgcaaccgagagattttcccatgtgaggtcactttggcaaggtattgatttgaagatgcccctttcgggctttcgagttttgcgtgccttggatttaggagattgcagcagtcaaaatattgataatataggtaatttggttcacctgaggtatctaaggttgcgtggtacacattataataagcttccaaaagaaattggaaacctaagatttttgcaaacattagatattaagcagacaagaataaaagaattgccatcaactgttgtacatcttacacaacttatgcgtcttatggtggacacatggacaaagttgccaaatgggattgggaatatggaatgtctagaacaactgtcagagattgataccagcatgtatccaagtcttatgaaagagctaagcgatctgcccaatctacgggttctagaaattttgataagcacatgggagcagaccaaagaggaacaatttcttgattgtttaggctctatgaagaaacttcaaattgtccatatttttgctccagatatatcccttgatttcatgttgaataaagattggacccttcatgaactccaaaaacttacagttggtgttcgccgagaaagcgaagacatatttaagctcaacccattgtctgggtgggctgagtttagcccattctctatcctaccaaggtggatcaattcatcactcaccaatctctcatacttatcgatcattgtcaagatactacaacaaaaagatcttggagttcttggggacttgcctgcactttgttctctatacttgagcgtgacaggcgctttaaaggaaagattgatgataataggtcatagtagaggtaatggtcaggcaatagcattccaatgtctggctaacttcaactttacaagtcctgcaatgatgctagtttttagacatggagccatgcagaggcttcaaatgctttccttttgttttcaactaaaggagacaaaagtttttcacagtgatttggacatgggcttggagaatctcacctccctcaagactgtacattttcagattgactgtcgttacgctaggctctgggaggtgcaggctgcagaggttgcactaagaagtgcaaccaacttgaatctcaactccccaacccttgacttgagcaaacattttgaaagattgatgtattgggatggaatggaagagatccctgagatgaaaatattcaaagaagaaaatgtatttttttttgcagcaatcccttaaatttatttccttctcattttactgtagaattattggtttatcggtttgttgttaggttgggattgtcaagattggaccatggggtggaaatagagggaggcgttatgatattgaggtggctcctcaccatctagaaagcatcagagttcacagcgatttggctgtacattcatttgaatttgaatatagcgaccgtaatggacagaaacatgttgcgggtccttggggaggatatggtggtagtaatgttcataggtgagcat

SEQ ID NO: 25020 - DNA, 11066 bp, Oryza sativa
aaaaaatcaagataatgaattgttgtaagaaataagattgaagaaaaaaaatatatggtgcaattgtctcatagagaaatttagagaacttatcatgatagaaagacttcgagtaaattccaaaaaaaaactacaaatactttgaccaaattataaaaaaactacatatttaagatgatctatcacaaaactacagatttaataataaatttatcgcaaaactacaagtttaaggctaagtatatcaaaaatacagatttaataataaattatcacaatactgtagattttggggtttaaatccttaacactaatgttatgtttgagttataaatgtctaatttttgtgattaaattggcattacgtgcagtttactctatctaaaaagagcattgggacacctacacaaaaactcttatttgttctagttagcagacgcatgaaactaacatgagttgcatactgtgtaactaatattgtataatgtctaactagtttttagacaaaatggcattaatttagtgatcatatctcatccatgtatccaaaaattataggaattacatgaatattccgtctgagcacaagctggtgacatttttcgacatgaatccatgttataccgttctaaagcatgtcatgtttttctgagtcatcttattatagtaattatttttgctttcctgcagattcaatttggcccttcagagttcataactagagtttatggaacaattggttcatacaatacaccatctgatgttgtaacatctattacattggttactaatgctggctgctatggaccttttggtcaagaaaatgggatccctttcgactttccagtccagggtaatggcagcattgttggcttctttggacatgcgaacctttatgttgatgcaataggtgtctatgtgacaccttccatgggaacaaggaaagaagaagaaaatgtattgatttatcagcaatttgtttgtgctctttattgtgtagaactttcttacatattgcattattttccccttttgttctcttttctttcttggtctatgtttaggttgggcttaccaagattggaccattcggccgacgtggagggaacccttttgacatcaaggtcacaccacaccagttggaaagcataacaattagtagtaacattgtaatcaattcacttgcattttcatacataagccatgacaaacaacaacacattgtaggtccatggggcagtggtggtgagagcaattatacggtgagtgtgtactgtatataaaagctactcctcctagttgtaaatgagtgactagctaggatttatatcagtcatgaaagtggtaagtattaaaaagtgctacatatatatcagatatccctcttggttatgggagggacaactctaaatataatcaagcatgcacccttgctacatatttatcagatatccctcttggttatgggagggacaactctaaatataatcaagcatgcaccctttggttataggagggagcaatttaaagataatcaagcatgtatagggtgtcttttctccttcttccattaataatatctgctgaaaattaatattctccttggcgcatacagttgatttgggaacattttttttatccttcctgtttgttgtagatccagcttggtccttcagaattttttgtcaaagtttcaggaacatttggtccatttggtgaattccccaatgtcataacctctcttacctttgtcaccaatactcatcatcagtatggaccttttggacaaggaggaggcactccattccatgctccaatgtcgggcaatggcagcattgttggcttttttggccgtgaagggttatgtattgaagcagttggtttttatttttgcgcattatgacaacagtttgttctatgttgcatgtcaaaggttttagtagatttgtttgtgtgtgtgtcctttttttttgtttcctatgcagtgaagattcactagttccatgccccacaccatgatcctcactagttgttccggcaagctccatctagacatgtcatgtttgggggaatttctagaaactgcggattctcccagaatctacagcttcctaaaaaatcctgattctcgcacatgttataaaaaaatctatagttatagaatctaaaaaatgaacacaaaaaactgggaaacccaaattttcgacaattctcaccaactatttagtcattagatgtttctcagaatctcaagattggttttggttgacatggcattgatgtgaaaatatggcctccgcttaaccaaatcatatttttttaaaaaaaattgtaaatgaattgaaaaaaagtattacacaaaaaattatatccaatataaaaatattcgggccataaaatagttttgtgaactcactaaatgatttctagtagaaaaacttgaattgttttactataagcaaatttatttaggttgtaaattctctagtatacaaccatgatttgctcattaataatttaagtaaaaagaattgaaacttttgacatctacaaaataattaggagttatctaaaacacattactttggtatggttacatgtgaaagaaatatctaaagtgtgatattgtgaagaagattctataaatgatatatagtatttttgcagtagatctttcaggatcttggcaagtggacaagacagaattccatggaggaaataatttgcgatgatctttccaagtggcaaagattgaatagtagaaatagagggtgccctcctcccaaatgctacaaactagctactcaggtatatagcggttaaaatgctattgtctataaacaattttgtggttgtcaatttagttgtcgatgaaaaactccatacaattgtatagatggcataaagttgcaacacagcacagacaagatagcaccttggtcaactctctaccatcaccactacacttgttgtcgacgagtgcttgtcagcaagatggagcaccctcaccacactaatatggagcaaatagagaccggggatggcatacaggctatcacaccctgattttcgctttaggatttataaattatttaataaaatatttctagaacttgtattaaagttcaactaatttacaagtgaagttaatgtgggaaataaaatttcccaaataatacctgggttaatttaatttttattaaattctccatgattacactctctaaaattttcttagattttttagagataaaaaactaatttaataatacaaacatcatttcagcaattaatttaaatgaaaaacttattaaaatcatccagcatccgccgaggtacaagagaggaaagagtgtcgacaacttcggcactcctccaaaacttcccctaattctctacctatattctcaacactactaaagttacgcctaaagtatgaaagtgagttgtatgccactttgttgcgtgttgtgaaatgagaactttcttccttttatagcctgcttatgacggttgattaggtcggcaactcccacaaccgccattaagaggcatgaatcatggatatccacgtggaatgtggagatgaggggctgatggcggttcccttgaatttttcttttatttaaaaatctcatcatttaaaaatttggagttaaaatttggatcttattttattttgtgccaattagatctcaaatcctctcttagacatccctttgaatttctgtcaaaccctaggtcaaaattcaaatttaaatatttccaaaaattccttaaaatatcaactccaaaatcctagagaaaatcagaaaagtcactgttcattgggcctccttttctttttcattccctctccccaactccctttcactctctcctccacccacacctctctttctcaccgagcaggccggcccatggccttcccgcaccggcccagcccaccttcttcatcttcttcctcgaggcaaccacacacacgcaaacaaacagttcgacaaaatgtctcgcccaacgttgcacggccctcgcatcgtgtctgtgctgtgttgtgccgttcttcaccctcctgtgcaccgtgcctcacgccagggccgcgtcatgccaaacccacattgagccaaggtcgcgccgcaccaaaaccgtgccgcgccaagccatggatcccggcaaaatctgaccacgtccctcgctccggattccctccgggagacatggtgccacgccatcccacgtcaccctccgttccatcacgccgtcctatcccgaactcccgcggacgcgcgtctcctcactcgtcgcaccaccgttttgtcatccatctcctcccgggaaactgcctccgcatctccctctctctctctctctctctctctctctttcgcgtcgcgttgccaccgccgcatgatgccgctcgcgtccccttgctctgaggatgctatcgagctaatcccgaccgtagccgccatcggccgcacgtcacccatgtcccgtcactaatcccactcatttcctgctacccttcattgatgaaatgttggaacgtctagcaaatgattcctttttctatttccttgatgggtatttcgggtatcatcaaattcctatccatctggaggaccaaagtaagactatgttcacatgtccgtatggcacctatgcataccgtaggatgtccttcggactatgtaactctcctgcatctttccaaagatgtatgatgtctattttctcggacatgatcgaagatatcatggaagtcttcatggatgacttctcggtttatggaaagactttcggtcattgtctgcagaatttagacaaagttttacaacgatgccaagaaaaggacctggtgaagggatagttcttgggcatcgagtgtccaaacgaggaatcgaagttgatcacgctaaaatcaatgttatagatcagcttcctccccctgtaaacatcaaaggaatccgcagcttcttgggtcatgccagtttttatagaaggttcatcaaggacttctctacaatcgccagacctctgaccaatttgctagccaaggatgcgccctttgagttcgatgacgcgtgcctaaaatcttttgaaattctcaaaaaggcactcgtctatgctccaatcattcaacctcctgattggactctgcccttcgagattatgtgtgatgcaagtgactttgctgttggtgcggtcttaggccaaaccaaggataaaaagcatcatgcaatctgttacgctagcaaaactctaaccggagctcagttgaatactgaaaaagagctgctcgtggttgtttttgctatcgataagttcaggtattacttagtgggagccaaggtgataatttatactgatcatgctgctttgaaatacctgctcactaagaaagatgctaaaccacgtctcttaagatggattttgctgctccaagaatttgacttagaaattaaagataaaaagggagtagaaaattccgtagcagatcatttgtccaggctgcagatcactgacatgcaggaacaaccaataaatgatttcttgagagatgacatgctgatgacggttcgcgactccaacctgtggtatgccaacatagtaaactacatggtatccaagtacattccaccaggggaaaatcaatgaaaactgaagtatgaaagtcgccgtcatatatgggatgagccatacctatatcgggtctgctccgatggcctactacgaagatgtgtgctgactgatgaaggacttaagatcatagaacgatgccacgcctcaccctatggtggccattacggtgcattccgcacctaggccaaaatctggcaaagtggtttcttctggccaacaatgtatgaagactcaaaagaattcgttagaagatgcactagctgccagaggcaaggaggaatcactgctcgcgatgcaaagccccttacatacaatttgcaagtcgagatattcgatgtttggggtatagactttacgggaccttttcctaagtctcgcaactgcgagtacattctggtggcagtcgactatgtctccaagtgggttgaggctatgtcgtgcagtgctgcggatgcgaggcatgccaagaagatgttcacagaaaccatcttaccaagatttggtacccccagaatggtcataagtgatggaggttctcatttcattgacaaaaccttccgagacctcctacgagagatgggagccaaacacaatatggccactccttaccatccacagaccagtggtcaagcagaaacatcgaacaaacaaatcaagaatattctgcaaaagacggtcaacaaaatgggaacaggatggaaggatagattgccgtacgcgctgtgggcataccgaacagcgtacaagacacccattggaatgtccccatatcagatagtctacgggaagtcatgtcgactacccgtagaacttgagcatagagcatactgggccatcaggaattggaacatggattttgagggagcgggagaatggagaaaaatgcagattgctgaacttgaagaatggaaagagaaggcctactacaacgcgaaaatatacaaagaaaggacgaagcgctggcatgaaaaaagaatcaaaatcaagaaattcaagccaggagacaaagtactgatattcaactccagggttaagcttttcggccacgaaaaactgcgcagcaaatgggaaggaccgttcgacgtcatcgacacctcttcgcacggggcaatcacactctgcgacgactcaggtaacatatttaaggtaaacggtcaacgcttaaaaattttccttgagccaaatgaaactttagaagaagtggatgttattgaattagttgattatgaatagggatgaaaacggagcggatagtttccgtccgctccggacaaaaacggatacggatacctttcggatcggataattctcggatatttcggatacggatacggatattttctcccggatacgaatacgaatatggtatcagggtttccgtcggatacggataataattcggatatccggtgaacagtgctattcggatatccgcaggacccatgagacataccccatttctttctaactctataactttcaatatacctttatagattttaatagtagtttatctcttaacactagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcgagataatccgtatttgtttccgtattctagctatccatattcgttttcgtatccggtaaaaaatatgaaaacgaatatggtatgagcattatccgtccgtatctgctccgttttcatccctaattatgaaccatgatgatctcatctattgcatgcttaaaaccctgtatagttgccatttctgcgctttgtttaggttttagtcatagctattaggaccggaccggaccggcggtccgaccgggaaaaaccggaaccagggcctcggccggtccggtccccttaaaagatcggctgtgcaactgaaccggggaaaaccgattgaaccgggtggtttttatgaaaaccgggctttaaaccggagtggtcagaccgggctagcttttggtgatgggctcaggcgagggccgctgagcaaagtccaccaaaaatcgctggaaaaggatgtgggagtggggatttgaccatgggttgcgcggttgagagctgcacgcactagccaccacaccatctcgttgcttctgttggtttaagacatttaatcctataatactttgaactgcggttggaccggcctaaccagtggtcgaaccgacaaaccattgaaccgagagctcgaccggttcattctccggtccggtcttaataactatggttttagtgggcctagaaaaaaaatggaggccagccggacccaccagggttcggccgaaccagggcggcgtccgaccgctcctatttttgaatgatagtctcccccgctcgttcccagtttgtttagatgcgcgtttggaggtagaatgttcggatctcaccagaacacttcttcttcctccttttctccacctttgcacattctcctctccaattcaacccaattcctcgaatttccactcatacccaccaatggctggcaaatcattgatcccattcatcggctcttcatccaattccatgtacaacctcaccggagagccaacaccggtgaatcgactcatcccggtggaaaactacacagtagaaggggtgaatgcactgtgggtgcagccccttgcaatagtgccgggctcccctgcaaatttggagcccgtcgacgagctccctggtttggccgaaccaggggttcggccgaacccttctcggccccgttcggcaacgcgatccctctcccctcgccatgtcacgaagacaacaatctggcgggattcgcctgcgcgacggcctacaacgggagagctcggtcttttgaaggcacgaatcctttttcaagatgacgagaaggctgcgccgcctcccgccgagcgctatgtgggcaccctgttcactaaggcaggggatgaggttctccacaaatatgtcacacccaccgctactccatccactccgaaggaggagcgattccgcattcaggggttgcgaactcccggcggtgggtatggcaaaggattgctctggcctttgacggcatcggagaaggagggggcagcagaatcccgtagccctccacctatgaaggtgaagcgtcatttgacgccccctccagttgtgagggctcccggccaattccaagaagatgaggtgaaattgccggagccctcgatccataagctcgctgcgcaagtgaagaaactccgcaaggagaacatagagcttagggatcgcaacacggagctaggggtagagtttgctgaaactagaaataattttgatacccttagtcgcggtttgcgcgctaaaatcaagtgtgcattcatagagatgtggaaggaaaataagtattatgctaattagatgtttcctttcccatgaataaaatagtagtaggtgtttggttttatctttccaatcatacaagcacttgctatgaataatgtggctcattggtgttaaccccaatgtttgccaaaatttgttttgtttcatgtttaataaagttcaggttttgaataagtgtgggggagatatcccagcttctgacgtgcatatactctgaaaactgttgaaatctctgaacacctggaagcactgaactctacagaaagttgcagagggatcatgcgccagagtggtaccaggttcggccgaaccagtgttggccccaatccctctcaactttcacaggtaagcaggtgagcacgtccgtcatctatatatctctaccatggtatagtactagagctgaaaattcagaaaacaactggttcgagcataagaaagataaaatttcccactaatgaaattcttcatatgattgatcttgtatattcattattctcagctgaacttgtgcttgtgaacaatcatccatgtttagggaaccctatgcatctaagtaaatgctatatgagagatgattaaagatgaaaggaactcttgtaactcttgttatgactcttgggaatttgttttcaaaatgaaattgttttaaaagcttaatcctccaattgacttcaccttatgcctaccaaggccatatgcaagtacatcaatgatcaaccttatcatgcatatgactgctggacattatattgagctttgtcaaatttgtgtgactcatgttagatatcttttatactctcatgattaagaggtcattatcatatctacttcccatttccacatataaaatttagctaagcttctacactagaagttggctttccacaaaaatatctattcaaaaaaattcctagtgtatactatgctttcttctcctaaaaaaaaactcttggaaaaaataaaatgagaaaaggagggaaaggcatggccaaagaaaaaaaaagaagaaaaagaagatggaaataaagcttgctctcaaaacattgagcaaagttgaaaagaaaatatagccatgccccttccatgatcatgccaagaaaacaaaatggagagaaagtataggaaaaaggagaatcatttctttattccaccattccacaaaaatattttattcattttccaccataaagaccctggatctaagagtatgattgatgatcttcttgagtccatatttttggctttgcaatatatatgatgcaggtatgtcacgatttatccctaccaagctccacatattagccttagaatagggatgaaatctggcacgttttaccttggtgaggatccaaaaagaaaaagtacatctttgagagacaagagagaaagtcaatatgaggaaaagagctggtttgcgaaaatttataaaaaacccatgagtctgacagagaagaaagaaggactggaatcgagatcatgccatttatcaattactcgagatggtaagatagctacttataaagttcacaggtacaggtatggttgtgaatgatttatatgcttgattcatatcttgaagaaattcattctacactaacatttactcagggacgagtaaagggctaagtgtggggggttttgttggcggctgttaaatgccgattctataccgccaacatctgcataaagttcggataataaaacatccaacatagtgataggtgctcaatctcacatattccacaagtgttggtgtatatttgtatgcagaagataagcccgatgttggaggaaatctagactaaagtgaggagaattatgtatccatacaaggatgggttgtgaacttcatcaaaatatcaaagactcagcccaaaactctgcgaaatggatagaggaggatcaggggaggacatgagccaaaggacatgct

SEQ ID NO: 25021 - DNA, 608 bp, Oryza sativa
agccccatcgacagtggcaatggtggccccaggctcttggaaacctaggtcatcatcgccgtcatcgatgtcctcagcgggggcctttgcttggcctcacttcgccgattgccggaaggaaccgccggggacttgccctctcggcgctcctgccttctctcttctctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttctttctcctcctgtcacgcccccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgccggtgtgccgcacgccccccctgaacgcgtagattaccg

SEQ ID NO: 25022 - DNA, 467 bp, Oryza sativa
ctcgacggcgtgggttcggctccccgtcgtcgccactcacactcggagagaggtcgtgcgcctttgcttgctcagccataaggctaaacaggaaaagcttggtgcacacgaaagagtgcaagagctcagaagatcactcgcagagtcccctacctggcgcgccagatgacggagcgtggggctcctcaccgggagaccgcgctggccctcctttgccggttcggccggggaccctgggtgagattctaagctctcaatctgtatgtggaaggttcgcgagacaggaagcacagaagacaccggcgatgtatacaggttcgggccgctgagaagcgtaataccctactcctgtgttttgggagatctgtgtatgaaagagctacaaagtatcagccagcctctcccttgttatgggttcctaatctggaaaggtccagtccaagaaaaagctctcttcctctctcagt

SEQ ID NO: 25023 - DNA, 16931 bp, Oryza sativa
ccgataccttatgcttaatcttaaactctacccactttctttcaaactcatcttcatcaaactcactatgcacaagtgttctaaaatctgaaagcatggctggactaaggttccgtgccatattttgctcaatatgccaggtgcacaacctatggtcagaattgggaaacacatgtaggattgcccgacgcattgcattgtctccatcagtgatcacagacttgggatgtttctgacacatacaagttaaaaactggcgtaggacccattcatatgtctcaaccctttcatctgaaactacagcacatgcaaatatcacagttgacccatggtgattgaccccaacaaaaggaatgaaggggagattgtatttgtttacacgatatgtgctatcaaacacaacaacatcaccaaatgcatcataatctatccttgattgcgggtccgaccaaaatagcctcttcaagcatcctgcttggtctatctcgtaatcataatagaactccatatcatccttctgccgtgcttgcatgtacttaagaacatggtcagcatctccacctttaatccgtttctttttcagcttcacaaaaaaattgtacatatccctagaagtaaaaccagtaccctcataaccaccatggtctctctccattatatccatcacttgatgctgatgcaaacctacatctctcaattctaccatcttagcctgttctgcaggagttattctacgatgtgagcggagaaatggcacttgatcacctttacacaacggatggttatgcttcgacacaaacctaacgacataccagttaccttttttctgatatagtttaatctcaaactgagctttgcaaccacaacgagttagtgcctgtggctccctacttctgttggaaacatccatatataactcctttctaaatccttcccttgagcatgtgaatctacgatgaattattatcccactaaaacgatcacgcctgcagtaatccttccttacactaaaacctctctctctagcatacttattgtagaactgaaaaccatgcaactcactaggaaatttcatgcctattatcgtagcatactcttcctgctcctcaatactgctaccaccgccttccattgcacacaacacagtaaacctgccaataagtatgaccactttcgtgactacttcatgcattgcttcaactagaaaatgaactacaaacaacaatacaaatgttgcacatatcatttttagtgcttgctaattacctgcggttgagggcgtactgacagctagggcggcggcgtcaatgttccacagttgtcccagcgatgctggcgtcttccggttggatgcgacagcaatggggctgggtggaggcgacggccgatgtgccgtgctagaggcggcgagttgtatgcgacgccgggtggcggcggcgacggccggaaccctcgatgcgacggcggccgcggcggctcgatgcgacggccggaaccctcgatgcgacggcggccgcgggggctcgatgcgatggccggaaccctcgatgcgccggcggccgcggcggctctctgcgatggcgggtgagggaagacagcgacggcagccactacggtctcgatctacttgcgacagcggcagatgcgaacgaagagaaaaaacagaagcagaaggaagagaccaagtgattggttagcagggcggtgattagcggcagggctcaaacccgatcttacgatcttacccctgctaaattaacggctagattagattggtacctcgtacctcatggcacctgctcaaggacagtaaaaatgctcaaatgctccaattataaaccctgatggataggataagagtggaacaacttttgcaacagtttatataatttagttcattcatttggctctttcgcctaattattctgctctccagattgtcgtaatcaaatatcttatcacatcaaatgcaaaaaggtaatggcctgattttttttagagacaaaatggcctagctaattggtggagagggaatattggtgctgaagctgtttctgcgtgcatcagtgtcagtcagcacacaaaagcacaagcgaagagttattaaaaacattcgatcataaatggatccacataacatagtaccagaaatgaaccagtaaattacatgaatcaattaagtgtcttccactcagataccagtatagatgtaccaagtatagtgatactcgtgcacgctggttaattagatactcgttgccggttctaacttagttggggcagccatctgggttgttgtaaactcaggaggtgttggtaagttgggtgagagtgataggcttgcctgtagccttcttgagattgaaggagctgaagccctcggtgagagggtcaccatctccagtgcctgcatcctgagctgcattggatagtccttcacacatccaatccttggaccagccccagtgctccatttcagggacaacttgtggccaagctgataggatcttgattccctcttggatttcaccctctcaagaatcgctttccgcgggacgtcgatggtggctctagggctttgtagcccacctgataaggttctttggtaggttggctttgcttgctctgtggcagcattgtcgccttcggcaccttcaacttgtgaagatgacccagatgccttgttttctagtaccatgttttgtgggagaatcaattgtggaggattggattcaatgatggcagtgatagggctctgaactttattaggaactggttcttcatactaagcatcatcgtcggatgggcgcacctgaatatatacacaaataagaactcattgattgaaaccatgcatttgatatatttcataaatacttagcctgaaatatggtgtaccacgttgttgagatcaactccattctcctctaggaagttcatgaagttgctgaggttctctgcacttggtttgtagtgaccactataggcccagatggactgaaatcagaatagatcatcagagatagaaaaaagtgctgattaatgcacccaaggaacagaatcatgaacaagtcatatgaaaattatcaaaatgttctcttataatgtgcttgcgaccagaagattagataatccattctgatgtccttgtaagtcgtaactaagtaaattgatcaaagaaaaaaaaatctgaagaatcttgtgggagttatattgggaaaatgcgataatgtaagtagatattttgatttagcaacgataaaagataggtaaatttaaatgaccagtttgatccactatacaaatttcaaccacttacgcgaaaatatttataaaatccatccaggcattgtctaatatttgtcacaaaaggatatgcatgctaaactgtcatatcaggaaagtaaaatgcagtgcacaaacaataatgaaccttgataactccattttctgctgtaaacctcccagcagctatggtagcacctcctgctaaaaagctcgagtgctggaacacacctttctctttctgcatgaataaatcagcttatatatatgagtaaatatttatagagatgctaattaagctaccagcttatatgagtaaatcagcactaacgaacacaaaatccttatggcacggagaaaattaaaccaccttgccagcataaagtctcttcgttgtgctcataacaaaaatccactttgacccttggcttgtatcaaggggttcttcagagtacttatggataatctttccttttgtaatgatgtattcatattgctcacgctcttgctgcaaaacatgcatcagatatatataattgttagaaccatctgtaggtaggaagcaaaaatatagatctcactaacaatattttcatgttacaattttgtaggttgctgaatttaatggtttgtttcagttgtcaaggattatatatgcagcaactatagaaatgatcttaccggaccaagatattttatgcattgcttcttcagctgagctcttggacactcaggaaggtcaacatcttttccctccccaatatcaagcctacatttgcaaaaagaacattactgaaatcactgcacaatcaaaccacttactgaaatttatgtgattcagtgcaacactgaacttaatgcattctatttgcaaattaatctctttttgtcagacacatccaaccagtttaattattccaatgacatggagtagtttgcaaatgcaagcacacaaatcacagtcaacttctcaccagtagaaaaaaggctggccggcctggctttggcaccagacatcatagtagcactgcagattgtgaccatatctatgccgtgggtcaatctatacaacgaatgataattgctgtcataattgcatatgtgcatcaaaagtttcacataatgaacgaaaaaaagcagaagcagaagcttccatcacgccatcatgataagctgtgaagctttctcatgagcgatgatgtattcatgctcacacctgacgaactacaagtccaattaagtcaactgatagcagcctcttttcacgtgtatatatataataaaacaataaaacaaataccattaatttctgaaccataaaggtactagtaatacactaatacctgatcaagtaaagaacactggtaaaaaaaaaacactagtagatttgtactgttgtacttacagcctcgatccagtgctggaatgccagcttccgagccttggcgtctcttgataaaccctgacccacctgcatcaaagctcagattttttacagcaatttcgacacaaacagaagattaatcaaggagatgcagaccagacaaaccaaaagaatgcctcctttttttcttaaccaaaagaatgccttctttttttcttgtggaattttgtggtaggctgcaggtagcagcaactgagaaacggaaggaagtaggagaccttggaagcaatgatgctgacacggctccagcgggaggcgacggtctccgggttagggtcgtggaaggagatggtgctgtagctcagccgcgcgtagtccagcgcttgccaccttcaaacaatccaacccacaaacttaatttctcggttaaaaaatttgattacttttagatttctattttctctacacaaattaaacagtttgaaactttgaatggatgcaggatgctcatgccataatctcaaagtccggaggctaagttccaaacagattattgagcaaatagttgtcaccgattatctacttgattattaagataaattagatatttttgatatataaacttaatagataacttaaaaacaatgagtaaaacgcataaaacggtccttaaatttgtagggttgtgacatctaggttcctaaactcacaaaatacagatttaggtctcagaacttgtcaaagtgtatcatttaggtcccaaatcgacacaatccctatatgatcctatgtggcgctgatgtggcatgccatatggacgtgacgtgtccttttcttcttttttcctaactttttcttctttttcttttttgttttcttctcattcttattttttcccctctcttctattcgggtcacagagaaaggagaaggaaacaaaagagaagatggagaaaaagataagaaaataagaaaaaagaaaaggtaaaatttgttcgtgtggcatgccacatcagtgccacgtaggatcctataggagctgtggcgatttgggacctagatgacacactatgacaagttccggaaattcgatatgcattttgagagtttagtgacctagatgacacatccctataagtttaaggaccgcctatacactttactctaaaaacaagtggtccaagtaatataggtaagtaatataaataatataaaatgcattattcaaagcgtagagtaaatattcacttcatcttaatttgatcatcccataaacgaagaccacgaaaaccaagaacaccaaaacatctaccattctaaaattaggtactccattgtttcgtgtccaacaaaaaaaattaattcactttaaatgttgcgcacatagtatttcaggatgtacatttactctttgcataaataaacaaaagaaacactttgttaattagatgatgattattttggaaaaacctaaaaaatcttaggtgataatccaataaataatctgaaaagaacaactaagtgcacaaagttcgacttaataacttaaaccgatgagcaaagatattccacatgaaggttggtgaagaatccggttaattaatcatcaccagagctcctcgacgacgacggctgtgtcggcgagcttgcgccgggtccggtagctccggtacatcttctgcagcttggtcgccgccccatcctcgccgccgccaccgccgccgcttccggccaccggagaggaaacctccgcgtcgagcctggaagagcccgcgtgatccagcccggccgccgccgtcgccaccgccattctcgtggtctaagaggaagacgcaatagtgcagcaaaatctaccactcccttcaccaaatggagacgacgatcgagagagaaacagaggcaatggcggtgctagctagccttgtcgagaggagagggaacgcgaggtatttaagcaaagagtttgtgtcgctgtatgtgacacgtgaaatggagaagaagaataaataaaatttgaggagaataattaaaagatgttttattctgttatatatatattctgttcgcgcgcaaaaaaaattccaagtagcctagcctacacgaagtcgaaaagtatcgtgctgaaagcctggaatgtgtgtaacggtattacagtgatgactcaacgactggctgcatgctcttactgttcaggcccacaatcccccaatggttactgcacaaacagtgaaacaatcgaacaaaatttaccaaaaatttaaaattttaaaaacttggttatgttactaatctcttatcgttacttcaccccaatggtaaacccgtcgacacttaaccgtgcggtaagggaaacttgtatgtgtgtgtatatatatttctgtaaaagagggtaaaaattttggctcgtagtattgatagagcagagtgaggaaaatccgttttcacttgcacataaatacacgatgagcccttttttttaaaaaaaaataaagaagttaatttggttcatatttatcctcagttgcctactatatatagtcccctttttttttaacaactatagctgtgattcgtaaatcgtcttcaattctgccttttaacatctcaactactccaaagtgctaccactaccatagttatatacaatacaatactccagtagaccagtacactgtaaaagctctattatatttttaggtcctgcagtcagcacagtgtttaaatcttttttcaaaaaatctattatattgttaaaggaatagaaaaatgagcctctactttcgctctcatggcctagaaattctcacattaatcggagaaaaagaaaaaacagagtccatatagaaatactccctccgtcccacaatataagagattttgggtttttacttgtaacgtttgaccactgtcttattcaaatttttttttgcaaatataaaaaatgaaaagttatgcttaaagtactgtagataataaagtaagtcacaaataaaataaataataatttcaaaaaattttgaataagacgagtcgtcaaatgttacaagcaaaaattcaaaatcccttatattataggacggagggagtacaatttagaaacagctgaaattcggaattaaaaaataaggaatattagaagagaagactagagtccatatagaaatacaattaggaaatagttgaaattcggaattaaaaataaagaatattagaagtagagtatatagtccatatagaaatacaattaggaaataactgaaattcggaattaaaaataaggaatattagaagtagagtatagagtccatatagaaatacaattaggaaataatagaaattcggaattaaaaatagggaatattagaagtagagtataaagtccatatagaaatacaattaggaaataatagagattcggaattaaaaataaggaatattagaagtagagtatagagtccatatagaaatttaaaactaactaaaattcggaataaacataataaaattaaaagtaaaagtagagtttagaattcgtataaaaatacaatttacaaataactaaaattcgaaattaaaaagaaacatgggtagaagagtctaaagttaatataaaaatacaatttagaaataggtgaaatcgaaattaaaaattaatgaatattgaaagatgagtttagagttcacatagaaatacaattagaaataataaaaattaagaattaaaaataaataatattggaagaagagcctagagtctatatagaaatacaatttacagataatggaaattcggaattaaaaaaaagaaatattgaaagacgagtctagagtccatataggaatataatttttaaaaaactaaaatttaatattaaaaataactaataactaaaacgtatataaaatacaatatgaatattacacattagtagttttgtaaagttagtacaaaatttaaaattatgttgttattttaatatatttgaataatacattgaaaaaatatatatgttattatatgagagaaaatataatgatgttagccgtgcagagtcaccatgctagttaaaataatatcaagcaccaaatccaagcaagagatgtaagttcatcagagacagggagctcttctgcgttggattgggtctctgagtcggatcgacggtgccaatgggccaagcaggccggcttgggcctgtaagctgagtggcaacagggaaacctttgctaattagattatgatcattttggaaaatctaaataattttaggtgatgattaaattggaatagtgataataattagttttgacaatctaataaataatctgaaaagaacaaataagagcacaaagtacataaatatgggcttattcctactacgactataatctacacttcgaaatacagagattttgcacaggcaacagggagaaaggaaattgtgaaaagagctcagattcaagagtcctctaaaacaaaagggatcagctaacaatcactggactccaaaattcaccttcttctgctgagacaagttcactgaattagattttccacaaaaataagatgggcattatattttggatgtgtgtaggagcaccatcggttacccaagtgatgattatatgccaaatgggttattagaaaaatcaatttatgggtaatttttttatgtgttcacttaaaaaaacataaaaaaaaagaaactacgttcgaaataccttaaaatcaaatctaaaatttagttttaaaattcaatttttagcagcgacgtgttgttcatgaatgggttgcaggaatgatctggggggcattggtagattgaaagtgggatggcaatcacatgttcatacgataagagtaatgtgcaacgaatgagcggaagatacgcgagggagacttgagctgaaggaggagaatggtctgtggtgacaaaggagattgagcgatggagatggggtgggttatacttgaggatacatttggtgttaaaagatgatgggcttcactggcatttgctaggtgaggatggtggtgtagtggggtaggattgctgattagcgcgtctgtgtcacgatcttacacttctagctcataagacgcatgttccgccctttcctttttcctttcattttagttgaaggttttgcaaatagaagttttttaacaaattttgctacaggatactacgattttgtggttttagccataagacactgcccgaactcacttttagggaagacacttcataaacgtgataatttaccgatggacaccgcgccgattagaataatattttccggttgaggaggagagagaaatcgcgtgaaatgtcaaaaatacccttaggtccagtcagctcttctatcttttctctctcccccctccttcgtctgatgcgcggcggcggaggacgagaccgacgctgcgatggatgtcgagcccgactccacccgcgtcgcggtggcgccacgaccacctgccggtgcgcgtactccagcaccagctccgtattcccggcgcccggcttctacttccgcgtcaccaagagcgagcatctccctcagctcgaggagaagctcaagaggatctgtaagcacgcacgcacatcgaccgtatacgttttgccatttcaaccttttttttttgccatcctattcttattaggaacgtaataacacaactaaagcatgattttcgtggacccatggcattcttttccgtccatgaacgccggctcgccgccgaacacctctacctcgaccagatgcatcggtctcttcccgaacaggtcggcctcaagatcgagcagctcgctctccctcccgacgaagccctcgttgcgggtgaagggaagctccgggcgcaccgccaccgccgcgtgccatgatcggacggcgtccgccaccgcgtgccgcccaagcctcgactcaacgatcttgaggagatcgatcaagcggtgcctctggctcgcagcgtccacctccacggccgattccgcacgggacagcgcgcccacggcctccctccagtcccacttgccgccgtcgtacacctttcacaggtggccgccgaacctcctctacagatcgccatacttctccacgatgtcctccgcgcggcagtcgcccttcccgagcccgacgaacaacggcatctggtcgcgtggaacgggctgctcgtggaacgcccgcacggcggcgacggcggaggcgacggtgccgtgctcgcgggacgtcgtggttggtgacatgaaagaagcagcacgagcgtgcggcggcgcggacgagcgggacggtggccgagcgcgggagggagagctcaacggtcgggaaggagatggccaggctgccgtcgtcgggcagagagagagagagagaggattggagagaggggagagagtgagacgagcgacggaggaagaagatgacgtggagggggatgaggagctgacagccgggcccgggtgacagatgggccctagtgcaagggcatttcggtcactccgcgtaaaatattaggccccctagcgcctcgtcagcacggatttattattttaaaaggcgcggtgtccgctggcaaattgccacagttatagagtgtctttccccaaaactgagtttgtgcggtgtcctacagctaaaacaacgaaatgacgatatactgtagcaaaatttgccaagttttttagattgaagttttaaaatgtatgtttttaaagaaaagaaattgtgcactcaaacatagctgcgctaaatagcaatctcggagagagtttgttcgaagccagcccagtccaaccaatccatcacaggcggcctggtcctccattttgtctcaaaacctgaaaaaaaaactggccgactcgaaatatgcctagggttggcctgtctttggacctgaatgtttctttttgttaggctcgggtcggcaaatttttgctggagcctagggcctgtttagtttccctagcaagttttttcaccctgtcacatcgaatgtttagacacatgcatgaatcattaaatatagataaaataaaaactaattacatagattgcgtgtaaatcacaagacgaatcttttaagtctaattgctccatgattttgacaatgtggtactacagtaaatatttgctaatgatggattaattaggtttaataaattcatctcacagcttacaagcggattctataatttgttttgttattagactacatttaatactttaaatatgtgtccaaatatccaatgtgacacggcaataatttttacccctgaatctaaacacagccctagttacaggatgaatttgacgtgggagttgtgtgggattatctatatcatcgatctgcaatcctatggcctctaattgagtaacctctcaaacttctttcagaacgtcaccttgtgaaagtatttaaaaaatgctcaaattaatatgttcattgcgtagctaaggctttagtttgctctgggctggccgacatgcggctcacgcacatatgttcagtacgtcatagagaataaaaattactttaaaaattactttactggtcaagatccttgtgtagtagtagtagtatgtttagtagtaagtcctaaaatatacagttcaactgcaagctcatcacagatcagttacagcaattgtcaacgctactccatcccctgcatccttttcgatcttcgcaagcaaacagctaacatctgaggatcatgcatccgtttgaccttaatttgagcgaattattctttttcaatccgagttttgttacagactagaataaactcattggatatatttgaagaaattctgaccattggttgaaatggtctgtaaattgcgaacagttattataactgaacgtagaaaaatgataattaaaacaaaaatatgtgatgatagggcatgaatttgccaatagaagtgttggtttatttctacgcccgatattagtaggataatattatacaagagtagctagctagccacgggatcttatactttgtggaaatgtacttaatcacagccggtgactgacacgttgggtcgcttcattccatagttaggctgctaaagcacatgtatctttccttgacggattggttacacactaaacgtggaattaactagtaattaggcatgcaacgacaaaattagccaatacaatgtcctgcgatcctgacctgtaaaaacgctgttgtaccagctgacctaattatcgatcgatcgatcgagctgacccggaaatcctgcgatgacacttcgaataagtggaaagggttgcatgcatgtataagcaaaaataattttgccgctgcaagcatacatgcaaagctattacatagtcatattttatcttgacacatagaccaaggataattaattctacttatcacccatttaaacatgctactagtaattcctcgtaaacaagcgattcattaatatttacatttctcgatgcccatgtagctaatcttgtgtggaagaatggaaagtcatgcattaaattcgagaaagtcattaagaagatagattattggattgaaatatgcctatcaaaaatagaattttcagatttagaaatatgactatcaaaatagatggagggagtattaagctaatcacgtgctgggaaagcatggtatattgcatgtggacatgtacaaccttggaagcaagcaactccatcgatcgcctataaattccatcgcaaccatgcatgcaatcacaccagcaactaaacacatcactagctacttaattagcagcagctacaatctgagtgtaattaacagtgtcgtgatggcgcctaggctgagcgccgttgcattggcggcgttcctgctgctcgccgtcgtcgtcgccgccgccgcccagcctaagcctaagccggccggaaaaggcggcaagccggagaagggagagacgccagggaaaggtaagccggaggagagggagacgccgccggggaaaggtaagccggaggagaaagagaagccggagaagaagaagataaaggtgaagtgccaggagagccgtaagctctacccctactgctccgccaagatgatggagtgccccgacacgtgtcccacctcttgcttcgtcgattgcgacgcctgcaagcccgtttgcggtgaacagccgccgctaccattgttaccaatcgggattaatctttagttctaagtatttaaattagagataaagatatcttagattcttagattcgtatttctggttgaaaaaccgggattacacaggaggttaccaactggaagtacgaagcatttctccgcagtggttgcacctccatcttgtctctgacgtatactctctgttgttgtgcagtgtgcaacgtgccgggggcgtgcggcgacccgaggttcatcggcggcgacggcaacgccttctacttccatggccggagggacgccgacttctgcgtcgtctccgaccgcgacctccacatcaacgcgcacttcatcggcaagcgcggcgccgacggcatgtcgcgcgacttcacctggatccaggccattgccgtcctcttcgacgacggcggcgcccaccgcctctacgtcggcgccaggaagaccgccgcctgggacgacgacgtcgaccgcctcgaggtcatcgtcgacggcgagccggtgctcctcccggaggacgccggcgccacctggacctccgccgccgtgccggcgctgaccgtgacgcgcaccaaggcggcgaacggcgtgctcgtggcgctcgacgggcggttcaagttgagggccaacgccgtgcccatcaccgccgaggactcgagggtgcaccggtacggcgtcaccggcgacgactgcctcgcccacctcgacctggcgttcaagttcgacgcgctcaccggcgacgtgcacggcgtcgtcggtcagacgtaccgctccgactacgtcaacaagttcgacgtcagggcgtccatgcccacgctggggggcgaccacagcttcgccacctccggcctgttcgccgccgactgcgccgtgtcgcgcttcggacatggcggccgcgccgccgccgtcgccatggccgcgtagctcgctgcactgcgtataccgacttaaatcatcatgcctccttgagtctgatgctatgatgggtatgagtgttaattgttctgttcattggccatggctgcacgcctgcactgcatgatcgtcaaagtgcgaagtaataatcttgtgttcgtgttgattagttgatgtgttgatattcgcatcagctgcactgtagtattgaactctgcaaagaaataaatttcatgatttttcgtaaatatttgggtatgttcagaaatggatgcatggtaaaccaattcagaatgatgttaagaatacaccgtaacactttgtcattgcttcgaaagagtgatcgatactggctcaaagcaaacaaaatacggtttttcaactttacaaagttatttttcgtacaaatcattgagtagaaactatagtctaattcagtcttgtatctacggtacaaggatttgcagacatgtctagagtttaatggcacttccattttcaagtgatctgaagacactatcatcgtgtctttatagaaaaatgtaatcttttttccacataaaagcaacagcacacttggtgattactaagaagacaataattagtagtagcaaccactcaatgcaacagaaaatggcctttggtataaacgtactaaaataatactagaatcgatgttacttgcagttacagaataaggctctgcttttatagcatttccctttttgtaatatacgaaaagagacttgcagaacgaacataacaggcaagacataataattctgttttgctaacctttgggttatggcaaaaaggtgtaatcacctgaaaccaatgcgtcaggattcatgtaaattcaaaaaaaaaagaaacttagcaaaaaaaaaactttattctgaacaaccaaaattcagcagcaagcattactcatgcatcagcttgcaaagggtgcgggtcacattcactttgatgcctaggcctgccccaatgctttcccaaacgcaaaagccagaaatccccaaatgaaggaaaacataagaaaggaaaacgagagcacctcagactacatattccccaatgcttttcttcactggtaacctcatagtgcaaggatgagtacggatgtaacatcactggtgctctcggactcaagaaaatgaaaacagaacattgggtcatcgggttaatcttcagtggcacaatcaacccagggacatttaaatccacaaacaacgcaataatctaactgaggagggaacagagcatctcagacaaaatattcccccaatagtttcttcaccggttgactcatagtgcaaggatgagttaagatggatgtaacatcaccgatgctctcggaaaataaaaccagaacatggaggaatcagctgccaaatgcctcatcagctacaatctacgtgactctgaacagggccttagtacaacacaacggcataaccattcatgtgccctgtattagcagtccacggtagcaaaacagcctaatattttactgtctagttataacagaaatgtagtggctaatcctacatagatatgcttgacacattacagctaacggcggtaacagcatcagtcgcctgagtccttacagatagtagaagaaccatccattctagctggcatcttcagttacaaatcaggtattatacatgaaaatggtgcatcgggttcaaatgcattcagagaagaaaagacaacttcaatgcttcaacttatacaccaaagaaacatcagcagcattacttatgtaatgcagccaactgatcaaacaagactaaacttaaaattattctgtgatctttttcatgaatcttgtatgagcactgagcagcagaatattcctcatacacaaccacaagcccaatatttttctaagactaacagaaatagaatggtcaattggtcatttctgcatagatgcttgaagcattacaactactggccataacagcatgagtcctcactgatagaagaactggagctggtcgattctagctgcctaaatggtgacgcattgccacaacaggaggcatgattacaacaaaaaatgagaccattcagcatgagatttgaacgttcactaaagcatgagcaataaaacatgtcatgagttcagttcttgatctatcaaaatccaaggcatcagactagatccacat

SEQ ID NO: 25024 - DNA, 21810 bp, Oryza sativa
gcctgcaggtcgactctagaggatccccagaggaaagggatatatctccccgagcctaatcgatctcctggagcgaggccccggcggcgccggcggcggcaacgtcctcggcggtgaacttgcccttggccttgtcggcggcgcgaccgctggccttgcggtcgaggatggccttgcggtccttgtcgagcttgagtttggtgacgacgaccttggatgggtggatcccgacgttgacggtggacccgttcaccttctccctggtgatgcgctcgacatggatcacccaccggcggcggtagacctgcaccaccttgccctcgcggcccttgtagctccccctcaccacctgcacctcgtcgtccttgcggacggggatggagcggacgttgtacttgtggcggagctcggtggagagcgcggcggacatgaggacgcggcggacggacgacggcgccgtgaagtgcgccttccggcacttgcgccgggagctcgtcacgcgcggattgcgcttcatggcggcggcggcggaggaggaggtggtggagctagggttttcggaggaaggggatgagtgggtggcgcgggtggaagagagggtatatagcggattctgatcgggaatggacggccaggatgagttggagttggacggaatggggtaattgggccgaggtcttttctggttttgtgagctttgggccatagataagatatgttaagtgggctagtcttggatgggccggacgtgctgatctagcagggaaaggcccctctgttggaatccagcccattctgttcgttcgttggcagcagagaagtttgaaatgagttttctttttttttttggaaggaactcaactaaatcctgttaaaattctacagaaattgttgctttcgaaaggagctcaaggtactaattctaatccaaaatgtccatgttgcaaggcttcaataataaatagtcaaccacggtacaatcaggttgacaaatgaatatgaccggtcggaaattctggtcatcgaacttgtgtcaagctggtacaaattgagaaaccgctaggcaaaggggccaagttaaataatatataaaactaaaatccacttaattaggaacggttttcatcagtgaccaaattatttttgcaaaccatgatttgcatacaatgcatgttatgagatcacctctgtgccaactgtaaccagaaatttggacatgcatcgccatattctatccttacatctcaacatcgtcaacccacacaacacaatacaactgtctcttctcaagcatagtattgactcgccgtccagtccagctggatttcgctcgtcgttatcttgctcatcccgcgacgagtagcgagctgagcatcggcggcgatggagtggatgccggatgggcagccagctccggtgggtcgccgtcgagctgtagccgtacgcgacggctgcatgcgaagtcgacgacacgaagaaagagaaagagagatagtgatcgatcgagcgtgcgtgcgtgtggcgcacacgaagtacgtggggggaaaaaatagcccgcttcgcggcatcgaccgatcgctaccaacaggtgcggatctgctgaggtaagttctcatgtttttttatatctatattaatattttaataagactgataattaaacggtagcgtaaaactgaaaggtcgatagcataattaacttttaaattttacttttggaatacggacaccatgttgcatatgagccggggaggatgagatatacttttgttcttgtataagaagttttgaatttggtcaaagtcaaactgttttaattttgactaagtttatacataaatatagtaatatttataatactaaattagtgtcatcaaatcaataattagatatattttcataataaatttgttttgggttaaaaatgttactacttttttttataaatttggttaaacttaaagcaatttgactttgacaaaagtcaaaacgtcttataacctgaaaaggagggagtacttcacacgaatccttatcttagaaaattcgaaggcaaattacattactattaaagccgccatttcagactgaaactgctccatacatgggcatttttagttgctgtagtataggttacagtgcttcatcacggctatctgtttccacagtctatgcgcagattcttggctactcaattttcatgaacacctacctgactgactctgcagaactcatgtatttgtcttcatctccaattcgtcagctctaatgcttgacatttaaagtgatgctgaattttggaactgttctgaagtgatttagtagcttcactatctctttcctgaagtgattcagctggatggtaaactgatgtatatatgcctgaaacgtgctaaaaaaactaataccgctaaactatcaaatcgactggttttgattgttccacagaatgtcaaagaaaatgaaagcctctttgatcacctggcactttggctgcattggcatatgtgtgctagctttgccataactctggttagctgccccaaagttcttatccatttcgtgcacagaagtatgacaagaaaggatttagcccatgtttttcatctccttttttctgaactattacggtcatggagttggatacgttcacaactcctcaattgagcctcattgcatatgcatgcagccatccgtttcaaattgtggctagaaaatttcctttaactgagcatgtccacctcaagattgaagtggtggcctgaatgcgaagcaaaaggagacactaacacggcctccatttctcttctcggtgccgtccaaatgagcagtatgacactttgttcctatcatctagccacttactttcttcgtaaggccaagatttattctatcttaaaaaaaacttactttttatatatcatctaccacctccgtttcaaaaaaaaaaaaaactcaatcctagctagggttcatagctatgtctatattcgtagctaaggtgttatcttttttttaagaacatagtagtagctactagtctctccgggcataaatacatgctgttcatgttttggatattgaccatttgaccccacttataaaatacaactataaccaccagtttctattattacatatttattcaccccaacaaattatatgttattttttttctaatggtagtacttttgagagaaatctgatctataatttcaaatatatcccaattaaatactaaaaacatggtagctattgtctagaaggagaactacgtatcatgcatgctttttaaaaaacaaataacatcggatagtgccaaaaaaatgatatagtaggaaaaaaatgacaagactaccgtcctatgagactagaattagaaaaagacaaaaccaccatcacacaccaacaatgcttttagtttacgaaaagaaaatttttaggtgtcacattagatgtttgactgaatgttggaagagttttttggacacgaatgaaaaaactaatttcataactcgcatagaaaccgtgagacgaattttttgagcccaattaagctatcattagcacatgtgggttactgtagcatttatgactaatcatggactaattaggctcaaaggattcatcttgtgattttcatacaaactgtacaattagtttttatttttatctatatttaatgcttcatgcatgtgtccaaagattcaagccttacacacacaaaaactatcaccacacctaccatcactatgcaagatcgaacaccgccagacctacaaacatatcatgcatgctgagcacaaagccaaattaatgcataaccaacaatagctgaatagagtagcccaggagtggaactaaggttgtcaggatcaggatactaagtagtatcgttttgctcaaagtaatatcgtatcgtaggatcgtatcgtagtatcgggatactatgatatttttttaagtttaattaatatctatattaattatatatagccattctatataaaataaatgtagtaatgatatatgtcatgcaaatagaaacatttatcaagagaaaccacgctggttttgatatatttaactgatttttatataaaattgagcatatttatttacattatttccaaaccatgttatttaaaataatattttgtaggatcgtagggatcgtaggatcgagatatcacctaagattttgtaggatcgtatagtaataaatagtagaatcaagatactatgaaaattaagatactagatgggatcggtatcgtttcggcttgataggatcgtagtatactaagatactaggatatgaatcaggatactgacagagtggaacacaagagctacaagaatccaagtccttgtgtagtgttcagtgtcaggctgtcagcttgacaaagaatgtaatggccgatgcgcttaacaagcacacgactagagataaaatcatcggagcatgtgtctaccgatcattggctgatctgttcttgggctatgtaaattaactttgctaataaaaatacagaaatgtaattgggtgatcctggataagacgctgcaattgaccgaccacatcactcatgatttagtcattctatagggatctacccctgctagtgttttagtcaaccatctacacgcctatttctattgcaatttacgcccaattcgagttgccagtagttagttattcttgtaaatcgtttgcatcttcctccattggcatcttggcacatgcaagaggtagatatatagtatatataacaacagaaatatccactcatcgttttgcaggccaggacgtctctgcattatgaaaacaacagcagccctatctcggtttgatgagaaagacgcattgtttgagtgaaatttgcagtaattaatcgacaatgtttgggaatcgcaaaacaaatcttgaggagcccttcaaaaccacggctgcctttgtctgaaaggaattgtgaacgagctgttcagtcatctctagcagaggagcccttttcatcttatataagctgctggcaaaatttaaattttaaaaattaattttaaagttagtttttttcattgtaatttattttttagcatttatttttaaaccgttaagatatataaaacttttatccataacctttttctcactgataagccgttcagctataggggaaacaaacaatttcttgctcaggttcagtctgttcagtagtatctttttcttcatgtgagtatgtgattggacacaaaaggagagagaagcatgagcaactatccagttctttttatcaggaacagataccaaataagtactatcatatttggacttgttctgaaaccactagtgaattccttatccatatttgtgtggattcttggcagcatttgtggcccaaccaaatttcttgtggatccttgtcgtactagcgatgacaagacgctgatcacgcatcgcacgttgcgattaatgagttgtgcattatggcattatgcatcgactaggatcagaatcagggtcaagataatactgacgtgctgtctgcatcatgtttcaattattacatccatgattcattatgtcggaattaagtacagtaatgtacttctagtaatggagatattaggtttttatgcaggtgacaaattgtgagtgacgcggtctttttaaagataatggaattcgttctgtccttttgcttcaaagatgctataaccaattattgcagcgaatgcaggacaaacagctgtgtattataaaattacagtttgattaaaaacaagattcctacttagtacaccacaataaacataaacatagacatttccatctctggttgtatgtaatccctgtcttcttcaaaccaaagaaaagcagaatgtctgaaatcagcgatcggtctttgttgatcgaatttcgctcccatcgccgtcggtgaccgacgtccaaaacggaagataacgtcaaagagtgacgtattttttttaggataaatgaagcattttactaaactcaaatgagtattcccggtctttgcgtgagcaacacagttgataaagattaaagaacaattgtcaaaatatgaacagactgtccccaaatgtattttcaaggtagatgatcaatgccagcaaaagttctccctagaatttatagatgaactagtaatcggtgaacctggctatatatattgtttggggatcatggatagctgaaaatgacgctggaaaagaggggcgatggaaatgcagctttcgatgaggatagcataggatacatcagaaacggcatatatcatctttgatcctttggaattggacactgtctatttcatcacgttcaaggtctttcctttgcttctccaccagaatcactaactgaattcttctttcgtgttgcgactgttcttcaaccgggaaaggagaaaagataagataaagttacaaaagtgcaagttctgaagttcacaacagcgcaaaaatcacagacggcggcatccttggtgtcgtttccttcttggagacgtcgtcttgaagatttcctgtttcgctcttgcagcgtttgtggttgtaggtgcgtggtgtggttgttttttcctttctgggctatagtcttccagggctataacttgtatttttctcctgctttatcaatacatgaaactcgcactgtcttgtgcggttcgtttaaaaaaaaacaatcgtctgatgagcactgtcaaacattgcatttcttcagactcagagatggagacaaatacaggaaatgtaggaatctgtctttttcactatcttcatctcttctatcaataccatgagacatgagcaaaatcatggtactccagtaagaagataggttcccagttgcttctggtgtagtacagttaaccaacacagttctcctcctccccccacccaccttaaaaaaacaattccacctaaaaaccagtgtttcggcgcgaaaaatcaacccgaaaaaatggttagaaaaaaactaaacccaataatttcaatcccattccaacgcaggagcatggcagtagttggcaatactgggattctgggaattgttgtgagtttatgcctgtattctgcaatgactctccgtgcgaaagcatgagacttgagtcaatgacactgataatttgggaatgcccaggtcaacagattatgccaataaaagtgatattggttgagtatacctgaaattgaggcttattaactgcagtaattgcactggtctgcacattttcagaaattttccacattttgatatgcattgaaggcaaaccttcatattactgctgcaaattaaatgtggtacattggataccttcattctatatttagttccgacgaatatcttctgtaatagtaatgcttacaaggaaatgtgattttgcaggaaaattaacctaagctggtctaaccagaagtaaaaacagggaagggaacctgcaaactgacagtattagttgtaaaaaatactttgtttttagatgaaaagaaacaaaatttgtattacttcctccgtttcatattataagactttctagcattgcccacattcatatatgtgttaatgaatcttgacatatgtgtgcctagattttttaacatctatatgaatgtgggcaaccctagaaagtcttataacctgaaacggaggtagtgctagtcaataacagtatcagtgatgtgtcattgtactggaacaacaatgtgccaaatcagatgcaacaaagcctgtccgacggaatatctttcagatattatggtgttttcatattagtgacaacaacataccatctactccagttacccaattttgtatgttttttcttttgttttcgattacccgatttgtgatttcaactaacaatgtccaattgcagaatgatcaccatacgaggaaaccatgacgaacacgaatcaatatctgaattttctgttttgtctcattagaaacccaaatttccctactaattaatttctcctatttttctatgtacaagcctgtaataacttgtttcagtttgttgttgcagtagaagtgaagtctcctagctgtctaagtgtgaacgcggcgcctgactctcacttggagcccgccactgatcgacgcggtgagccccggcacgaaccgtggcgcggcggcggcgccgccgctccggccattctcgccgacgacctcgacgtcgaacgccctcacgacggcgacgctggccgccttcatctcggtgacggcgagctccttgccgaggcacacgcgttggccggcctggaacaccgggtatttgtacgggttcgccgggacgaacgacgcgccggggccggtgagccaccgcgccggccggaacgcggcgtagtcggcgccccagatgtgcggcatccgccccatggcgtaggggtggtacatgacgcgcgcgtcgccgccgacgtaggtgccgtcggggagcacgtcggcggcggcgcagaacttggagtcgaactgcaccggcgggaacagccgcatgttctcgtgcagcacggcgtgggtgtagtggaggcccttgaggtgctcgtaggtgatggcggcgcccgtctcgccgccgtcgccggcctccgcctccgcgcgcatggcggcggcgacttcggggttcttggacaggagcatgaacagcgtggtgagcgcggtggacaccgtgtcccgcccggcgaggaggaagctgacgacgatgtcgcggaggaacttgtcgtccgcggcggcgtcgtcgacgccggtggaggccatgaaccgcgacaggaggtcgtggctgctgccgacgcccagcttctggcgctcccggatcatcgccgccgcgagctcgtcgacgaccttgatggccttcctgagctccctctccgacccgacgttgaggaaccgcttcgccctccacagcaacggcgacgccgctgcgccacgcatggcggagaggcgcgacgcggcgtcgaacgcgtcggcgagctcggacacgggcatttcccggtcgaggcagccggggtcgaggccgaaggagatcttgcagatgttgtcgaaggcgaagcggcggaacacgtcctgcagatcgagcacggcgccccggtcggcggcgtcggcgagcaccggcatgaggcgggcctccacctcctgggcgatgatcttgtaggcgtaggagcgcacggcgacgctgccgagctcgaggctggccatcttccgctggtggcgccacgcgtggccgtcgacgttgaagatgccgtcgccgaggaggtcgccgaggagcgcggcgaagggcctccccttggggaagttgtcgaaccgcgtcctgagcatgtgctcgacgttcgccgggttcgccgtgacggtgcagccgaggacgtggacgtggacggttcccgtcggcgagcggcggagcaggtgcgcgtaccagtcgccgaggttggtgaactccctcgcccacgaccccgtcaggtaggcgcggcacacatggcagctgcaccacggccaccgcctcgccaccaggagcacgacgccgagcgccgccaggcacaccgagaacgcgaagaaggcgagccccgcgcaccgcgcgccccacggcaattccatctccatggacacggtggtggtggcatccatggcgagaggaggagaagaagaagagggagagagggagatgtgtgagcttgggtggggaggagtcaaggaggaggcgatggctatatataatgcgtgtggacgaggaaggcgcacatgggacacgtgcgctaaacatttaacaacgttttcccggcagcctagctttgcctctctatatttcttttattgtgtgttttgttttttctattttttgcgcgtacacagctatgtcccagcgatttttgcatgctgagctgggtccaaagtgtgtgctaaaaaatcagagtacaacttatagctgctaaatattgcttccgagctggtttttgggatgaaacatgctattgttgtgagatcaatggttaacagatgatacttcaacctcgttaactttcctttactttgttggtgcttttctttttctcgaaactgggtaaattatattaaggaatagaagaggaaaatttttttttccacatcttaaaacatagctagagcctagagatgcgagcaaatgagcctaaccataatgtttggctatctccggcatgtggaatggacaaatattgccaactaccatgcatctttgttccttcattactcgatccctttattttaaaatataaaaatctaagatcatattaaacattttatagtattacgaatcttgacagacaatataatcagattcgtagtactataaaatatctaatctggtactagttttttatattttgggatgaagcaatacctccgaaaaagttggcaacccagtcgactctaaagccaatgccatcgatttgattgtcaacaaccatcagacaattattaacgcaaattataagcgcaacactatattaatatatgaattgatatgaatgcaccttccaaattacttgtcttccctatatcagtacacgttgatagtgactacaatatactactccctccatccaaaataagttctttttcatccatcatatacataccaatataaaatataaaaaaaagagctaaaaatactctcactttatcaaatcgcaatgcaattgtttctctctttaactactccgatgtatatatatatatatatatatatatatatatatattctatttttacaaatcccaatgcaataattgcttaaaaataaatttattttgggacgaactgaagaagccaaatataaacttattttggaacagaagttctatataaatggtacaaattcaccatcattaactttcttccctcgattagcacaaactaataggggataaactacattaatgcaaatagccaaattgcaaaattggtacaaatttatagtggctacaatatttattataaatgggtacaaatgtgtcctttttaactttaattcctctatttgcccaaaataatattgtgattaaactatattaatacaaattcaccctccttaaccttccttccttttattagcacaaatcaataatggctacaatatttaatataaatggatacaaaacgtcctcttttaactttccttccctttattagcacaaaacaatagtgattataatatttaataatgtaaatagtataaattcagcctcttttgtcgacgagtgatactcgtagaccggatgattaggatattatggtacgttggaacgaggatctacgtaatacgacatcaagcaaacagaagacaaggattatactggttcaagccccttatcaagtaatagccctactccagtttatatgggattgatgatggaaaaccacagattacaaaggaagtagacgaactcgatgataccgacaagatcgtagtcgatgtactcgcaagattttccgacgacttggctccgcgtactctggcttcgtaaactatggtgggtgtgttggcgatgagattcgatgctttacacccctccctagggatcccttttataccgtggactatcttgaccccaagtaagacctagagacattggatcttgcatggtacaacagaaactctatcccttccaagtaggactttggaaatcgcttgactcgaggagatatctttcataatttgtaacagattccaatagcgtttatggggataattcgtatacgtgaaagtatgtcatatccgtatattctatagattgtaggataggaggtataccttatccataaccctgacatctttaactttacttccctcaaattaatagtggataaactatattaatacacattctcttctaccttcatttttatatttcaaaatactttacaacattatattctttagtacaagaatggcgcgcgcacacatcaccatactcaccatgagtgtgccttctaacatacccatgttcctgttacataggagcaacacgtatgtgactttaaaataatttttctttgcttccattacaattcagaacacacttttatacacattatttactttgaaatatataactttcaatgtttttttgaagatctacataaagtaaaaaaaaaatctggttatctagctaattcatatagcaggcatgagcatgcctttagtgtggatttcagttttgttcccaatagatattagtgctgctgcgaaggatgtggaggctatggcttgcaaagaagggttgaagctggcggcggagtatattagggtccatttgaacctatgggttcggaatccatccgtcctaatacacaaaacggaataatgaattagcacataatcaattaagtattagttaaaaaaatcaaaaaatagattaacataatttttaatgcaacttttctatagattttttttaaaaaaagtaacactgtttaccagtgtgagaaaagagttctcgaagaaaaagggagtagaagttgaaaaaggggagcatatgtagaacaccagcatcccagtagtcagctcgattgctcctcggttgccgacttgttactatcgaggatgggcaacatatcaagctgagctccctcatcccagagacaaagggcctcacatgggtcttcttcctgatatgcaggcgtgccataaggtagctgatgaacttgctaactttgctaaacatttggtacatctcactccgcccgtgtggcgagaggatgcaccatccaacgtgtattatttaattaagcagcttcgtcttttgtaagattgtaatcgatcataacttaatgtatgctctcttttctaaaaaaaattaatgatatttcttttctatatttagtgtctttagaaaatatttttttatatatgttgttcgtgtgaatgctcggacatatatgcatcaatcccttactcaggtggtgtttggatccagagactaaattttagtgcttgtcatatcaaatattaatttggcactaattagaagtattaaacgtagactaataataaaactaattaattgtataaataagagctaatttgcgagataaatttttaagcctaattaatccataattagcatatgtttactgtagcatcacatactagtcaaggattataaaataagtttttatcattaatctacgtttaatacttttatttaatgtcaaacatccgatccgatatgataagaactcaaatttagtccccgattagccatcgatcggctaccttttctcgtcgatcatcgacgacgacgacgacgccgtacgtacgcgtggtcctcctggtccagggcggcagaaaattccgttccgtttcgctgttttcttggccgccgtacgtaccaggcaaaatgacagcaggatgttgttgtatttgtacgatagccaaccacgcatccataacacacggtttttctttatccggccggccatccatccatggctccatctttgccggtggtccgtccggccgcgccacgatcgacagtatgcatcgcctagctacttgctaccccctccaaaaaaaaaaaaatccccggtcacaggcaactcgcgcacacgtatgcctgacgacaagtccttttgttttaagataatagatagtttagacttaaatgcaacgacatgatatgaatacatgagaaaatccagacaacatctagtttactatgggaaaacattttttaaagccttttcgtttagggaggctcatatttttcttccttctccagcctcctactcttaggacatccacaatgtggtgtaaaagtagtccataagcaatagaatattccattcagccacctattaacattgtgcaactagtctatatagaaaaaataacaaaagatatccatatgcatatggactacccatatggaataaattatattatctatctctactcatctctcttctcctaatgataccttgtatctatacattatggacattgccatagggataaactatttatgtgggtcccatctatatggatcactttgtcatatacattggtgatgcccttattacctcttctctcttcccttctctccatagagatctaatgtaggtgccgctcctgctttcattagagacagttgttcctgccttaattctctccaaatctattttagccgtccgtaaaaaatatttttctgaagatgtatgtttgtatatatttttataaagaatttatagagaaaaaccattaattagcagctacgtactagatggtacggaattaaaaccgacgaatggaaaacgaaattgattgataaagagatgtcagatgtgaacgtttgccactgaatttggctcaaatttcttggttgcaagttgcaactggcatgtactacccctgctcccaatctaccaataaaactgagttcttttttcaactcaaaagcacaaacttttttatgttagcacgcttctcgaatggtacattccgtaaaaaaaatctatataaatgtttttaaaataataaaaatattttttaaatttataatagctaatatttaattaatcatgtacaaatgtttttctcattttccattgcgcgaaaaagcctccacaaactgacttctcgaatgggccctaagtacatctgtcacaagccgggtactgcagatgtgtccctttgatagtgagcgtgagaaacggactcgtgtggttacatgcatgttgcatatgctgttatttcatcttgtcgactcgatcgatcgacatatataagcatgtgcacttctcaccattattgattcatcacgcacatgcatgtgaaatttcttctctagatagcaacaatattttcatgcatgccaacaaacattaataatattacactcaacgccaacggggactactacgtgtaaacatttagaccaaaaacaccacatatatatgtatatatatcactttcttcaattattattgaggaaataaaacattacaacagcacatgtgggaatggtctatggttagtaaggactgaaaggaatgctcagtttcggtactgtactgtctttccgtcttgtgatagttacggccaccacattgtgtttaaatttgactactactgttgatccatcctcatgcctgtatggtgcaataatcgccatccattttcaaatataattatttcaataatttaaattatatatattatataagcatttatgttaaataatgtgatatgaatatttcagcttactatatattcggattaattatagtttcaataggactcaaagtttttcctactagaaatacgggaagggtgagatgatgatttattccctagcttgcattataattaattcctcaatactgataattgccagtttgtgcctgtagttttttctcgtaaagattttccacgtaaaaattcgtagctctattatgcatctatttgaacaaagcatttcttggatttgcctaacatagccacatgttgtgcacatttattgactgaaaggaaatcttgcttccttatgttcaatatttactaaacaatctagaaatgtctattttaggaacgaagggagtagaaatttttctctacttctttgtatattgttatctatccggcctattggcgtcatcaaattagttcatcaaaatgacaagactacaacaaaaacaccatacctgctcctagtcttactgctaggcgagttctaaatagttaaaatgaaggtatgggctattcgtgccaagtttctaaagttaccttttgtgctgttcatttaaaaaaataaatgaataaagttatctctaaaaacttcctacatcaacattacttacataacgtttttcaagctatcaattagttctacaatatttaatctattcatacgatcatttttttctgtccatatcaatcattaagctagatcacgccctaaattctataaacaataacaaatatatcatccttccctttttctaatcaatcccagatgagacagagattaaatagctagttgatagcctagttgcgtgattacctccatcatcaccatcattagcctggattcggtccttgcatcagcatatatacatacaaaaattttcatggatgcatgtggacacttgtaccatatcaatctatcattgcatcagcatatatacatacaaaatttttcatggattgttgcacacatatattgcatacgtacaccaacaagtcacattcctgttggttggaggctactccaaaccatgggcttggaaacgggagagatctcataagcacaatggtttcactgtcgttcgacaccgttggcattattgtttttttgcagagatcaccggaagaacaaaaccgccacatggattgttgcaatccaatgtgcaggatcatatcccctttatccagtagggctagctatttatgttcaactggacactagagacatcttttgtgattatttggcatatgactaggtaaagttccttgtcttttttgtgagactctttccaacaactcatggcatgggcacatacatggtacactcactcgtttcttgtttctcggaccttagctagacgtcactcgacgagagaaaacaagtgacaatggctgttctaagttaaatttattgaagtttgatcagtttatatatagaagaatgttgtaacatatcttcaacacaaaacaaatatacttaaaaaattatgcaacgatagattaatgaattatatttggagctacatatgttgctatatttttctataaattttgatcaaacttcaaaaaaaaatacttatgataaacttaaaaatcttatatcacctgtttggggaagcttttgatagctgtaacttcctctaaaattaaaagctcatccaaacaatataggtttttttttcagattctaaaatgttatagttgtaggattatgaaaataaattagaaacctgaaactgattttttttcttcttcaaattcttactaacaggattcccatcaattgtttcttcgaatctaaagctctccaaatacacctataatatagaacagagggagtagctcacaaagcatattccagttgttgttgagacttgagatcatgtgagatactagctagctatgtcgtctctctcaagtggccaattaatagatggcctgaattagatgagaaagcatatatttgaggagttgtcgagatctctgtgagctggtagataggtatgtctctagagtgaatcagatggctcgccgtccttcaatagttcaattggtagcgagctagctatattaattccatcaagctttggagaaaattcataagcttgttgcattttaggattttctagattaattacaaataaagtgatcgtgaattaagaaatggttagtggcaacctcatataggtggaattccaccctaatcccacatataaaaagccgctctaaaaaactgctgtaccagacaattgatcaaccgagagaaaaatacgggagaagagaaaaattaaaccaagtttatcggattatgtcccgttgcaatgtaccgcaggtaagaggtaactagtagcattaaaggtaatgaaacatcaaacatatatagacttatcgaacgaattttcgtttcataatatattttttgaaaaaagatcaaagttttgcatgtaaaatatattcacatgtgcaaacagctaatgcagcatataattaaatttctttatttatctccatataaatttaagagtaaaatatatggccggcccctaaacttgtgtggtggtgtcacttaggtctgtaaacttgaaaattgcacgtttagatccgtgaactcgactttaagatccccgtaccatcctggtccaaatatcctttgactgcgtttgaccgccaacgtggcatgccacgcaggcaacaattttactcccagcctcctctacatcacaacatgtcgcatatatctccttgtagctatatagagacaccagaatcccccaaaaataattttcaaattgttcttctctctcattcttctccttgcatgtatagaaaatgcagtcccgattagcaattgacattgctctgcactctaaaatgatcttatccttacgcaactggcacttgatcaacaacaccttcttccggcgacttcaagacaaggacgagcttagacaatccatggggatgcctagcgtgcaagccgaattgcgcagcttcccgctgcactgcactgcctcctaccgctaatctcaccgccgaggccgccacagccgctacctctcgacctccttccgctaaactcaccgtcgaaaccctagccgatttagggatattttgagggatttggattgaaatgcgcactggtcagggcaagttatgtgtgaaggtatatgtggaaggggttgagaacaaaagtgttgcctacgtggcatgccacgttggcggtcaaacgtagtcaaatgacgattggaccgggggtggtacatttaatcaagtttacggatctaatcgtgcaattttcaagttcacggacctaagtgacaccacaccacaagtttaagaaccggccatgtattttactctaaatttaattgtatatgcatttttctcaagcacaacgaacttaacataatagacagtttccttaaaaaacaaaagggagaaatccagaactaaagatatatactatactaccatggaccatctttacaccacaaatctaagcccacttgcaacttgcaagatgtagggtggatagactcacaccaaactctattctgaaccacacaaaagcataactgactgaactgactaccgatcgataatgcatgaccaatttgtcattgatctgtaatttcatatcatatatactgatgttggaggagctagctttatgcgtggcatatttatgtttttagcacatatctgacaggtagtgtggtaccatgcatgcatggtagctgtacaagcctaagtgcaattgtgcaaaacaacaaaacttgttacagctgagctaataccaaactaatgcgctctggtgtcctaatgacaatacatgtcaatgcttcagaacctcatcatttgctctatatataaagaatcagtcgctgttcaaaacttaaattttaaatcttaattttgaaattataattctacagtatttttaacgtggtttctttttcagcattaccatctaagccgctaaaaacacacacatataaaaattctactaaaacaatattttttatttgttaataaatcgttttagcatataatcagcttttagccatctaataattaggttgtaagtaagcatgagataaaggagaaagcaccagtactactactactagtagccaacaagcttagctgccggtcaattagactcgagggccgacatgtacacatcaaggtcacaagttatcagcgacggcatcgccatcagcctcctccggtgcagcgcactgtccggcaacagtggtgcaagtgtgctgattgtgacattgtaatttcattttagcccttttgaaagaaacttttatgaaaaacaaaaatcccatgacgatgaaaccgggagtagagtattacacctcacagtttaggtcgccgtcgttgagccctcggttcatttagcccatgcctgagaagcgatggcgatgtgaaaccaacgggaaagaagttgaggtatcaacacgaagctctgtggttgagtcatacccctaagtagttgatcatactcagagactcactcacagagtgaaatcacatgataattccttggactcaaaaccgttttgctaagattttgcatggaaattgcctagcaaggtatgtttaagtacatcctcactcaagtctcctcatttgtgttttaagttaggaacaatatgtttacataaaacttcagcataagtgacaaggcaaccattcctggactaagctaagttcttgaatgaaaatcaaaggaattttggagggttataattaatcctttaggaaagaatttctatataacaccctttcgatcaaagaaataggatttaaaaattcctatggaatgcaaattctattaggaaatttaacatgatctcacgtcttatattttattttcctttgctagttcaatgcacattctctctatctctcttccacatatggtttcttgcaaaattcttgtgtttcaattcctgtgaaccatcaaaaggcattatctgtggtgttcctctattttgtaatcatgtagtattgcatagcatgtgacaatcaattcatgtgtttttttttctatttctgcattttaaaaatcatgtgtttgctaagtaagcgtagctcagtgttgtacccgtcgacagtgagacgcccataataacttcgttaatcttaagatatgtcagtcggatctgtcgaatgtgcttataggggtaaggcgttcatagggtgggtgtgctcacgttatgatcgagcgcctacgattatattgtgtttcttaaaacaaataaaaatcatgtgcttcaaagaagtcctaaacagcttatgggctgagctagctactttttcatttgtcaaaagaaaagggatggtcctgacatccttgaacaatatacccaacttctttgaataatcgaatcacatgataattcctcaaagtcagaccgtttttgtctaagattttggatggaaattgcctagcaaagtatgtgtacatcctgagttaaagtctccgcctgtcttccttggatttaagttaggaacaatatgtttacatggaaacttcggtagaaattataagtcacttatttctggacttgcctcaatttaaaacaagttattaagcagattggtaccgtagattatctgtttgattataaggatacatcaaatattttgagaaataaattttccaaataatttaaacaagtggtttaagtaatacaatagtaggaaataaatatttctttgagaaaatatattttttcaaagcgtgaggtaaataatccatttcaataatctaataaatatttacatatttaaaagatctgtagtgtttctgtcatccaacgccaatagtttcccctgaaataaaaaaggaaaaaaaaataaaagtccgactctaaaaaagggcaaaaaaaaaaagaccatccgaaaagaaatacgtgtcgtccatgagaaacttgaggcgaaagagagttttcatgtatttattcatatttagattggttcaaccaaatccgactagctctctatatcgtctaaataaatagtgtcaagtctgaattccagatctaacatatgtcagagatctataattttaaaaaagaaaatcaatagctctaattctcgtttcggatcaattatcgatattaatttgacttttaatattacatgcgtagtttgacgtaagtagctaaatgtggtgtagttactaatcttgagtctctctggttctctcacttactttactgtagtattattcacctttctctttctctaattaactaggatttgatgtatattttcctatagcaacacacgagcattttgctagtaataataaaaagaattgagcctcacttattttgttaaaaaattgcttttcaaaatggagggaaaaatacaaaatagtactccctccgtccctaaatatttgacgtcgttaacttttttaaacattttttaccgttcgtattattaaaaaattaagtaattattaattctttttctatcatttaatttattgttaaatatacttttatgtatacatatagttttacatatttgacaaaagtttttcaatgaaacg

SEQ ID NO: 25025 - DNA, 31955 bp, Oryza sativa
  unsure (1)..(31955): unsure at all n locations
nnnnnnnnnnnnnnnnnnnnnnnnnnnnnnnnnnnnnnnnnnnnnnnnnnnnnnnnnnnttttgttaaaaaattgcttttcaaaatggagggaaaaatacaaaatagtactccctccgtccctaaatatttgacgtcgttaacttttttaaacattttttaccgttcgtattattaaaaaattaagtaattattaattctttttctatcatttaatttattgctaaatatacttttatgtatacatatagttttacatatttgacaaaagtttttcaatgaaacgaacggttaaaaatatttaaaaaaggttaacgaagtcaagtatttaggtacggatgaagcagtataaaccgatctttcccttccccttggcccctgcctgtccgtccttgtcctgttcccgcagccgaccaccgcgtctcgccggagggaggggctccaccgtgcttgccgctacctttcctagtccaggacggacagcttgcctagctacacgcatgtagcagcgcagctgccgcgcacacgccgcggttgtcgccgccgcgagctaccgcccaagtttcccgcacgttttgccctgctgtttgatagcttagctagcgacaccccccccgcgctgttcgctagctaccggggcctctctctctctctcccctcgtcatttcgctccggatggaggccgattattgggcggcggcgatgtccacaattttcggaccgaaattgatgccgaaatttttggttggcaattttgaattagtttgaatataataggaattgttcaaatcaggttaaaatatgtctgtttcaaaattttctccctctaatttactattgcttttaaaaattctgagtatgttgcgctgacggtaaacgaaccatgcatgctcaccttagatgtgcgcacggtgtccaaatcactgtttactttagcaagattagttatagtgtactattttatcatggttactatgcagtatacaagttcgtgtatatacatgtgaattttataagtttgtatttcggattgtacccaccgtaattaagtatatacttatgtacctccgtttttttatatatgatgttgactttttataacgttttacaatttatctaatttaaaaatatagtataaatatgtaaaaagaataggttacagtagtttttttaatgataaaataagtaacaaaaataataattatatatttttttaataagacgaatagctaaacatcacgataaaattaaatgtgtcatatattaaaaaaaatgaaaggagcgaaagggctgtaacctagtggtttgacgacattgtgctttcagtgataggcgacgtactcaacaacgaggcacctgtggggtttgcgtgcgtgtgttgtgagtgtctgtgttgtactatgtaattctcgaaaagaaacacctcttaatttttatttaatctgaatatagaaccatgagaggaagtgggtatgtgcaatgttggcttactgtgtacagcacttatcgatatgttgggcaatattctgtggccattgacaggcaacagcaaatggtccatcggccggtcggctcggcgccatgcgcactttgtctagggcacgagggcaccatgcatgtcggcgactcaattaattattagaaactcttcgattcttatcattagtagtagttccccttaagatggcatcaccgcccaatctgaaaaaaaagggtatctagacttaatgcagttgtgcttaattatatgttgcatattgtatctaccgatagtttgactattagagtacatagatatttttgtatatgcttgtagggaaaaaatataagaggataagaagaaggtacacagtatgtaagagataactttataagatctctaagagagagggaaatggagaagtaagagaaattaaatagtgttataaaaccggtaccgataatacatagatcgatatttgtgaatgtcataggagatccaaaactgatgatgataacacttcgcgagaacagctcaagttaatggtcattttggtcttctaggattatggaaagaatggaactcgtgtatcttcaggaaaattggccggcaccccattcctcatcctcttgagaataaaggaggaagctctccaatgggcagttgcgggggcaaaaaaaaacctaagtgagatgtaccctttacgagaatggagtgttctgactggtctaggacgaccataactcccatgacttatatataactttgcttccctactctatcaatatataaggcaatcttcttgcctttccttcaaaaaaaaacagacgataatatcaaggcatgatatttgttaacgaggttcagccaaagcctatatctctgaagcattgattatggatgctcctctttatccaacataattataacatatcagagttacaagctagcaacctgttccctctatccaacataattataactataactaagttattgatagtcaaagttatgtttgactgaattttctaaaaaaaacaaagttgactgaattttatcctaaaagttaaaacatttatgatcagatggagtatatatatgccacaaaggatactttttatgtctagaaaatttcttccctatgtgggacaggatttctgagcggaattctatttcaaaataaaatatctgtaagagttagccgtagaatctaagtcaattagagtttggcagttgtaaattagaatatgggtacatatatgccacagggcagttttgttttactcattgtgagaatttctgcatgtttatgtttttttattggtatagttgtaaattgcacgtacgccacaacttttactatataatatattatctttactcagaaacaaagttcaatgccaggctcccctacaataaattaatcaaatgagccatatactttattggacagtttgcttgaaattcccataaacatattgttttgacatgagggccaaccaaatgggttgttagaatagttccaagatttccctctcaaaaagaacagtcccaagataccacatgtatgttttcatgcatgttgatgttaattaagaaacatctctagaaaagtttctgacttttatagtgagtttcttagactttaatagtctgaatcttccagaatcgttctagattctagaatggcagagaaataaatttatgtacaacaatgtcaatgtatatcttttctaataaaataaataatgatgggtgaaggttcactaataggacagattcatgaatgaatgttgtctctatctatctatagttggtgttttcgattatcgtggccttgctatctgctacaaacattataataactgcctatagttttaattgaaaagaccgggattttccattatctaaaaataaaaagtactgatctatttgtagagtatcatctgtcaattaattgaattatggcaaacttgttgacaccgcgaagatctcatataaatataaatatatatacatgcatacaaaatcaacaaaatcaatctgtctttttgaaaccgacggtggtcaatttataaatcggtccgttttagttaattttcatacgaagttgactaaaagttatctgcaggttatattggttttcacttggttttttgtaaactggttggagcggtttttattttgagaacggaaaggtaaaatccctggcggaggattgttaagcagactgtttatttgcggtcacatgcatatgttttctctttaatcaaattgattgattctattgttctaattatcggcctccttgcttggttaattaatcaatccatgtgttgtacgtgggaacttcttgcacaaaaagccggaatcaattgcacagattagctgaaacaaatcactagcagattatagttcagtggaaatggcatgttttgaataatcacactggcctttcaaggcatgctagctactaattgtgtggtccttgactatgcaaatgatatgcatgcatatatttttttggataatgatgcatgcatatatagagtgaggttagttaccaaaagtttaatcgcatcacggcatcaatatatatatatatatatatatatatatatatatatatggccaggtaaactaaaccaatagtataaaaatcaacttattttttcaagacaaacttcaaactctataaatcacctaatttttagatggagagagtacgttgggtaactaaagtttattaatagagcaattcaaaaataataagtataacggccctattgttccgatggatagaataacctataattagcttttcaaaaatttccaaatgaacaatttcaagaaaaaacttttaaattttaatttgctatgttcaatttatgtgtttttccgtagagtacattgaaggtaaaaaaacgtaaataactaaaagtaaattcagtggcaaagtgggtatacatatatatactacccaaattagtacacaaatctcagggcatggcctgacattattggaacgccatggccaggaatcgttttgcgaacatgggtagtgatcttagttatgggattgatggaccttaattcttgctgtatattatgttttctttcgtttcaaaactaaactagagcgaatgtgtgtttttatctatctatgcatcttaaccatacaaaggtcgaaagtattgtaagtacgattatttcatctcgatgtactccctctattccaaaatatttgacgctgttgacttttttaaaaatatttgaccgttcatcttattcaaaaaaaattaagtaattattaattattttcctatcatttgatttattattaaatatacttttatgtatatatataattttacacatttcacaaaatttttagaataagacgaacggcgtcaaacattccgggaaggagggagtaactggctcagttcagtaaagttttcattatcgtaagataaaataacattgacccgtctacgtcaacggcggccggattaattctcgtccccgccggcgccggcgccggcctacctccagtgagagctaacccaccaacttattcgcgcctgcatctgcgtgtttggcgccaaaaacgggtggatatatatatatatatatatatatatatatatctctgaatcatcatcatcatcaatatcactaggagctcactagctgcatatgcgtaccaacttaacctgaactttcgtcagtgcaaggtcaaaattcgtccggccgtgcggcgccgcaaaaaccaaaacgaacctaacctaaaccacacaaatgcacgtgtttacattaacttaatttaatttgttcttgtactactatgttctagtagatcaatcgtgcatgtttcgttcactgtttctttctctgaatttttctgaaaaccaaactcatcgatggtcgacggatattcttcgatcggtttgtctctctgcacatgtcgctgtcggccaactcggtcgtcgacagatttcgcaaaagatgagcccccggttaataattatcttcgctaattaagctagtagtagaaagctgtggtacggtacggctcttcttgttaatcatgtaaagagagtcaagtgtgactgtcgtactcatatatactattatccatatcttcttcttcagtttgtaccacatacatctccttgattagtactactattagagcagtacaatagcatgctataaaccagccataaacatattttaaagagataaataaagagatagaagagtaatagactacagatttgtagccaactatagcacggacttcaagacgtactgtgtatatgacaggtagggccaggtattaatagtacagtaagcaactattgtataaattggctcttctattggctatagatgatttagagttagtagttggctatactattaaacttgctcttattctctatttaggaatacaaacagcacgttgcaaatgtgtacggggagaatcaaaacggatatgtactttcttcgtactacgaaaataattctactaatgtctatccctgaattctttaattagctagtatacctttcgtacttttaactttaaaatcgggtattagtttcaagttagtttcgatagtgtgttcatttggtattgtagatgttaattattgtttttggaatacgcaaggagcgtatcattatattaagaggaataaaagttatttacaaatcaaacataaaatttgaaaaggggataggataccggagcggaaaaaagaatttaagctacaatctcacaaccgattgggacgacctagagactcatgaaactagagaccaagtgccggtattaattgccacctttgccaggcgccataactccgcctctgtagccatagctttcgctacatcgactcagggccactcttgcaggttgaaatcccggttgtttctctcctgatgttaattattgttttgtgacttgatcaaagtgagaaaacttttacttaagagaaaaaaatgatagactaaagagttcagggaagtaaaagttttaatattatagaagtaatacttaccgcctatagcggcaggccgacagctagaaatgcacacaattgtatttgtgcatattttctaataataaattaaaacccaacttctatatctaatacgatgtacaccgctactatttgtgaatagttttggatgtgctgattcatgcatccacagatccacgaaggtgtatcttcagatttttcatgatacactgtccccaaattgcactccagtgtaagcaacatgcatcaacacatatggtatgatgctaccaaagctttagaaaactactaaccccaagaatcaatcgaccaacatggctggtgctcaatcatcccatcacatcacaactcgtgcagtgcagcatatcccctgatccctcacctccaatcttgacctaaaaaacgataagtacaatctgcatcgcataaagagaaaaaggagagatcacgagcacatgctccaatggccatgaatttgtgtgcccgcaagaagaattcagcacacctgcacaagcaataatggagcttgaaataccagtagaaatcagattgttgcagctttgctcttaaacaagttgaaaaaacggcgtttttcatttgcaattgtgctacgcatgcgtgaatggatggatggatcatggatgatctcttttgatctctactcaaaagatgagcagaaagtcagtgtgtgtcactgcctgttctgttcatttggactactgcccccagcagatgaatgatgatggcctcttttactacttttactctgaaactgtgaccaacttggtctgctgttcatcaatttttacacatgcatggataaactagtggatgcagacatgccatagcagcactagtgctagatattagagcaagtttaatagtatagccaactactagctccaattcatctatagccaatctaatagctcatccatataatagttacatactatactattaatacttggtcccacctgtcatacacacactgcgtcctggagtccgtgctacagctggctacaaatctgtagcccgctgctcttctctctctccttatttatctccttaaaatatgtttgcagctagcttatagcttgctattgtacctgctctaagagcttatatgcaattcagattgcagccaaaataaaacttatcaaattttagcactaaaattttagcaatttggtaatattgccaggtttggacaggatttcttttgtattgatcaagtttggtaaaaaaactaaatggatagcatctttgacaatttaaaaaaaaatggtatggcaccttaaacttatcagaaaaaacagacaatttacaagtactcctcaaatctcaagtgtataatagaaatagaccgtaattttttatttagttgcgtgctagttaggtttcaaatttgagacatttatttgtgatatcatattgagttgcattcacggactaatttaacctaaaagtttaaggttgcgagaaaatatggacacttcacttatactacaaatggtcttgaagaaaaaaaaaagcaattgagccagcagttgaacagggtatgagtaagtgcggcagtttcaggctgtctggccgaattgtagttacagtacaagcacaagcacattttgtaggccagatcttgtctgcgttatgatgagaagaaaggatgcagaattgcagatttgcattgcagcagattttctgatgtaaaaaaagaaagaaggagaatgccataatggttacgagtagtacaaacaaacagacaagatatatctgcagtagttcagagagttgcgaaacagtggccatctttgctttcttcccgaccaaatcacaggtgctgcaaccatatcaagcaatcgtctatccgtctttgctttctcctcatgcgaaatggacacaaaagaaaaaggaatcctgagcaactattctgtgtttcagtaagcactcacgtcatgaaccttcttcgccagattattgtcacatgctccctccgtctaaaaaaactaacctagaagtgtgatgaaatataatctagtacaacaaatttagattgctcctgtccagattcgttgtatgggattaattacatcccaattctaggtagggtttttatgggactccatacctctaaaattattttttaagatacttttatctaattcattgcttagaccatttgttctgagatatttgttaagtttatttcttaaaataattaattcatccatataatcaagtatatttttcgtgataataatttgatgaataatctattttaaattaggcctatataaaatgtcactttctttgggcgtgttcagagttgatgttctccaatccatttatgtcgaactgtttgtgtgccacatgttggccccaaaatttcttcccattcttgtgaccaccaataatacataatcaagacgattgcgcttgcgcacgttatgagcaacaagttgtcgactattgtgtttaaatattgacttgcttccctatcatgtctctctagctccatcagtgacttgattatctgtcggagaaagatgccgatataaaactgtttgttgaagcatcaaacttgcgtaagcgatgaccgagttgcgactgacgaaacaggcagtggataatagccatacgaacactatgaacagctcacctgtttcaaaactgaatattgatcgtgcaatggtaagaggtgtgtgatttcaaccccaaggtctcgtgttcaatccccggcactttcataattctttctttaaaaatgtttggagggacatttctcccgccaaatctcgtttttttatatatttcggttttagagttctagtattgtatgaagtgacaagttcagataatcacttcaactgaaaaactcaatattgtctcataaaatgtacttatattatcaagtgctatatatattaatttcacgagaacagccttggttcagtcagttgcaactataaagtgcaggcacacttttgtaataccgtgccattgctgtggacccatatgccagtgatattaaagtcacctaacttaagtcggagataaagttacctgcaactttaccttcttacacaaacttcacttggctactattgaatctaaaacgtaactaattagtactagacataacattaacatccgctatatgtacaattaatatctttgctataaacccaatatcagctttggcaacatgagtttcaagattgtggcgttacaaccaatgcaatcttcaaacttcagatgtttgccaggtagaatggtatgtacaggtacaaagttcagttccttgccaatttgttcatggttgagctaatagtggtgcttgcactgcttcatgatcaagctgatctggaactgcaactcttgtgcatttggcttctggcttaagcatgaaagaaatgcccaaagatattgcctgcagaagtattcagtcaagtcatgcagttataggcactatttagattcatgaacacacatggaagaattaataggactgaccaagaagaaaccggcaacgaggaaactgaaacctttgcagttgaagggggcttgttctgaaatgaagtaagctgaaacagagttgcagaaaagggagaaatcaaacattcagaatactacatggagttggcgacatggcaatgcaacatttgtaagatgaaacaaaaaaaaattgcttgtttacaggtcagggggctcatgaacaatggtgccaacagtacagctgtggatttcacagttgaaatgaatccttgtgcctttccctgcaaaagtaaagtcaattttatgccaaactttgatcagtaactgagtaaataaagctaagggatatcaagattggatttacaaatcaagaaatatttttttcccttcctgagtttacctggtcagatgagtccacttccccagagatgattgcataagtctgcacatgttcaacaattttgaagtgtattcaaagatttttcaagtgtataattgttacttaaatgcacacaaaacacaaaacatgattcctgattttaatgatgcaaacattgtacatttggcgttttattttgtagttaatatactcagatatctcatatatcacagatcttaaaagttacaggtatatagacatggtgatcacttacagctggtttgaccagaacatagatgacacccaatgaggaagtaagataaggaacctgcataatcagtgtcaaacaaaacaaacaaaaatgttcagtaacgacattagtcactgcagcattttttggacttaaaatttattactgaactatgcgcccaaatacatacccagtaactccatgccaaaccatacaggacagcctagaggaaaaaaaaaggttttagttctgcatctgatatcagtaaaagtgataacaaaaatattagcaaaaagagatgtgatacactcacgtaggcaacagatgcaagtatcccaacgcataggactcccttctcaccaactgtattgataataacagggagtaccaaaatctacaattttacaatttttttttgttaatcaggcaaggcacttaaaggatgattgttttttcgaatataacatcaagcaaaggttattatagactaagtactacctgcgaaaagattgaaccaatgcctactaccataagaatttcagagaactggttcttgtcaaaaccaaatactgacttcagatagtactgcaaataaaggggcgaagaatgaaataaccagtactcttttgaacgcaatgtcgtaaaataaatctgagcatatggttaccattaggacatcactaatgccgatcatgcccaactcgtagaagaaggaaatgtatgtgattctgctaagtgtttcactaacaaaacatgaagatagagaagatcaaaatttgcattagtaggtatctcttgacatcaacaaaatttgcatttgcaattttcaaatgttggtcaagtgtaaatacagaagtctcatcaggctttcttttccagaattattatccgtgaatccgatacttattaattttctttgtgctttgacatgaatcgttacaccattaaattacttagaccataaaggagtctggtgaggaacattaccttctcctgattatgttaatattctccttgatagactcccagcgccgcagtggtaacctgacaaccaaagatgagaacgacatatgctcaaacgaaccagaagaagctctttgaagtgtctcaaccagagatattttcatgtagatgacagaagagatcaacaaagcaaccgagacctgataatgcgtggtttcatacttgtaagaatgacattaattagcataaaaattgaaaaataacattgttgatgaactgtaagaaatcttcatgatataatacctggaaaatccaccgctcgggcagaaacctagagaagccattgcccagagcatgcgaagcagatagtatcccagttatgcagccaaatgcaaatgctctctttgatggatcaaccacatcggcctaattaaattagcagaaaagggaattttaactgtccagcatgcaacgtgcatgactacttgttctcaaaccgcattgtgcatagctatgcaataacaagaaacgctgtcaatttgccgtttgtccaatttggtttaagtttccaggctcaaggagagaattatacgacttggataaagtgaaaccaagagttagcatctgtgattgctctcaccgtgtatgtcactgcgaggctggttatggttccttggcctatcatgaatgacaaagtacgcagaataaggaagatatacacagcaatcttggatttgttgcaggcaagaacacctgcaggaataaacaatatgacaccaattaaagacatatgattaatatcctgtgaaactcatgaaaaccttgacattctaatgtcaaattcctgcaagcagagagactaacacttaactgatataagcttccaaaataagatagaacaggtatagctaccataagggatgatggaagttgaggcagtgagtaggaggagaggcttccggccatattcatcagctagctgccccatcaaagtgtatcctacagccctgaaaatccctcccacctgcattaacacaagagtttccaatcaattgttcactttcagttgtcacttgcagactgattctttcagataaaatcaagaaaatggtcaactccattttcatcaatgaaaatgttatgcatcaatcatatagcataagcattggcaaccagtagtaatataatccctaatgcatcgagtcaaagtttcttctgaaactagcaaaagaaagaaactgaatttaggcatcatcatgtgatttcatttttcagataatgaaaactttagcgaactcagttaattacaccaaggtggtacaattgttccgataatactcccgacctctgcatagctacgatgtatatcactgaacaacaataatgtcttacaggaaaggagggacaccactgcataagagggagatgatcaaatgagagctgaccgtttgatggaggccggtgaggtagatggcctccgggcaggcgatgtcggcgccggggcagagtgctcgggtggtgacgtcgacgagcacaggcaccgtcatctcctcggcgacccagtacatgaccagtccaagcagcaggtgcatcagtggcttcagaaccctcacatctcctcctaccttctcctccatgttcaccttgtctcctcctcttctgcacctgcacctcaacaaagtgtctcctaatccagtaactgctccctgtttatcttcctaattaatctgttggttttattggccaagagcagcatgattcgtgaggtccagcttcaaatataattagagcatgtcactgtcctgtttgagtgcttttgttgatgatttccattgtttagcaagtgccgaccgcccaaaaggcagattaatccgattgttttggccaggattgattatatattcaacctatggttattatgcttttgtttgtagcgtttggtcaatgataaaaaccacctgcagctaataaacacaaaagcacattgcttttgctgtaaagcaacattatattattattgccttcacacaaaagtgattgggcgacaagattttcaacttgttgttatgtatctttgccctttttccatttaaagattatacatttggtcctttttaatgttttctaggatatttaggtttttctgtagtgtatatatttgttcacagcaacatggatgacgttacaaaatgtaagaaacatgggtgtgtgatgtctatgatgcagactatgtaattgcccccatcaccttccatcagccatcttcaccactgctgccccttccagcttactccctccgttttagattataagactttctagcattgcccgtattcatatagatgttaatgaatctaggtacacatctgtgtctagattcattaacatatatatatatgaatatggacaatacaagagagtcttataatataaaacggaggaagtaattaatttccacgtctcatcctcaaccttcaattgacctttttcattcaatttgtggggaccatttcaaaccaatatattcaacttgcaattcaggaaatattgcagttttccccccaatttgacaaggaatactttcaacttgcataaatcgctttcgcccggccgcttttctccccttccaatctccagtcccaaatgaaccactttgaatttggatgaaaaagttcaactgagcaaaggattcaccattaattattgcacatgaatacgttcctaccagctggtactctgctgatatcttataaaaccctatttggggattctaattatgattgggtcctgaattcaacaagccctctgaacagcatctaagatctgattatattgcacatggagatccaacaaaaacaaaacagttaggatcagaacacatggataccaatacatgaggcaggtttctgttgcattagatggcgaggaatgctcttcaggtaatctcgctcatggtcatagtgatacaaccaagaccaattgaagtgaagaaatttgtagaaaaacttgtgttctttggatgatcccttgggaagatagaaaagaagtaatcttgcatgttaggctcatccaatctcttagagttggaccaataccaatatgctctgataactcctgcatagcacgaaaaaaaatacttcaattgtctgattttgttaaggatgaattaacatagtgaagttgcactattaacaacatacttcggtctctcacatgatctgaaggtaggaagtaggaaccaatatctcggttaatatgattgggttctcaatttagtaagcaccaacagctagatcagatactgcacgtagataaaaatacagaagaatcccagaaccatggtagaatttacatgaaaatcttcttccacctcttacttcttccgcctcttgtttcgcttcctgtcactctcatcagaacttgattccgattctgagctgtagctgtctgaaccagaccctgaatcacttgagtctgattcagacgaggcaggcttctgtttttgcattattagccgtggcatgttcttcaaatactctctcagagtctctgtgataccacccagtccaatggaagtgaagaaatttatggaaaacctggtattcttcggatgatcctttgggaagatcgaatcgaaagaatcttgcatgttaggatcatttagtctttcattgagtagacgaataccaagatgctctgataattcctgcataacaagaaacaaaaccttcaattgcttgctttggtaaagatgaatcgacatatgtagtaaagaaaaggcataattttaacagcatacctggaagagtatttttatgaaaattctagaagatgacgtggtgtcctcctctgtcaaacggatgtaagctaaaacatgccaaggaagcgcgtcggtgcccaacaaatgcgcaaaaaatttagcaacatttctcagtttgtttgtttccagacgatgtatcatggaatattgttgcacgaaacatttctcaaagttatcttggtaaactttgttaatcatgcaaaatcgctgccctagcaatccataatatcgcaggtatgttctctcttggctgcagcactcaagcagcatgatgcacaattccatctgttaaatgaaataaacagttagctttgctaaaaatcactatattttgcaaactcagaactgaagggccaaagaaatcaatcagattatatgaattgaagagggactgtttgaaatcgagtattgtgttgtgcaaaacatgtgcctgtcttagcataagaatgtttcttcaccatcattttttgtattgcatgtcgttcagtaataggatctagaatgaggtaagtaattttgcttcacttcaaaaatttctagaagctcaaaatagcttgtgcaatttcagtgacttcagaaattcaaagaactaacaaataagtttagcaactgaactaccaattaggttttatcaatgcaatatgtgaaaactagcagataattttaatcagtttagtaactgaacctgaaagatacatgacaaatgaccatgtagtacatataacagtagtctaagtcgctacttgtacacatgaagctaagtcacatgaaaggagcacaataaagaaaacggtaattatagaccattcgtaaaacagatgcattaactaataactacccattggtgccttttgttaatctaataacttggtgcacaatattcttgatatacaaaccagcaccagaactatccgaatggcaagtgactgcgctgttgagacacaacattccgtgcattatcacaaaaatttgttctagtttgttcatgaattgaaagattggaaaatagattctaacaaaccgtaatgctcacagaaggtgttgtgtacaagaaagcaaaataaaacacaaaaataaggaaatttaaaaataccatagaaattgaaaaacaatattataatacagaaaaagagtcaacctacagtacttacctcttgaccaggctcaagtttaatttttagaagcttgtgaccagcttcttcaaaatcaacacttgacatgattgtcgagtaaatggttcttcgaaggttaatgagattggtctcagtttgatccctaatctccatctgctcttcgtcctcttcatcatcggattcttcttcagcatcctcatcagaagaatcatcagacccttcttcatcatcagaagattctgctccaaggatgcttctttttaggttctcatatgccttctcatcttcagcaaaatttggatttcccctgaaaacatctgcaggttggtaaaggtaagtgcaacacaacacggaagtgttaagatacatagtaaatgcaagaaaatttccagattcctatgggaactgaactggtgtttaaaattccattaaaataccaacatttcaaaataactgaggcttttatgtcataaatatagtaaactgaaaaatgtttgcatatgaaataaaaccctacttagattagtctcagggtctagctcatcctcaagggatatctcatgagtaaattgatcttcctgctccacaagatccaactctggacgtatagcagggaatcccttcacagatatgatatcatattgtcagaatttgttataggaatgcatagaaaaggtaaagaattaggaaaaatatgaatttacctgaaatttagcctttcgaattgcaaaaaggccttcgatcagaaactgcacacgcttgtctatttcaccttcctgaagaatgcctcgaaatctttcaaaaatagctgtatagattaagaaggcgaatccattgagaatgaaaatggaacaaaataagaaaaatagagaagtcataaggagatcaaacaaataaccaatggttcatgttagttaactttgaaacaaataaaaagctacatttagaaacagaaaacgtgttcaaatatcacagtttaagcagacagacaaatatagaacaaaaagatatccccagaaaattgtatcccaaagaaagtgtattgaatttcagacaaaatccagatcatccaggtaaagctaaacataatactagtgtaaaaaaaagggtctagacctgcactaaggttcacacatccaatattccacagatgaaatgaaaccgcctaagtccaaaaatatgtcgtgaatacagatgagctagtcaaaaggtttaacaagtcattcactcaaaagtcataataagcacttatggtaacagctgatctgaaaaacttaccatgaagcccttgtggagacaagtcctgaagcattgccccacattctttaacaaaacccaccgctacctaccagataagaaacatatccatatgcttcagatattgcataaatgaagacatgatcaacataaaaggacataagaaacaagatatgcacctcaacactatcatcagttgggttctcaagcagtacagtaagaagctccagtgccacgagctcatgagcaatgacctgcctggttaaccaagtgtgctatgaacttggttgctgcaagcagttgtggctgcaatcaacaagacaaataggtaaacaaacatgcattactctaacatggtgaaaaattaaccaagtattttccaaatgatactagttgtacttgaggcaatagcagtattttacatgtcaagctgaaaaggagaattgaggaaggtcaccttgtcgtttcgcttatatgctctcttgagctgaagcacgacgcgaacaagaagcaggcgaccaatctcagggaacttggtattcacaatggcgacgagcgcagcaaacacgtcggtgaagccaggtgaagccatctgcgacttgatgcacgattggcagaaaagcccccgcccacgaaccaggttctcggcgaacagctccggcacaatattctttacgttggtagcattcaccttgttcaccaggccattgatgctcttcttgagcgcgtcccagctgaggcgctggtactcggcgctcgacttgtcctccacctccctcatcatctgcgccatgcggaaaggcgggatgtagatccctcctgtgcgccctggtatcatctccggtagaagcggcggcggcggagtcggctccttcctcctctgagggctcctccggcgccgctcatcatgaccacccctgtcccggcggtggctctggtctctctgccgcctcctggagctctcgtcatggcggtgccgacggctacggtcatcatcgccggaggacgaacacgactctgagctggggctccggcggcggtggcgccgggtgtcgaggtcgcgctcgccgctctcgtcgtcagagtcccgcctccggcgacggctgtccagctcaggggcggatctgacttgcgacattggggtccagatctagaagagaggctagggtttaacgcgaattcgagggggaaaaaagcgcatgcgtgggtagagagagatgaggaagaggatgcgcataaacggggatggatgctcaccggacaccgggattgcggcggaagcagcacgacggcggcgcagccctgctcggcggcggaagccggagagggtgcgccccggcggccgcagtgatggtatattgtgacgtgtttggatctggaccgttctttctcgatcggacggatgaggagaaaagttacacaaacaaaacaaaatacacagtggtaattacagtatcacggcccatcatttcgcttatgtgaaatgtcatatttacagatgaaacataatttataaataattttttatacacatgttcttagcgatataaaaacaaaagctaaaaaataaactttgatgaaaagacccaaaatcaactccaaattgaaagctgaaacttcaaattttggatgataagtataaatagtataagcgaaaagatgagcccatcagtgttggccttgtacactgaaattctatttcaccacgtgtctaacacaagaaaaacactgtacactagctgaaacacacgatatcacgattgatttacaaggacaaatggacaatgtttatggctgatgaaaaagaaaaaaaataaaagacaatgctaaatgtggtgaagtttccttttcttccattcattcttaacagtgtgagatatatatagcctacagctcgtcggccggatggccgccgccgccgccggcggcggaggctactgtagcagctggctcgccggcggccaagctgtgcagccagacctcgtcgcggacggtggcgaactggtcgtcgttgcggtgccacgtccagacggcgctcgtctcgttcaggaccctcagccgcccgtgcccgaagctcgcctccctgaactccgacaggtgcgccgacttgtgccccttgatgaaccttcatcaaatttaattaatcaaagttcaattaactaagctaatcacacatataattaacgttatcaactacgcagatataaatagttaaggcatagttagttcccaaatttttttcctaaaaacatcacatcgaatctttgaacacatggttagaggggaaatcgcgagacgaatcttttgagcctaattagtccatgattagccataagtattacagtaacccacatgtgctaataatggttaattaggctcaaaaattcgtctcatggttttcagacgagttatgaaattagttttttcattcgtgtccaaaaacccctttccgacatatgatgagatcgtgaagcttacttgagagcaaggccttccctgttgcccccgtcgccaatggtgatgtacattgggccccggctgtcagcctcgttgtcgtagatcctcgtctaattaaatcattaatcaccatgattaagagctcaacttcaccattaattaacatcatgcaagtgttaagacttacgaagcgctcgtaggcgtggacgtggccggcgaagacgacgtcgacgcgggcctcgtagaggaggctctccatggcgcggcgcatccgctcgccctcgccctggtgcgcctcgttcgtgttgtaccacggcgcgtgcaccagcgccagcagccacggcgtccgccgccggtcgacgccggcgaggtcccgctccagccacgcccgctgcggggacccttcctcgaactccgcgtaggatcccagcatcaccacgtgcgccgcgccgcccgccgcgttgaacgagtagtagaggttcgacggcgagccgctctcctcccgcggcatccgccaccgcgcgttgtacgccgcgaacggcgcgatccccaccaccggcagcgcctcgatctcgtggttcccctccgtcaccatccacggccgcgcgctcgccagcggctgcaccagccgcccgaacgtgtcccacagcggctgctgcgtgtcggcgtacgacaggtcgccggggagcagcagcacgtcgtagtcgccgccgccgccgccgatgtgggacagcgtcgacgccgtccacttcgtctgcccgaggtcgccgaccacgacgaactccacaggcagcctcgccggaggcgtcctgagggtgaactcgtcgccggccttgccgcaccggtagtggtacgtcgtgctcgcctcgagcgggccgatggtggcgtggtggatcgcgccggacttgtagaggaagtagcggtacgtggtgtggtcgccggtcgccgacgccgtgtacttccccggcgacgtcccgtactccaccacggacggcgcgttcaggtcgtcggtcacccatgaaatcctcatgttcttctcccccaccatcgaaatgtgcacctgattatcattggcaaccatgtcaaagttattaccgaaacattaggaatcagaattatgctggataataatttcagctgcaaattctctttgattaaaacttatgtaaagctcccagctactatgtcatactgcaatgtaattttgttgtctgtacttcacattgtaacgttgacaggttgataggaaacgtggaattaaatcttctgtactactgtattaggtgtcaatttgtatttgtgtctgattatgaaagtttgaaaatatgttactgtaaacaaaggacactctttgcctctgattctgaagaaaaaaaaaagaagcagagttcaagcataaaagaactctgcaaagaatgatgatgaaatcatgagacaaacagaattcgtttgccactgatcaatcttgggatggatcatggatgaactttttattgaaaaaagacgggaaaagcaatgaagcattcagaacaagaaaactccaagtgccaaactctgtcagactctgcacactgcaagtctgcaacacccagagatgaacccgcacctgctgaggatgcgacgccggcttgccgtgcgccgtgagcaccagcgggctcggtggcggccggacgtactcgtcggcgccacgcgcgcacaggaacaccagcgacgtgatcccctgcagcagcagcctccacgagctcgccatggcgcccaccaccgcgtcgccgaggaccgtccccgtgcagctccgcccgagcgccgcctgttccaggcaccacgcgcaccgcgcgttcacggcggagaaggcggcgcccgcgacggcgacgaggcttctcgccggagcaaccacggcgacgcggaacgcaacccgtatcagcgcgagcaccccgcgggctattatacacgcgagcagtagcgtgcggacgaggaaaactacagttatctgcagcttcttacgcgtgtcgcctcgatcgcacgagctcgccgccatcgcggccgtcgccatcatcatcggtggccagcctgggctgagcccggaggaggagacgacctgggagaggagagcataattgcacgtcattaggattttaataacaattaggaagactttggattagggcatatcctcggagatatgccatggtgtttcttgccgctctctctcttgctgtcgtgcgtgcgtgcgtgcacctggcatgtggcgtggacgacatcgtcgccggtggttgccgaaaagaagaaggagcccgccgtgtgcggtggtggtggtggtgaaggtgggaagaagaaagaaagaaataggtaggctggggttggcattttgctgcgtgatgcaggaatttttgcactttgtgtgtgtggtgtctctgttttttctccttctataggtagtgtttcgtttttaataaagttataagatacgggaaaataagaaaccattaacataattaattaaattttaattattacaaatctaaaaattagatttatcttatagtttaaaagaatttatatacagaaagttttcgtacaaaatacatcgttaacggtatgaaaaatgttttaacgaaaataaagataaaatttgtatcttaattaaaaaataaaaaaaaaagaacagtgcctatatcgatttgtgatgaaaggggttgtcacggttttgtgaagttggcagtggacacgtcagccttctaggtgcatctgacagggatgtggttacgggcttttgaacctttgatgggtgaacggaatattatcagatgctgttttgggtggctgagaaaatctaagtttggaagcaatagtagtagtatattattaagccatcttgatcatgaaacgtgtgctttgctaatttattgttgaacacatgatttaccggataactgaaatggctaatacatgcgtttgtcatgatttaccggatgtaactgaaaaggaaagcagcaaaacctgcaacaaagtgaacgcccgatgctcgcccatggcagaatgcgtgcacgtacgttttttatgcgtgccgtgtctgaacggatgtgggttctatgcaggtatggagcttggatgatcactggagatactggtagcttgtttgtcttatccagtataaattctcatttaacttaaagagatttactctcgtctggcagcatgtaccggcaggtaactagtatcgggaggtagaagatcaaatctggccatccatcttgaaaggatacgattggaaacagaaagagcaagagaagcggaacaattccggagtcgcgccgccgctttcctccctgcgctctttctttcctccctccccgcatcgcttctttctcatctgttcctccctacgagcgcagaaacggagcagttttcccgccggccgatttgatccccatcatctactgtcggtggccacagtactggagaatacctcacggcgcgctcgccccgcatgcaatgtcaagagcagaagcagatggtggttctttgccttcatgcatgcttcagctctagcaaaccagataatgacattgcatcaattgattcaggcaggaaagaaggcgctctgctcgctggtaccgtgacttgacttcctcaaggatatatggatgctcctcggcaatgggttggggccagagctcgggaattctgtcaccggggagttcgttgttgctgagcggatgtggagccgcagctgcgacgggaacgggatgaaggtgctccacaacagtgacgggaaggggagacgccgctgcgatgagccgctgcgacgacgggaagcggaaccaccgccgctgcgatgggcaggggagccgccgctgtgatgggccgccaccgcgccgagaagcggagcagccgccgctgcaatgggcaggggagacaccgctgcgatgggccgccgccgcgacgagaaccggagcagccgccgttgcggcgggcatggggagatgccgctgcaatgggccgccgttgcggacgggaaatggagccgctgccgccgccgggacgggaagcggagccgccgccaccacccactagatgcagaccccaccgcttcatggacaaatttgtacctgcagatatcagataatttccatcgtccaatcgagctgaatgaatggctgagatttggtacctgctggtaccgtggtacctgctggatgggagcaatgctctaacttaaaagattttatagagtgtgtctttttttaacctctttaatacttcctccgtcctaaaatataatttgctaatcaccaacctgtcggaggtccaaactctattttggattatcatcccggtgaagttttgcacttacgtggtgtccaggctttctaaattaggttattgaagttggtagcagtggtgccgaggagttatccgttgtaggccgacgttgataggattatgaaatagttaaggaattggcgaagctaggttgatgaggatgacggtgtaaatatatactccctccatattttttaagttcccttctagtgtcaggagaagtgtttactgtgttttcttcaacagccctgcatgttgctttgttacccttttattccttccatcttaatgaattttcgtccgcttttactggaccggtgaaaaaaagttataaaaatacggcccggtgaaaaaaaaagttatatcgacaaatgctcaactcttttcttcgagaattctaatagttcaccaccgaggtcttctggtgtatttttgaaagagtggtgaacatggcaagctgctagctttggagtttggaggcatcacgatcgaagaggtatataccaacgttatcatagtagtgcaatgtagttaggcgtttgtcagtacgaacctttccctgttctaggattgggtatgtgtccacaacaaccatgtttattactttgtataacagcataaagtttgaatgacttcctccgttttatcttgataaatctctttgatcaaatttattgaagaaatataaaatatttttatcataaaacgaaaatattattaaaaatatatttagtgttatatttaataaaactaatttagtgttggatgacttaaataagttttacttagaaaaaaaatcaaaataacttgtataatataaaacatgggaagtaatattattttggtagcaaagcatgacccaatgcagctagatttttttttgggaatacactagaagtgtatctttattaagagaaataaaagttatttacaagagatacaagattaaagagaacagggtactagaatgcaacagggacttaagagtacaatctcacaaccaaattgaacgacctagcgaccctagaaactagagaccaagcgccaaaactgtcgcctttgctaggcgccacagctccgcctccgcggttatagctcttgcaatttccgcccagggtcatgttgatgtaaaaacacgaggcctgggagatctgcttaactccagtgcaggtccaaaactcgccttcgggtatgctagcgtgccggttgatttgatcatgcaatcaacaagaaacaaagacaaagaaaccgcggttaaatccataaacgatagccgatcggctaggtgccaatgacatatcatttatctttgagccgatgtcatatatgcatcgatcggcaagcattaataaataaaacagaactaaatctactcgatcggctgtagatattaacgatatataattcttatatcgatatatacttaaatcaagtgattgggataggtcggtcgccatgccgagacagtataaatcacttagatcgaaatatatattaataataagattatatatgttcatagcatagctgatcagatagatctagcatgtatcggctaatactccgataccgctctatactaagatatcaaagcaaatagaatatatcaaacaaaagactaatatacttaaatgcaacaagatcttaacataaaggatagattcaatatatcagcgaagcacataagataaaaggtaggtaaatcaggtaagatcggctgaaactccgatactaccctaatcggcaaccaagaagcaggctagagattaagattctaatcacgactcataagatcaaacaactgatgcagctataagtatgaaaagaaggacgatatctagacaatcaagccattgaaagttttatagagtggtagatatcatatataatctaaaccaacgtcgatatttaacctaatcggttgccctctactagcagatgttagccgattgtaggttagatgacgatattgccatagattatataagatatatgataactcgacgaattacataaacaaaattagagtatcataaagatggaagcactaatcccgagaacgcaagccgccataacaagttttacctcttgttgaagatcgaaaccgatgcagctcaacccgaaagcaagaactcgtcgaaataaaacgaaagcaaaaagggtggcgatgcgccgagattgtattgaacgtgtgttaattttattacatggggctcggggtctatttatacccgagaattacacaatatgtccatatcggacacgactcttatctctaacaaactctaagataccataagtctttgcggcagacttttacccaaacatatctctaaggaaattacataaattattctaattaatagatacaattgccttctcaggactctatctatgcatggcaatcatcttgaagcatatcaactcaacccgatgacgtataccaagtcgtattgtcggaatcggctgtatcgtctaacccagtctgactcggacttagccgatcccgattgtagccaatttggactccagccgattcttactctgtttccacaacgatcttcgtttttaattccacttcgatctaatcttcgtctccgatactgatattaccaaatttggtcgttaacaggtcgctgctggagattgaacacccgattgttcctctctttacagatcgtccattctaccaaggtcgcaatggtgccgaatccccgacgccgatccttcaagactttcttcctgctaaggcagagccactgatggaaggaagcctcttgcaggggaggcaatccggtcactgagagtgcccaccgggggcggaggtagagtatgggagggggggtgcccagaaacccggtcaagtaaattttttaactcacagattttcatcatgtttgtatcccctcaatacaagcttaggcacacgtatcaacttaaacttgattttagatggagtaaattaagcaagaggcacattcctccatttcgttctagctccacccctgatgcccaccaccagatcgagttgacgggattcagggcagccaaccaagatgtgatctatactctcatcctgttaatcgcatagaacacatcggacggagtggggcagcccacgacgacgaagacgatcagcagtctaacacctattcattgtgaccaaccaaaagaaagtgagaaagcgaggaggggccagaaactttcaagttggcgcctcttggaaacggttccttcctatgaagatggcatggtacgccgaaccggaggaatacgttcctgtcggactccatttccatgagaaaatgcagctatatttatccgggatttagattttcttctgctccgccactggacgaagtcacgcatggactgctgtaagcctgtaactcgagaaaccagtcgattgcgcagccagccaggacttggaacgaagggaacagaacagatcagagacgaagacgtacaccaattttcacggaccaaaaaaaaaaagaaaagcaatccgttattatgccaaaatggaacccagggggaggtgggccctgtcagtggcccgtggctagcagatgtgggggccaggcgaggtgatgactgatgagagccaggcagccaccaccgccgttgcattggtacgtgtcgatcaactgagcatgcgtgcggttcgttcctcacgcgcaaaaccgaaccgcctgccgaacaacgcgcaacctctctctctctctctgtttctttcttctagagttcagactggagaggctggaacagagtgcagtaaaaccaggcaccgtttagttcctcaaaattttcttttaccaaaaacatcatttcgaatctttaaaacaaacgagttataaaattagtgttttttattcgtatccaaaaaccccttccgacatcctatcaactttcgatgtgacatctaagaatttttatttcaccaactaaataggccttagtcacctaaagttgactaaaccacatatccaaatccccagattcgcacctgaaatcagatgcatccgaaactggattcctccacggcacattatcaatcatcattaatcattaattagctgcttgcgttggcaaggctgtcctatatatacacgacgccacccttccatgctagccataaccgccctttttcatttcatatctatccccagtgccccatttcagatttggcgagaccagccatggcgatggcgatgacgaacacagcattggctttcttcctcctcgtcgccgccgcatccctcctctcgctgccgccgccgtcgctcgccgtcacgtcgccgtacgtgcgccccaagccgagggccacgctgtctctgctcaaggacgacgacgacggccggaagccggagcaggtactgagttttttatgtttttgatgacggatttggccgtagtgagtttgaaatcttcaaataattttcatgcgtcagttcaatttcttaatatttctcaaatttgcatggttatgtggctttgctctttgttggccatctaactcaagattcagtgttgagtgaaagaaatggtttggtcatctttggtgcaagagtccacccaaccatagtctcatgttgagcaacctgttcttttttttaaggaaaacctgagattcatgtgacacagcctggagtccctcgtgattatggattatattaacctaggaaagtgcaaagtaggaacggattatgcttcatggtttaaatttaccaacttggagtatatcctggaacaagaaaccgattaatttgccaactaattaatcggcatctgtttagtctaaatctcacctcgatcgataaggcgaccacacacaaggaacaagaagctcctttgggtttcttgctttcccactcgtcttgttgtttatcatttctggccatgtcggcatgctggttcggccgaggtgttatctagtgcttggctgtttcctgctccatgatcacgagcccctttcggtggttagtgttgctgatactgcaattaatcaccattgacacggcttcaaactcttgagccatgcattctccatatcttttttcttcttctttttccagcaaattaaaccattagtaggagtattcaattggcctgccgcccgcgtacgtgtcagatttcagtatggtcctcgtggaaacaattattgcaaacatactactccactgtactgccatgggacagctcatgacactatcaggaggcactcttaaaaatactcatgtttgcattagagattagataagggttcttttgtgtttgtgcaagttatggttgtaggaaagaaagaaagtatttattctcgagataagaaaagagaaagtatttatgaaaaggaataaaaacactgcaacaatatagaagctgaagaaagaaagtcattggtagtatatcctgtagacagttgcaggcagcaattgcaaaattcagatatgtcaagaagagacagacgatatgttcagtcatgatgctgactttaattttgctctttttttcttcaagccataaatggtaaaggtggcctaaccaaacactccaaatctaacactcaataacgtttcttgttcgtttttgccttgggagtttatgtttcaaactcttcaacaacctgttaatatagtgaggtggctggtccggttttagtcgatctggtgaagaaatgctagatgtttctgttacgcagttgcatgaagcaagaagcaaaaatatgcttcccaagtttagtcactgtcagtactgtatgacatggcttagtactgacagagaagagaacaaatcaaggttggaccaatgttctgtccaatgttgagtcagtgaacaaaagtcaacacgaaactatgtgctcctatttattcacctcaatttatcattctgttcatgatttagtcagtacaataatttattaaaacagtggtccttattgatgtacacatattacttcatgtttagacagatgtacacctatgatttaatcaaacatggatatcttaaattacaatataggttactgtcttgttcatggatcatcaaattttcaaaaaatacaggcatcatcaagttgcatggatgaatacaacttatcagtagaatgcaatccatgaatctcatttcagcaagatgcctgtattttttgatccatgtcactctcatctactgacaatacaggcatcatcaagttacatggatatatccatgtcactctcatcttgtcaaaaaatacagtcatgtcagtagaatgcaatccatgaatatcatttcagcaagatagtaaaaaaaatatatgacaagtaaaatgtgctaattaattcgaaaggtagcctgaactcggtgtacagttcagattctcactgaattggaccagaattccactgaaatgttcttcagataactgaaatgcttgacgacctctctgaagaaacttcctattttggatggaaattttcaggtgcacatatcagcagtaggctctgacaagatgagagtgacatggatcaccggcggcgacgcgccggccaccgtggagtacggcacgacctccggccagtacccgttctcggcgaccggaagcaccaacacctactcctacgtcctctaccactccggcaacatccacgacgtcgtcatcggcccactgcaacccagcaccacctacttctaccgctgcagcaacgacacctcccgcgagctctccttccgtacgccgccggcgagcctccccttcaagttcgtcgtcgccggtaagcttagctgcactgcatgtgttcgaatgcttgtgtgagcttcgtgacatcgtgtttagttcattgtcaaaagaaaatattgacgtatatggatatacattttaagtttaaacgtagactaataacaaaacaaattacaaattccgattgtaaactgtgagacgaatcttttgagcctaattaatctgtcattagcatatgtgggttactgtagcacttacagctaatcatgacgtaattaggcttaaaagattcgtctggcgatttacagttgaactgtgcaattagtttttctttttttgtccacatttgatgttcatacctgtgtctaaacatttgatgtgacggaaaagttgaaatctagacacagcactgacatgtctctcatggcggacgttccaggtgatcttgggcagacgggatggacggagtcgacgctccggcacatcggcggcgacgactacgacatgctgctgctccccggcgacctgtcgtacgccgacctgtaccagccgaggtgggacacgtacggccgcctcgtggagccgctggcgagcgcgcggccatggatggtgacgcaggggaaccac

SEQ ID NO: 25026 - DNA, 9236 bp, Oryza sativa
  unsure (1)..(9236): unsure at all n locations
gcaccggtggttgcaccgcgacctcgccgccgtcgaccgcgccaggccggcgttcgtggtggcgctggtgcacgcgccgtggtacaccagcaacgaagcgcaccggggcgagggcgacgccatgcgcgccgccatggaggagctcctccgcggcgcgcgcgtgaacgcggtgttcgccgggcacgtccacgcgtacgagaggttcgcgcgggtgtacggcgggaaggaggacccgtgcggcgcggtgcacgtgacgatcggcgacggagggaaccgggaggggctcgccgggagctacgtcgacccgcagccggcggcgtcggcgttccgggaggcgagcttcgggcacgggaggctggaggtggtgaacgcgacgcacgcgctgtggacgtggcaccggaacgacgacgacgaggcggtggtcgccgaccaggcctggatcaccagcctcgcctccaacccggcttgcaacaagtgaccccatcaatccatcagaaattcagaatgtagcagaaacagatttatgaattatataattatataagttaatttattgcattgatatcgataattagaaatttagcattagtacttctacagttctatgtatgttagaagatactctatctgtcacataacttagaacgagatgtgagcctctcatactgatttgtttttcttatgatagaaacccaaacacgagttaaatcattagcgtatgatcaattaagcattagaaaaaaacaaaaatagattaatataacttttcaaagtaactttccttgagaaaattcttacaaaaatcacagtgcttaacaatttgagaagggtgcacgtaaaaaataagagagtatggttaagagagaggagtatagaacacactatccttatataaaaagttttgaaaatctaatagcgacaggcgcaaacactttttcctaactactctactttcttcaattctataattcttgacgttttagacaagattaaagtcaatgtttatgactttgatcatcaatatatttaataatatttaatttaaagataatataacaacatatacaaatttatctatcttacggagtactataattaaaaataaaaataaattatttattacatatatgataattaaaaaatatagtcaaaatatattttgaaaattatattaatacccaaaacgtcaaataattatggaacttgaggaagtaacaccgtaaaatgctgataattaaattacttgttgcaatctctctctgtaacgttcattccgagacgaacggagatggttaatgatctcgggggcgatcattgagaaatggcaaaatactcgctataataacgaaactggtaaaccagatcgaggctcgcaaccggcaaaccctaaccctctcttatccctgccgccgccgccgccatcttctctcatccatcgccatggctgctgcagcccgtaattaccttaatctggattttgacgtttccgatacgaaacctctccctgactactgcttctcagaggcttcggaggtgtggagagctcattctgatcgatcggatgaggaaagggaacaggaacaggctgttttgagggtaattaattaaggatatcgaagcctccaagaagctttaatttgattttctttgctttgattgtgcctgcatatatacacgcacgtatcttccatcctccgattctttaattgcatatattacttcgtatgaatacatgatttttaattgtactgcatttctttctgatcatttttgtgttccattctgttacgcaattggtatatatgcatgatctttcttaagatgcttgtagttctacgaagagaaggaaaaagagctggaggcaattgacgattgttctgaagccctaggcgacgtggattgtgatgatgaggaggaggaggaagatgaaggaacatgtgaggtgatgatatctactgtgtgacagtctccatttgcagcacagtttgagattgatcactattcatcattataataattaattcttggcttaattggttgcatctgttcatcatctgcagctatgcatgaatgaagggttggcaccaagcccgagaaaccatggcgagcacttgtgcccagtgtacctggagatggtaaatcagcaaattctggaggaaataaaggatcaagaccttcacaatgtaagtattcatgattagttcgttaagtttgctttgtcattttttttcttctgattttagtggctagttcagtgtcacacgttattcatattgacagaaacgatgacattagattcttctgtttctacgatatactccctctgtcccaaaataatctatgaacttattaaaggaataaaaaaaagtagcctccacattcgctctcacggcttagaaattcccacattaatcggagaaaaagaaaaacatagtccatatagaaatacaatttataaatagttaaaattcagaattaaaaaataatgaatattggaagaggagactagagtccatatagaaatacaattaagaaacaatagaaattcgaaattaaaaataaggaatattaggagtagagtatagagtacatatagaaatataattaagaaataatagaaattcagaataaaaaataaggaatattagaagtagagtaaagaatccatataaaaatataattaagaaataatagatattcagaattaaaaataaggaattttagaagtagagtatagagtcaatataagaatttaaaactaactaaaattcggaataaacataataaaattaaaagtagagtttagagttcgtataaaaatacaattaacaaataactaaaattcgaaatttaaaaaaacatgggaagaagagtctaaagtcaatataagaatacaatttagaagtaactaaaattcgaaattaaaaattgaagaatagtgaaagatgagtttagagtcgtccacatagaaatacaattagaaataataaaaattcataattgaaaataaataatatcggaagaagagcctggagtccatataggaatataatttacaaataactaaaatttgatattaaaaataattaataattaacacgtatataaaatacaatatgaatattatacattagtagtttcgtaaagggagtacaaaatttaaaattatgttgttattttattaatatatttgaataaataattgagaaaacatatatgttattatatgacaggaaatataatgatgctagccgcgtaatctgtgcgagccaccatactagtttaatctaaaataagatggtgacgtacgcattctaatgaagttggtttgaaaatcaaattaattattggtatatggtatattgtacatttttgtgcttttgtgcaaaggaggacaacaatatttttgaacgttttggagtcatggttgactgggaggatgaggacgaggacgatgatggtgaggaatttgaagaaatcaacaaggtaatttgatttttgtgtccagccagtgtaattaaacaacagcatatcagtattgtgatttaaattagtcgttaacataatagattactaactaatatctgtaataatgttagaagtttattcagcttctgggtcatggaaatgaacttgctcgtgaaataatggatggcgcccccgctgcttgaggcgcttgccactggcggctgcagccgataattgggctttgagttattgggcctaactagccaaggcccaaggagcggaatgcatgggcttcgatgggaccggcccactttcgatcccctgctttatgctccagtttcgagcaattcgtgtgttaaaacaacggttaatgtgttcaacggtgtattgcttgcttgtcgcctgcttgtaggtctttgcttctggtggtacaatttcgtcgatttatgtgctacattatatgcaactttatatgaaacaatccaattcttgcacaaaagatttccagcacatcagagcctcaatttattgaggccacctttggaagagaggatatatatcattaagagtaatttcacataaattaaattagttttaagcctcatttgaaacaaatgaaaaaccatagaaatttcagaggattttatcccatagaaatcttatggaaccatttgaaacaaataattgtttcctaccaattccttcaaaatttcaatgaaatgaaacattctagaataatatttggagaaaaataagtataaggaccatctcatgtttttctcttgtgtttataattcctgttttttcatttgtgctaacgttttaaaacttttcttcatttcaaaatcctatagaaatccaatgagtatgacattcttctttattcctattttttttcctttatctgtgtttctcaatcccgtgttccaaaagcctttaattaaagaacttgctactactaaaattcatttactactacagtgcatgagggtaggtttggcacacaggttaggtcagacatgatgatagtcgaaactgcagcccgctagagtactgatgctgagctcacattctctgctcccaatgtcctgcaccaaaattgacattcctaactgccccagctcactcatcacggtgagagcaagttcaatagtatagtcaactactagcttcaatttatctataaccaatttaatagctcattcatacaataattacatattacactattaatatctagtcccacctattatagacacactgcgtcttagagtctgtgctacagctggctattaatttgtagcccactgctcttctctctcctgatttatcttcttaaaatatgtttgtagctgacttatagcctgctattgtacctggcttactgacactgcaacactgtgcaagcttagctgtgtttgcaggacaaccatttccaaggcttgttccatcctgtccctgttcatgttgctgtcacaaaaatggagctgctcctacactggagtagtaggcatgatcatttcctgtttaccaaatgcatgccttttcagaggaagatcacggcaactcacactccagtttcgctctgtccgtccgtcctcctgaccggagttgtacacactgtcactgtgcccatacggatgcaggatcacttccaaaagtcaacacgtcagatcagacttgaagaatccaaatcttgaagccaggattattctgcaggttgctgccaatctctcctgtaggagtatcttcgttttaactgcagtgcaagatgcaggggctgtgtttaggccggtcannnnnnnnnnnnnnnnnnnnnagtttggagaaagttgaaagtttggaaaaaagttgaaagtttatgtgtgtaggaaagttttggatgtgatagaaagttgaaaatttggggtagttgggggtgaactaaatacggccagggtgtgtttagttttacatcaaaattggaagtttgaagaaaaaattggaaatttacgtgtatagaaaagttatgatgtgatggaaaagtttaaagtttgaagaaaaagttagaaactaaaccatcatgaaaacggcgagaagaactgaaaattcaggtgatccaggaggaggaggaggatcacaagtcaaaatacacaggaggaatacaggagccaaaaagatttcattgtatcatggcctcacgaaagacacaaagtttgtaaaggactgtgagtcaaaaacctgagtcaaacacagcctaaatgacaggttgaaaattttaggcatcttaaagaacagtaaacagaaggccatgatgcaatgtttcacatcagatcttggttccgaggagatgtgccatgatggtcgttgctgctgttactactcctactccatactagggtcattgacgaacagaagacatgcacttgaatgctgcctcatcatttgttgatgccttgggacagtaagagatctgttgcaaagatcagcaaagagcatttcgagttggaactaaaactcaacagtgtgttaaatgttctgctttctgttttgccgtcaagctagctgctacagtactacccataggctataaaagcagatacaatagcaggctataagccagctataaatatattttaaaaagataaaaaaaagagagagaagagcagcgggctacagatttgtagccagctgcagcatggactttaagacgtaatgtgtgtatgacagatagtaccaggtattaatagtatagtaagtgactattgtacgaattggctattacattggctatagatgatttggagctaatagttggctatactgttgaacttgctcttagctgcctgtggtttcatcattgaacagtaaataggagtattaactgttaggatgggcattgttcagcctctagtcaaacttgatttgaaagcagtttcaatttcacggtaggatttgtttcactagtgcaggagtggtgctgtgtcctgcattgttcatcggcaagctgctcctagagtagtttgccactgatgaagtattgatgttttggccataaaatgaggaactcactgctaataccagagtgctagtatctgcataatgagggtttccgatatgtatgtgaataaaatcatactactgtatatatgaagcatgattgatagactattcaaaacaaaatcacagcaagttcagaaatcaagagttgtgaaacctgcattgttcatcagcaagctgctcctagacagaaattcaacacatctcacatcaagttattgctggtactagtactcatgatcagagagagtaaaggcaatctaggatgtggaagaagaagaagaagaatttccaagaagaagaatttccatcgattgcgtatctttggacggaacgtgaactgcgtcatcaattcatcaccatcatgaccacattttcttgacagctagctactcctccctcctttaccacagagatcgagttaaggccttgtcccttgtgcagttcagttgtgcctgcatttctgctgttcttctgcaggaaagaggaatactgacgttactctcctccgatccatgcctataaatacaggcacccccattcaaacccaaactccacagcacaaagaagccaagaacaagttccgtttcaagttctctctcgctactcttcagagattagagattttagaggtgatacttacaagcatcatagttctagctagtattagcatgcaaacatcttttctgaaatgatcgaaattcattctgactataaatgtttttgtctgaatttcatttgttgatcgatgctgcagcagaagggaaggaagaggatcgatggatcgggtgacgaacctgtacctggagaacctgtgcataatgcaggagaacgagcggctgaggaagaaggcgcagctgctggacaaggagaacaaggcgctcctcgccaagctcaagctcaagaacaacccctccaccgccgccgccgccgccgccgcctcctcgccgtcgtcccagcagcagccagacgccggcgcctcggcggccgccagcgtcgtcaaggccggcgcggcggcgccgtcgtcgtcctatggcgggaagaagaccaagtgatgcagctagctagctcgagcatgcatggagatgatgacgtggatcttttgtaattagttgcactagcttaagtacattagcatatttgatgttactagcatgcaatgcatcatggagcattaacgatcgagtgttagatgatcaccaggtagccagagcagcgtcgttttggactaattaagctagctattagctaagcttgcagtgttttgtgccagtatttgctatcttcctgctgcaagtatcatgagatggtcaatgtgctaactccagctctagcacttccagtctagtatactgcgtgctttgcaccttatggaagtgaaaacctttatacgtacttattgttcttcaaatgatggataacctacagaaatggtgtaactctacttttagatttaacacaaaatgcggtcttaatgatctatatgcggcattctcagccaaatgtttcagcgagtgagacctgaaaactgcaagctagctataagtacttctacatgtgcataacaaacaggccatatgctctctttctcaaaaaaaaagaaaagaaaaaagaaggccatatgctcgctaatgctaactccagaacttcctttgatttgtgcaccaatgttgtgtgatcgactgatcgtaagcaggagtactgacacctgatcgactagctttgagagagagagagacctttttattaaaaaggaaattacggatacctacaccattggcactgtagggcttgtttattttaatgtcatttttaaccatgctatttttagtaaagttaaaaaaaatattgtttactttgttgttaaatttggtaaatacataagaaatcctgctaaaattttagcaatattgctatcttgctaaaaatttagtattgccaaaacttaataaggtttattttggctataatctgaacagctcttaaaccctcggatcttacacaaatgttgatctgtgtgcaacgtttctcacacccatgcaatgtttcatagagtgagagacctgcagaaaaccgcaaggtgcaagctagttttggccatataggagtagttcattatcacttcgtcctaaaaattaactgaaaaggatgaattctcattaccgtttttgcaagaaaaaatgctactcgatcagagctataaaacaagacattacttaactgtcgagattattttggtattagagccacggtcctgtagcaattttggtcgcaagagataatactccatcgttagagcatctccaacagcatggctatctcactcttcaaactaaaatttagcaattttaaattaaaaaaagactccaacaaattagctatctcacttttcaagctatatgactggccaaactgagttccttgctggccaaacttggccagtcaaaatcggctggccaaccgcggggcccacaccgtttctcttccccgtctctctgtacactccgacgccgccccagccccttccactgacgagccggcgtctcctctccccgcctcccctatcgtcccccttccgccatcgcccgtcggagcggaaacaacaacgataacgaagatgatgcccctctgtgcagcggtggcgacacatcccagctccggtatagcccttccagtgttgccgcccgtcatcttcggcaacgagacgttgaggatcggagatcgcaagc

SEQ ID NO: 25027 - DNA, 4306 bp, Oryza sativa
agaagaagagggagagaaaaaggaggaagatggtgtatcagatactgacgtgtggtcctagtaagtgtagatggagatgttgttaaagcgataaatgagtttggcttgataaattatttgaagagctggttaagtgtttgaagagtccgatttagaaatgttgttggagatgctattagttcttaaaaaaaaaactactgttgcaagaactgcagctagtaggcacatcatcgcacgatgcattgcaggcgacgtcatctgctgcactcgagtgaacccaagtcttatcgatcccccgtcccatctacgagatcatcatgcatctctctgccgcacacagcttaaattaatcactcttgtgacatgcatttactcgatcgtgctatttccaatttcccaagctctatccacctcaaccaacacaattgatattgagtgtgactgatagactgtttctcctctttaaaaccattgggggggttaatgcactgtcaaatgacaaataaatgcacattgtacgacgaatatataactatcatattggtattggtaggttgtgtctcttttgggctgaaatacaattataaaacaaagaactgtataacataaaaaataaccacaagaatggttgttttaatactttatccgtcctaatacaagtgcacatagtataggagtaaaaaacattgtaccaaaagtttgggtttagatttttctgaaagttcactctctctttttttccctgaaaatatggaagtaaatttgggaaattatgtgggtgtagggagaaacccagatgaagataatgaccacatatatatctagaagttttggtaattctaaaatttttcacactaaaagatcatatcagaatttggtaaggcttaaaatcaaatgtatccaacctactaaaatttaataacactaaaatgtattaaatcatgattatggttcaaaggtgaataagtccttataattataaaattataagggtgatcaacaaacatattgttggtcagaaaacagaaaaccacttgggccacacgtgcgggctgcactgaggaagtagtttcctctttttctcaatctcaggaccaagttgtagagaagatatagattaaaagttgcattaaaccaggatcacactaacaaactacgtcatgtactcctcatcaaacacgataagactcttcatcaaacacgataagactcttctaacataactactccctacgtcccattttaagtgcaacaataaatttccacgcttaacttttagtccgtattattttttataattagtatttttattattatgatatgataaatcatgaatagtactttatacgtgacttatgcttttaatatttttaaaaagtttttcaaataagatggacggataaagttgtgcatggaaaatcatggctgcacttaaaatgtgattgaggagtatatactttctccatctaaaaaacttaatctagatgaagatgtcaccctcatactataacaaatctggacaaccactatccaatttcattagaggtggtgtttgaatctcctgaagataaaaataaagataaagattaagtgtttaacgtaaaacgaggtcgtaataacgtgtgatttatttagttttaattattacaaacttgaaaaatagattagtctgatattttagagcaactttcatatagaaagttttcacacgaaacacaccgtttagtagtttaaaaagcatgtcacgaatatccaaaatttaatcctgtgcttacaatagaaacgaataagacctaaacatcatagattaagttttttttttaagtacggagggtctaagtcagatagacgtgtgtctctaaccccgcaggattcacctcagtttctcgccaaggcatgattatccagtcaaagtataatactcgtccctaatcgattttaaatcgaactactactactccgcaaaaacaaggctcaattagtagcaaaatgtttatcaggtaggcagcctactatgccacctaacctaccgtcgccacccttcctcttcttttttttttttgaacggtcacccttcctattctcaaccaacgtagaacaaacttaaaccaccttgatcgcattcgcattccatcgccatcgatcgatcgcctcctccgcacgcgcaacggcaagccggcgagctatatatactacatgccactactagcaccatgaaattggcaatggcaggaggcgacggagtgaagggcgccgccgccgtcgtcttcgttgacgacgacgacgacgagctgttcgacatcgacatcgccttgctcgaccgccactattaccaccaacgacgacgcgacgacgacgatgaagctgaagacaaagatggcggcggcggcgacgctcttcttgccaactgcctcctgccggtgagctcggtgagcaaggcggtgcccgtgacggcgacgacggcggcgagctcgtcgtcagcctctaccttccttccgcccgtccggtacggcggctccaggagtatgctcctcttcaacggccccggcggcggagggaggaggctagtgcggagaggcagcaactcgtcggcgaggttttggctcgccgcgagaggactcgacgccgccatgggaaactttcagaggtactagaggtcagctgaaacgaacagaatcgaacaagtcaacgagtcaacttgtggagcccagtggtatatggcccttgtgggcccaattaccgcaggcccataaaggttcggtttagtagcacaaaagggcctgtatttttatttgggaataagttcactttaggtccctctatttatcgctcagtctgattttcatccctaaaccgcaaaaccgggtacgactcatccccaacttacgaaaaccgggcaaacgaggtccctcggtggttttgatagtggttttggctgacgtggcgcatacgtggctaatttgactcggtcttcatctgacgtgacgcttacatggcaatttgatcttaaaaaaataataaaactagtgggacccacatgtcagtttcacacacaaatagaggaaaaaatggtgggacccacgtaggccccatatgtcatcctcactcctctctctatcctctctctcccctcttctctctatcccttctctctctccggccgatggagcagggcgggcgacgggcggggcgggacgtggccgacggcgggtcaggtcgcggcgcgccagccattctcccgcagcgcctccttcttcgcggggagggcggcgaatctcccccatcgtctttcggattgccggcggcggcggtagctagccccgcccccgtggtgaggtccgtcccgccggatagcttgcgctcggtgctccaggacttggtgtccgacgagtaggaccggcacgccgtgaagctacgacgcttgtagaggaccaataggcggaaggcggcgggacccggtgggagcggatcggcggagtcctggagatcgtcggcggtgagcagcgcgcacgcgtagagcccgggcctgtccttcccggagaggacggggaggaggatggccatttcaccggtcatggggttgcacacgacgagcttaatgttagttaaatcttgcatgcatgtagctactaagtgttagctatgggtttcaattctgttattgcattgtgcatgagcttccggtctatggatgccatgcatgtagtggtagtcgtgccgaccttggcgatcggaggcgtgagcacgttgttaggatcgtggggatggacatgattgtaccgcgacgtgggaacgcatccaatgcgctcacctgcataatgaaagggagagagaaaaccagaaaaggtgcagcttcatcgcaccacaaaactcagcgtgtttcctcgtggtcgcgtgtgtttccacagcttgttcgtcgatcacttagggaaacctgtcacttaagggcggcggagctcgacgacgaggcggcctttccgtgatgcgacgaggcgggagttcttgaagaggccggggttgtcaaacaccctgtcaagctcgccgccgccgaacctggaggaggccgagggcaacgggatgaaccgaggcagcgcgaccgaggaagacgagtcgtcctcgtgggtctggtggaagaagtcgacggcgaggtcccggatgaggtggctggaggccggcatggagcggcagatgtacaccgcgttgccggtgaggtggtgacaaggcggcgccaccgcctacaagtggcgcggtgcaccgcacgagatcgtgaagatccagcgagctaagccgaaacacgaggaggagg

SEQ ID NO: 25028 - DNA, 3407 bp, Oryza sativa
gccctgttccatcggccggaaagagaagggatagagagaagaggggagagaggatagagagaagaagaagtgaggatgacatgtggggcccacgtgggtcccaccatttttcctctatttgggtgtgaaactgatatgtgggtcccactggttttattttttttcggatcaacttgccacgtaagcgccacgtcagtgtcacgtcagatgaagactgagtcaaattagccacgtaggcgacacgtcagctaaaaccgctatcaaaaccgccgagagaccttgtttgcctggttttcataagttgggggatgggtcgtacccagtttcgccgggccgaatgggcttgtatttgtaataaactcaaatgtgtcctatctaaggaataagttcatccgaggtcccttaacttgtcaacgaatccgattttcgtccttgaattttagaaatagaatcgaatagcaactgcagcaagcagtttccaatccctgtgaagtcgtggagactggagaggggggaaggagaaaatggcgacgtgctaaccgttcgcttccggaagctggcggccgaccagatcaagggcgcccgacgccgatgacgccctcctctatggcgccgcttacgtcccgccgccccgctcctgcgccaccgccgccagtcactagtcactaccgcttgcgccctggggccccgcgcgccgccggcgccctccttgacgccgccgctacttgcaccttgtggccctgcgcgccgccaccgccatgctcccgcgccgccgacacccaatcgccgcattggtggctcggtgccctcctcaaacccgtcgccatcggcgtcgtcgtcttcgacagtggcggcgggaaagcaggtggagagaagcgggagctcgcccgccaccgcccataacgaggacgccgtcgaggtcggtgagcggcgcgaaggacagtggaaacggtggcgggggccgcgatggtgaggtgtgcgtccttctcctcgcggaggacgctgctcctttctcgtcggtcgccggccgcctcctgcacatgcgcgccgctcctttcctccctccggccggcgcctgtgcgccgcttcttatttctgccagcgagaggaaggaggagaggggagagagatgaagacgacgagagatggggagagatcaagaggaagaagatcaggggtgagaatgacttgtggggcccacgtgggtcccaccatttttattaatttgtatacgaaactgatatgtgggccccacggggtttattattattttttgggtcgaagtgccacgtaagcaccacatcaatgccacgtcagatgaagaccgagtcaaattcgccacgtaggcgccacgtcagccaaaaccacaatctaaaccgccgagggaccttatctgcaccggttttaatagttgagagacccgttatatctggttttgggttcaaggacgaaaaccgaattcgttgacaagttaagggacctcagatgaacttattgccctatctaacgagaggcctgggtaacggattacggccatctgggcccactaaaaatactcgtagaaatacggctacggtgtgtacgcggcgtcgtcagcccactcgccgcacatcctcggcgaggtcgccggcgatggcgccgccaccgccagggcggcagcggctgccctgcgacggcgaggaggacgcccccccccctttccaccgccgccggtgagggcctcctccgtccagcgatcgcttccggcgggacgtacggggcccgccgcgagcctggtgagggttttgttctcccctccctctctgacgatatgctctctcttgcttcgctttgattccgcaagccgccgctgggatccagtaatttttttttcacttaattccactcgcgcgtttcagtttgtgcgggaattcgtggatcattcaaaggattgtgctacaaattcccaccatatcatcactatatcagtgttgtcttttactgcaattttttttttaagaaaatgggataaaccgggcctctaaatccatccggatgtacgcagccgattttatgtgttacttactactacatgttaataaataataacctgcatagtagtatgcaatctggatgaatttgtacaaaaaaagaaagctggattcccatcatatcagtgttgttacttactgcatttttttccattgtgtcacatactacatgttaataacctgcatagtactactagtatgcaatgtggatgatttttgtacaaaaataaaactggattcctatcatatcattgctgttacttactactgcactttttccccgtgtcacttattactacaagttaataacctgaatagtagtatgcaatgtggagccaccaagcgacaccatgtggagccaccaagcgacatacaaatagataaaaagccctttctaccagttgggtttgtccaccagcatgaattggcttatacatgacttaaaaacattaataataacgtggtttacatattagtgcactggaatttgccaacatggctatcaatcttactgcttacaaaataatccactaatatgttcttgatacggaaagaaatctaatactaatacatgctgcaaaatgcatctggtttattcgcagatatactggctgctgatgtagcagaagaacgttgattcatgagaaagtaatatggcagaaaaggtttgatttcagagaatcgtaattttgggacaattggagctgcatttctcagcgcctcctggctgcagtctctctctgggcattgaagtagacagcagccacaggaaggccaagatcattctcctcggcgaaccggcgggtgttgaaatggtccctgaaggatggcacaattacagtttgcctgcgcttctgcttgaagagcacaaaaatgaacctatggatgccaatgttcggctttggactctcatagcttatgacctcgcgtccttcaatcggaaagtggtacagttgtttattcacaaggagaaactcaatgaataagatggaaaaaaaaactgacacaaattagaggaaggacctaccaaaagaagcatccgttgtcccaggtatatcagtaacaatcctgcgtaaatgttaaggtgagatttgctgataatttagccacattactattcatgttaagactagtcagattatgtgttgtttgtatgcatatgaaagctaaagtaattgtcctatcttccctagaaacataactaacatgtctagctaatcggtaaccacccacaagaaacaaatatatagtatttagatacaaatgttcatggttggttaccaatgaaggtgctcccttagataaggatcacttggtcctggcacatctgggtctgtcataacctgaaacatgaggagttatggttaaccagggaaa

SEQ ID NO: 25029 - DNA, 4394 bp, Oryza sativa
gtgaagtttacacatggtcagaccagatggaacgctatcgtcaactacgaacagtggctagtgaagcttttttccgatgttccatgacagaagaaagtacactgaaggtgatgaaaatgctagataatttgatgcttgaagatgactgtagtgcaaattgtgacaactttgagattcagtttggtcatgtggttcgtcaaagtatgcgcactgacattgaaagtagtgagaaagtgcttgatccagaactagttgtccctaaaggagctcctacaaagagaatgagaggtttcttggagaaacgcaagaggaaatgtgggttttgtcgtttgacgggacatacaataagaacttgccctgtttacctaaggcaagttgtcctatttgttattaacctcttcataaagctaatattgttttattcactgaaattgtaatgttactttgaacatagtactttcagtccacgaagacataagacgtcttgagtctgaacatggcaaactacatgaagcgtctacatctcaagttaccaataggatttagggacttatattgcaacactgtgtctacatctcaatttttctttccaaccatgtctttgaatctatcggttctgattgtcccaactgtatgaactattttgacaatttcaatctatcaccaccgatttattgggggaaatatataatacccatacaatgaataaaaaaccacaaaaagcaaccaattaacacacaccttatggatcagttttctccctcactctgcatgttgtgccacgcatcgaggccgctgcccgcagtggccgacgattcaccgtcgccgccgacgatgcagccccggccgcccgccgtcaccgacgaatcatagcttcaaccattgccgggctcccgccgacgaatcgccgccgccaacgatgcagcgccgcctacgcatcgaggccgctgcccgcagtcggcgacgattcgccgccgccaccgccgatgcagcgccgccgttgcatccagaaaagtcgcgtccgctgtcgccgactaatcaccaccgccaccgatccagcgccgccgacgccggccgtagccgtcgaatcgccaaggcttcccgatttgggccgccatcgctcgcccttggcattaaggtttgtttgtctcctgctcctgcccgacgaatacgaggctctattctctcgcgatacagagaaggaaacagataacgcgaaagtacaaaactacccttccacacacggtactgttgtgatacgtacgtgcggtacgacgaggtaccatcgattttggaccgtccgatgaggccagatcaatggtcaggatttggtaaggatgggaaagatgctcttataattgagggtcgaaaactaaattaaaccaatccccaaaaaaaaaggtgccatctaatcctcagcaaccacaattctagctggagatcggttaagttcagttgcaatttttggacgccgaagccaattcaaccagagttaactgctaaatggcattcccaattgtgagaaaaatattatactgctagtttccatcacacgatgaatgggagattctccagagtatcactcgcatccgccactaataattctctaccaaattacagacaacgggagatacatttcagaaagggcgatagaatttacttacgcgtgggcgcgcgcggcggtatcctgctcagggaagtggtcctcgatggcagccgtagccggtgagctcgagctcggacggcggcgccggcgatgggagtccttgacgtttgtgcccaagttgccaacccacgtagaagatcacttccccttagatcaatacaggggtagctccggcggagactgcaggcggcggaggcggcggtgatggaacgggccggactgggtcaactgataccagtagtttaatcgaagcccaacatggccacgtgcgtgattacaggctactggcccagaacatattgggcttcaagcccagtacacgttggtgtctttctaggataaaagaagtaaagaaggaataagtttatttgtcatccctcaactttacgtcgagtttgattgacatccctcagcggtgattttgcttcacatgttcttccgaagcaccgcaaatgtccccaaatactgcaatacattgctaccctgcataggacatcgcaaagcagggcattgcaaagtaaacttacatctacaaatattcctcagtaaaacggcattgtatttgtagatgtaagactaggctaaaaacaatggcaagactaggttaaaagaaaaaaaaaactcctgtcttttgatcgggaaacaatagggtggtaagcactgaaaacctgatcactgatcatgatgccctctgtgaccctgttcgttcgtccatcttgctcccgacagctttgtattaaaactgtaaccctgtgtcgttcgtcctttgttcttcttttccatggcgcgtcgcatgatcaccgtagctgcatttggctttagcttacccagctagcatctgttacaactttctctgaatatataccatatcctctttgcctctttgcagcatatgctctgcttcatcatctttttccgctgtaattaacctgaagaaacgtggctggagatgatgcagacacgctggtttcatctagaagtacgcacccagccagaaacgaaatctgaacaaacagcagctgccagtctgccactgcacggtagcagtgtgtgacagtgtgatggatactgtcgtgcatactgatgcggtgcaaagcgaaatgcaggattccatttagcaatgatcgccactgcattgctcctctcgccatattctgtcgcccggttgccggacacccacaactgtactcactccgttaaaaaaaaacgaatataatattagatatgacatattatcatagtaaaataaatctaaacatgttatatctggttctagattgattttatagaacgaaggggtacgtatcagtagcatttttttattaagatatagagtacatattttatcttagtttctattaacatgcttttaacatgttaaacgatgtttttttataaaaaactttttatatagaaattacttaaaaaatatcaaatctattttttaaatttataataattaaacctcaattaattactctcttcgtctcaatatataaatatttttagcatagtgtcaagttaaacatttttaactttgactattaatagaaaaaaaataaaaagatcaatcatttaaaattgatgttacatgatttatcattaaacaaactatgataatatgcaactcttttaatttaaaacatcttatttttacaggtattgttggtcaaagtactatctcgaagactatattgaagtctaaaaatacttctattttaggatggaggaagtatatgtcaatgaatttctcgttttgaatgtgctgtctttatcttcattttaacatatctcaaagatagcatctctgaactagcatcatctcattactcttcctataaattggttgccaaaactcaaatttagagttgatgtttgggagttcttattttccatgtggcttacttttcggtgttaactcaattttaaactacgaataacacaggttaaaactttttatttgtttgttcatatgtcattttacagtttatctgttgtagactgaagaatatttttaagttttatccacaaattattattattttattgcttatatgcagttttacggcctgtcagcggtagaccggaagaacaaatcttactagtaaaaagaattcataaatacaactcaccactgagcaacatgtttcaaagttcataggaattttgcggggttacatgctcgaaaagtccaaatgggcctaaaatatttgtatatactagtatagcactatggagatactcgttaataagttcttttttggtgagacagtcaccaaccaggcaagtgaccacgttcagacaaagtcagatacgcgcagcaataatttactcccgtccggggggacacgcacccggcaactatttggcgcgacagcgcggcgcccgcgtgcgcgccatgccagttcggttcgccgccgtcccgcgtcccccaccacgtgcgccggcaatggcggcttcctccctagctttgcacgttcatccatggcagcttcctccattgggatagcctgtcttgtcttgtctagtagtactccacgggtgtgccggggcagctgtcgtcgtcgtatgacatgtcagcgttcgcggcggcggcgttcgcggcggtggcggtggcaactctgaacggcgggggaacgtacggaggcgtggcgcaacggaggagcgcccagttgacgccgctgaagaaggggtgccgcttgatcaccgcggcgccgacggtggcgcc

SEQ ID NO: 25030 - DNA, 7799 bp, Oryza sativa
ttgcgcccgcgccaccggcgccggcggtggcgcccgcgtcctgggaaaagctggaagcacgacacggcggggacaatgcaggacgggatgatgcacgacgaggaggaggaggaggaagactggccgccggcgagggcgatggggtcccagatgacgtgcgccggcgtcggcgccgtcgggtcgcacttgagcgagaggtcgaagtcggtgagcatgatgtggccgtcggcgcggacgagcacgttctccggcttcaggtcacggtacacgatgtccaccatgtggacgtactccagcgccgccaccacctccgccgcataaaacctacgcaaaacaacacattatcaccatcattaacaagctcccaaaactaacattaacttttgaatcgtttagcaacttctagcatatgcaaaaaaaaaaaaacaagttggccatggaagataaattccattgaaaatcttaaccttcacaccaaatttaagtttgtgttattaaattaagcattcaccaaacatttttgcttttagagaattcaccaaccaattcttaggctgtgtttagttctctttaaacttccaaaaattccatcacatcaaatgtttcgacacatgcatagagcattaaatgtggacgaaaaaaacaattgcacagtttgcatgtaaattgtgagacaaaacttttaagcctaattacgctatgatttgacaatgttgtgctacagtaaacatttgctaatgacgaaataattaggcttaatagattcgtctcgcagtttacaggcggaatctataatttgttttgttattagtctacgtttaatacttcaaatgtatgtccgtatatactttaaaaaaaattgaaatggaactaaacacggacttaacaactttgcaactgtatacaaagcaaggctattgcatactgcaactgtatctgaagcatggaagtgaatcccttgactttattcacatgtcacctcaaccaacccacatatttgtgtatcaactaacgacaaatccaactgtatcaactatcagcactatttgcattgatacacagacatgcatggatgccacagtgtgatccagtacaacaaaggaaaaggtcacaagggagcagaggagtgaaaaggtttcagacagtactcgaactagtgcatcattgatgttggaggtttgcacgttccaaagctgattaggataacttaatggcataaaggggatgcagctcatgtgtgtgcactcaattgttaattccttgggttaattagattaatccttacagcaagtaccatactggctactaggctactaccccatgttgatctcgactgaatccatttattcataggctcgtatggttggctgtgattaacactcatcacatgggtgttagttaaagtttctctgaccaatggcatctataattctctacttatgaggctatcagagagtgatttatcatgttctccgaacggttcttgcgccgtagtgcaagggctttggctcgtgtcacacaggcattagcacaattaatctacctgaccgtgcggttgattgcaatgttgttggtcctaggtaggagtgtgctgtgcttgtaccatcagaattcacaattcacaaacgccgttgtaaactgctactgctcatctactggtacaagtgtacaattatccccccgtaaatagcgggattggccattgattcatcttggtaggaaatccgtgtcatgcaattctgtatttgaggccgtacgtactacaactcgtctaataaatcaattcttgaattcatggatcgctttgtactgccaaagtgtcaataacttcaaaaaatatatatatgttggtctatgatgttgtggtgtttttgttagttggtcttagattctagcaacactgttaatatattgtgaaatgaagaaaaaaaaataaaacattggtaattggggatgatctggcaaagcatgtaggttgagttgactacagctctgcaggtgaatgctatggccggactacttactagtctgtctaaatgaatatagccacatgatgctgtaatggagcaaacgtaaccgaataattctaccagtattttctatcagtacacagcttagtaaagttgacgtgtttttgtctcgtaatctctggcatggcctacatcaaagatattgcacagggaaagtacggcggagattaattctgtgtcttaagtttattctggaaggaaattactacgacatcagtatctgtgtatagtgggaagataataatattggcaggcagtgatcatcatcgatctaagaggcaagtaaaaaattcagatttgtgatgcaaattaagcagcctaatttcctgcaagggacaaagactgcaaactgttcatgcgacaacaacagcttgacttccatatgaacagtcttagcttcagaaattcagaaggccactgcagccacaggtgtggatgcacaagcaaacacaccaataccaatagtgattagtgagtgattgcaaggtgatatgggcgtgcgattgtgtgtttgaccgcggtgcggctcacgatatggcacgaaaacaagaaactgtacagtgacagtgacccagtgatcgagctcccatccatgatgctcaatccttcacaatgtctacaaagatgcttttttttttcctttttctgaagaagaaaatattctcctcctcataagtcagattcatgcattaatttgaggcactcttaagtgtaatttttttggggttataaaagaatgaatccaaagggcagctatcatcaaacagcattatccatgttgttatgatggaacacaattctggcaaaaaaaaaaaaacctattcgataaaaacggccgatgcatggctgacagaagacacacgggccaaacaatgcacagaagaagtacagaacaagtgttgcttcatccactactagatcattaataaaacaaaatataatttatacgaaaaggaaacaggaaaagaaatgcagataaagtgaaaccaaagtcaagagaaatcgcaggaaatcagccacattcttctcccaaaagcctaagaataagatcaatcactaccttactactccagctacaacttcagtcacagtccacgccttaaaaacggcataaaaaaagtgatttgatcgaacatttttactagcatttaaaaaaattataaattaacgatgtggtgatcgatcgatgccacagaaatcgagcagttcacaaaattgtttcaaaaaagaaatcatttcatctgggtgagtgaatgcgtgcacaagacaagcggtggtggtgtacctgacggcggactcggagaagcggcggtgaggctggcgctggcggaggacgtggaggtcgccgccggggcagaactcggtgaggaggcaggaccagcgatccccctcggcgacgcccaaaagccgggggaggaaggggtggtcgacgccctcaaggatctcccgctccgtgcgggcgcggccctccttgttcctcccctccagctccttcctgtccatcaccttgcgggcgaccagcgccgtcgccgcgcccctgacctgggcgaggtagaccctgccgatgtcccccgccccgacccgcttgaggaagcgaatgtcgaagagcgcgacggccccaagccgggccggcgtggtggtggtggtgttggtgaaggtggtggtgccggtgaacccggtgaaggcgaaccggaaccggaaccggtcgaagaaggcaaacctgaggctctgcagctcgtcgccccccggatcggcctcgccgccgggaggcattgcaatgtgctgtggtgtggtgggtggtgttggaaatggcggaggcagagaaggagatggatgggttggtgcgttgcgtttttaatttgaagcggagaggtgagaagccggaggttgacgacgatgggctgggccggatcatccgcgtccgttccgcgcttgattttttttttattttgtttttctggatttccgggcccctgttctccgggatgtgatcaaggaacaccaacattgctaatttgcagcttgatccgattattaaatagatatttaactatctttactcttatacgcgtggtatttaacaatttaccatcagacccacatgtcataaatacataaggatccacttgtcattgacatatgagcagtgacaaatgcagctttaaaatatagatgggacggagaatagagatgttcactccataagagcaggtataatagctctattaagttggcttcaaaacctgataatcagcctaatctgagattagggaaagaaattcaccaagaatgaaacaaggcgcttgttttagcgccggcgcttgcatagcgccccacaccatatagctcgcatgcagccaggagagacaataaaaaatatgttatgtgggtcccaacagctgatgtatccatacaagtatttaatgtatgtatgctttaaccaaggcagctcataactaacttgtagttagcttgttgtataagttagctctacttgacatgacaaaattttagagcttgctgctagctgcactattaatcttgctctaagagcaatcgaacaaaacacatatcgtatttatagtcaatcgcataattatctcgatcattgtttgtggcgtgtgtatgttttgaagaaacaaactaatttgttggacgttcacaccttgttatacctaattttgatagcccatgactgctataaaggggtagggggtcttggggtgtagagcgatacgggttgtagctgggtcggtcgatctactctgcctaatgggtagatccgcccctgcatatgagtagcaaattgttaaacgtcaaattaaaaagtgataaatagttaaatgctcaattattaaatccttgctcaacgatgaggagtttttcttccaaatacactcatctcatcaaaataaaattctatacatacaccatattcctattaacgttttttattggtttggatatgtctgttttaaatgtctccctatcgatgtgtatgttacatttcataaaaaagaaaaattagctgtaaacgcgctgagtcgaaaactcgaactcggataggaatgttttaccataagaaagatatccaattgagctcgctcagcgcgtgaacgctgcggaagtttttgatacgtaattgcaaatccaataacgattcatggctcaagagaatggaaggtttaaggttgacgtcgatgagttcaatcaaatcaaccggaagaacattgtgcaaaaatcaaataaacaagcagaagcagcagccgcggcgaatgcacggaatctggcaaataaaggcgaaattatttgaggttggcagtttgcgtttgaaatcagacgtagcagggtacgcagccagggaggctactggctatagcaatggctgcagtttgtgaatggattggcctgcattgcgtggttggtgtggaatggattcgaaggcgtgagtccaagtgtagccgggacaaccgactggaccaaaggaagggtttgcttgagaagcatgtgatatctgcagcttcactcaaaatttaaaattcatttaaacagtgtaataatatgcagactaaaaaaatggcagtttataaatctagaaaataaactaaaaatcagaaattgcgtttttccatttttcagtttctccagattcttataagtctttttttttgaactaaaggcaaagcttgcctattcattgaatatagatggcaaatttacaggtaaggaaaaagtaatattagattcttataagttacttcctccgtcccataatataagggattttgagtttttatttacactgtttgaccactcgtcttattcaaaaaaattatacaaatataaaaaacgaaaagttgtgcttaaagtactttagagtaagtaaaaaaaaaaataaataataattccaaaattttttgaataagacgggtggtcaaacagtacaagtaaaatctcaaaatctcttatattatgagacagagggagtagctaccaactagctatttatcataattttaaactatttcaaacatgatcgaagaaaagtcctttatgatcgattgagctacgattgataaaccatagaaacataagcaaagcaaccaaaaaaaatagtttataagtaaaaatttttacatttatattcttaatggtttaaaaaccaaggctgaaaaattgaatatgatggaaaaactaatgttagattcaattttaaattttggttacgaagataagccagcaagaaaacgataaaagccgatgagctcctccccattgcagaccttttttctcttacttttcttttaaacagagtgttctaaaaatctcaaggtcccatgttaggattggcgtatcatatatttttaaaacaatgatgattggatggatgtgtcgggggttcagttcaggagttggtgtgatagtctgatactctgaaatggggtcggtttcttcaagacaaggccatatgttttacaattcagaggttcatcgatcatcgaccgatatgcaagcctcagaggacccctcgcacaaagtctgagaggatcaattaaatcgaagtcaatctattattgtctgattgtctcggtgagagtagtcttgagacatcgaagacaaaaatgttgggcaacttgcattgggctaagccacgcaggagacaggcagaatcaactggtaacaagtttgaggctgcaaattatacctgcaatgttggatgatgcttctacagtgtttgtgggggaggttgttacactccatggccgatcaggatccggtgtagttgcagtctgtaactgaactagcaccacatgatagcaaatcaagggttcaggttgatgcataactgtagcacctattcattgtagtaaaatttattaggccattttggatactaccaaaataatgtgccctaccaatttattggtagcttgaatagtaatgttggatgtttggattgtagccaataatttggggtctgttcactttgttgccaaaaaaaaaaaccttaccaaattttgacattgctaaaattttggcaacttaccaaaattttgacaggatatcttatatagttaccaaaatttggcagcaaactaaatgtagccacttttttgacaactttaccaaaatttagtaaggttgaaaatgacatcaaagtgaacaggtccttggtaatgcctcaattgaacttgacagttggcactaatctagaactttctcctctgtaacatcaaattttggcttcatgttggtagtaatccaaacatatgcattgcaaccttatcataccaaaatttaccaaagatttgatacggtagcaaaccaaacctatccattattttacgtttcttgttgcaacgaatctggactgttggatcaaaacacaaatggccgagcggtatgtagttcagacattttgtacttgaggttaggggctgtaataggcccaatacaaagcaactctgaactcgcagaacccaacccagtagtaaaataggctgaaaatgaacactacaagaacaggcaccacaagaagcccaaaagaaagatcctgcaaatttgtggccccaaaacaccaaggaaaaagtacaccgaaggtccctcaacttgtcatcgggataaaaaacgtcctcgaaccgcaaaaccatacatgcgagatcccttaactatacaaaaccggtcacccgaggtccctccgtggttttgaccccggttttggtctacgtggcggctgagtcaacgtgggacccacgtggccccacatgt

SEQ ID NO: 25031 - DNA, 1918 bp, Oryza sativa
acatgaagaaagaagcattcggattagcacattccaatttgcaacctaaatgaaattgtactaataatcaagcaaaaaaaaaaggaagtgagaaaccaaatgggatggatggatggagtactgactcggtctggcggatcttgtcgaagaaatgggcgtcgtagacaccggcggcgtcggcgaagtggacgacgccggagaagtagtgcttgtcgacgtgggcgagcgcggcgttgcgccgccgccgctcccggccgcccgaccgcatcgtcgtcaccactatcagcatccacctcgacacgctgccctcctactcctcgtcgctcacgtccaccaccgcgccgttcccgaccccggccgccttcgccgccgccgcatccggcacaaggctcacctgctggttcacggcgacgtgggacgcggcaagctggtggtgcggctggaataggagaagaacaagtagcgcgaagaaggagaacagcgggcagcgtgacgcggcgacgaggacgacggcgcccaagcccgctcgccctgcgggcgccgcgaagaacttcatggtgccaacgatctccgcggcggcggcaagccaggcgcatcgtcgggaggcacgaatcctacggggacgacggcttcccaatcttcaccgagaccaagtgcacatcggcgccgcgttgtcgccgccgccgccgccttgctcccctgctctcgtgtcgtcgccgtcgccgtcgccgccgccgccggccgccggacctcctctcccgtctcgccccgtcggtctcctccccacccgtcggccggcggcgccggcctacccacagcaccagagagaagagtgagagagagaagaggaagggagaggaggggaaagagagaggaactgacgtggacaggctgacatgtggggcccacgtgggtcccacgctgactcagcgtcacgtcgggctaccggttttatatagttaagggactccgcatatctggttttgcggtttgagtactttttttttttatcccgatgacaagttgagggaccttcggtgtaatttttccaaacaccaatggatattatggacttttggcctttcaacagttaattattgcttttataaactttgttttgaatctcacaaacacttcgggggtgtagctcagatggtagagcgctcgcttagcatgcgagaggtacggggatcgataccccgcatctccaacgtttttaaacaaatttatatttttttcctgaaatttcttaaatccattttccccccgaatcatattatctgctaagctggaattaaatttcatgactccatttttttcctcctgaattggggagttgaattgcattaattttctttattttttttctcttactagaaaaaatacttgtgcgttgcaacggacgaatgctattttaatcttattattgttatataatttagatatggtaaaattcactgtggaaattcgcttggatttttctttttttgaaaatcatgagctgcaattaggagtctggcattcatctcaagttagcatgcaagttttttaaaaaagatttcttatacgacttcttttgtatttacaaaaacaaacaaacttaaaatccgactcaaacacggatgacattccaaaatactagaaaaacatcttcaatttttataatggtaaataattgcattacgtgctaagctagaattaactacttattactagttccttttctcctggaattgtttttaaaaatttcttaactcctttttctgaactgtgaagttgaattgcattatcagttaagctggtatgcctttaacagttaaaagtaaatttcacaaaacatagattttagaacactcgtaccacaaaacccatgtattatgatttgttttgaaaaccccaagtttttagggaaaatttt

SEQ ID NO: 25032 - DNA, 5610 bp, Oryza sativa
  unsure (1)..(5610): unsure at all n locations
nnnnnnnnnnnnnnnnnnnnnnnnnnnnnnnnnnnnnnnnnnnnnnnnnnnnnnnttttaagaaaaccttatgtttaagtttatatcatttttttgttaacccatatatttgtgcataataattggaaaaaataatatgagatatttctaagtatatatacatgttagtcttattttaacgagcgtcatttattggtaatatgattaatgtttatatgtataagttaccagttaatatgttattgttagtggggttatgttgtgttttttcaatcttccaatgtaagaggaaaatgttaaagtacatgggagggatatgtattttgtgcctactaatgcagacatatactactaaaaatatcatatacaatgatgaaattatgagtatttgagataaacataagttttttaaaaacatttttaaaccagggttccttgaaacaaaccataatatctggaattatgcactacatgtgtctcaaattattttgtgaaattactctttaattaccttattactagttttcaaaaaattatataatctgtctttaattcaattaattagactgcttataatttatagggactagttttttttcacacgcaccaaactctatctaacccattccactttgatatatataaaaaaataaattctacaaaactattcgatcaaaactatcgctttactatactttaactaggcgcttcacaatactagaaacaacaacaaaaaatataaaacaaaacaacaattttattccctacatgtctatgatatgtgaacctaatttggatagcacaagtatctcatatgcgtatgacagatggacccaatgacgttggagatataaaattgtagttttatgataaaatcatatactattgttgtattgttgcagtagcccagctaaagttaaacataccggcagttttagctttatacaatttactatataaaaaccatactcgaaaaataaaatccaccatctccattctctccttactcccaagtgacacgaattacggctattttttcagtgataggtgtatccactgacatatgagacattcataatgactttattaatataaagatatatcgatctaatcttttggagatactcatactgtcatacatatatggtatactttcttcatcacataaaaagcccaatcactatgtccagaatcatctttaaaattggattcttttttgatgaagagaacatatcctatcttactttaaagctataacccactaattccaaagctcaacgtacaaacataccacctcacaatccactagcaacaattacatacaaaacttatataagcatgcaacatcatctataattcattaaaatcaacatccaatcatcatccttcacattattttcacaatatttttaacatatatatatccattattttttataatatttaatatatattcatctatacaatcaaagtgtgggatatcatattttatttacaatctcatacaaagtctactaattttatttaacaaacgagttttatttgttgttaatagctaatatatttttttacttttagcttaattattaaaagatactaaaaattacttagtaattcccgtaacaaagcgtggggaatcacctattatatacacatttatatatggtattgtgactagtgacttgtgagtgtctgtatttcgaaaaaaaagaaaaaaaaacagaaatggaatccacgcgccccaaaatgcaagtgcgcaacacacaagagcccaaatcgagagagaggagaggagagaggagtccagcgagagtccatccatccacccctcgtgacgtgagggggccgcaccgccgctcgccgctcgccgctaccccatccgccgccgccggccgccgacgaggttcgggggggcgcgatggcgtcgggggtgtcgacgagcatggtgctgacgctgctcggcttctgcggcagcgtcctcttcatcgtcttcgtgtgcacccgcttcgcttgctccctcctccgcggccaccgcagcggccgcagcgcccgcctccacgcagcctcctcccacttcttttcctcagtatacgtcgtcgaccaccaccgccacctccccccctccggcctggaccccgccaccgtcgccgccttccccacccgcgccttcctcggtgatgccccacgcggacacgcttcggcctcctcctcctcctcctcctccgacgccgccgcccagtaagtgctcctccctcttcccccgcaacgatcgcgattccccgcgtcccgtgcaatgccttcgcactgcagcattgcgttgcgtgaaatctaagcttcgaatctacagtgttgttgttgttgttgttgcggtgatgatgcttggcttagagcgcgtgcttttctcgtcggtttggttatccgcattgtggggggttcgaattcgttcttctccgggtgaatcgatcccaacgattgcagttcgaatgtgaacttggatgatattctattgagcacgtttcagttggtaggatcgagtcggtgaccgggggattgaatgcccgctgaattagggcattgtagttgcgggggcgccctcatacgagtgaggaaaaggggatctatcaactattatggattttatattatatgtttgagattttctgtttgagcacatgtcactgtcagtgtttagttgagattctcctggatgtccacttactggatgactactgtttttatgagtttaggtgtttttagatctgtgaagctcttcttcgtagtcgatggatgatactagcatagaagcatgcatctatgttcgttaggtgttcttctatgagcgccgaatcttcacatattatttgaaatttgaattcttctcaacatactagtactgagtatgtcattctccgggcggatatgccaacatgacatgattcagtttctattgttgaatgcaatagtttcttaaacggtatgagcgaatttgggttctacaaatttacatcatttgcaagtatatattgttaatgattataatagatgacctgaactgagaaacaacaattgagacttactcccttttattttcataaaaggtaatattgcctcctgcccaacattttccaatttaatgtttcgcaagcacgtggttgcctccaacccctaatatcttcttggtaaggcagtcatagataactgctacttaaaatcctgaagaaaaaacaccgccttgcaatgaagtttgaagtaccaagacgttgtccttgagtattttgattgattgtttagtatcaaataagttatcatgtggatgttagtgcctaatagaaacagtatgacttttttagtaccatagtgttgattgttgtgtttaattggagattgactattgaatcgtgagatccctgaaaactcgaattattaccaaacagctaagatcattaggtcaatcacataacagaatgcagacattaagttctgttgaataagtcgaggaggaaggatgaggcactgtcatcaagtaggttaaaccctcacctgtgcttgatgggatggaagcttggattaggttggttgtgcgatgtgtatctaaagaagctacagagatgcttctgttaatcatatattcatattggcgctattcgctatagtggttttgctgtatcaaataagaggtttccatgttgggcatcatccattgtgggattgtattttatagttaaagtgttgataaactgttgtcaactctgataaatactactagtatctgaattgtgatttgtgtttctataggtgattgttagcattttcccaattacaccaatattatattctgaatcatttccttccattgttggcaggtgtgttgtctgtcttgcagactatgaagagaaagacgtacttcgtattcttccttactgtggccacaattttcatgcgttgtgcatagatatttggttgatgcagcactcaacatgcccggtttgtagaatttcattgtgtgactaccctgatagcaagcagacaatgtctcctctaccaagtgaagtgataatacctccatgttcccctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaaattaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaaatagcttgtctcacttattgcatcccgactgatgaattgttgttgtcaacagcagtacatctgcaaaatcacaaagagaagtagctgtcaatacaatcagaaaacaggaggagggcatcttgattagttcatggatcagggtatgagaggaacacaatgtagctgtctcactcatgtagtcatgcaaaaattctccctgaacagcatcaagatcagcgaccgatttgccatcttgtctgtgactgtatctacttggaagcaagttagtcagacatcagcacagtgccattcatacggtaactgcagcagcatgtggctccaatgtcctatttttgttaagagtctgatgctgccatggtaaagtgcctgagattagttggtcaagcactcaaagcatgataatggtgggagccagcacaatgctacataactctgaatctctgatccaagatctgaagattaaagtccagattatgatctctcctctgaaaaccaaatcttgcagggccaggagaacagcctatggttgtccacgcaacgatgtcggctggcccaatcatggcctcctgctagatctaaactgtgtggctgatcaaaccagcaggcagcagcaatggttcatcacttcatcttccctgctgcctttgcaacagtgtgggggctggactgtgcagacatgattcaatcaagtgtactgccatgaaaggccttaataagttttacagtgattcctgtcggtggtggtggccctcaccggagcagatgcagagctcttcactcactcactcactcactcactcactctgcccttaaaatggtggccagcagcatggtgtgatgatcacactctcctgcaaaggcacttcacctggaggtgtagtgtgaggagagctttttctttgcaccttttggttttttggagcttcagcaatgggggaggtcaagcatctttgcctggtgaagttcaaggaagaggtcttggtggatgacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25033 - DNA, 701 bp, Oryza sativa
  unsure (1)..(701): unsure at all n locations
caaataaaggcgaaattatttgaggttggcagtttgcgtttgaaatcagacgtagcagggtacgcagccaggaaggctactggctatagcaatggctgcagtttgtgaatggattggcctgcattgcgtggttggtgtggaatggattcgaaggcgtgagtccaagtgtagccgggacaaccgactggaccaaaggaagggtttgcttgagaagcatgtgatatctgcagcttcactcaaaatttaaaattcatttaaacagtgtaataatatgcagactaaaaaaatggcagtttataaatctagaaaataaactaaaaatcagaaattgcgtttttccatttttcagtttctccagattcttataagtctttttttttgaactaaaggcaaagcttgcctattcattgaatatagatggcaaatttacaggtaaggaaaaagtaatattagattcttataagttacttcctccgtcccataatataagggattttgagtttttatttacactgtttgaccactcgtcttattcaaaaaaattatacaaatataaaaaacgaaaagttgtgcttaaagtactttagagtaagtaaaaaaaaaaataaataataattccaaaattttttgaataagacgggtggtcaaannnnnnnnnnnnnnnnnnnnnnnnnnnnnnnnnnnnnnnnnnnnnnnnnnnn

SEQ ID NO: 25034 - DNA, 641 bp, Oryza sativa
ggtttttatgggactccatacctctaaaattattttttaagatacttttatctaattcattgcttagaccatttgttctgagatatttgttaagtttatttcttaaaataattaattcatccatataatcaagtatatttttcgtgataataatttgatgaataatctattttaaattaggcctatataaaatgtcactttctttgggcgtgttcagagttgatgttctccaatccatttatgtcgaactgtttgtgtgccacatgttggccccaaaatttcttcccattcttgtgaccaccaataatacataatcaagacgattgcgcttgcgcacgttatgagcaacaagttgtcgactattgtgtttaaatattgacttgcttccctatcatgtctctctagctccatcagtgacttgattatctgtcggagaaagatgccgatataaaactgtttgttgaagcatcaaacttgcgtaagcgatgaccgagttgcgactgacgaaacaggcagtggataatagccatacgaacactatgaacagctcacctgtttcaaaactgaatattgatcgtgcaatggtaagaggtgtgtgatttcaaccccaaggtctcgtgtacaatccccggcactttcat

SEQ ID NO: 25035 - DNA, 846 bp, Oryza sativa
tgatacggtagcaaaccaaacctatccattattttacgtttcttgttgcaacgaatctggactgttggatcaaaacacaaatggccgagcggtatgtagttcagacattttgtacttgaggttaggggctgtaataggcccaatacaaagcaactctgaactcgcagaacccaacccagtagtaaaataggctgaaaatgaacactacaagaacaggcaccacaagaagcccaaaagaaagatcctgcaaatttgtggccccaaaacaccaaggaaaaagtacaccgaaggtccctcaacttgtcatcgggataaaaaacgtcctcgaaccgcaaaaccatacatgcgagatcccttaactatacaaaaccggtcacccgaggtccctcggtggttttgaccccggttttggtctacgtggcggctgagtcagcgtgggacccacgtgggccccacatgtcagttggccacgtcatcactctctcccctcctctccctttctcctctctctctcactcttctcctgtctgggtaggcagctggggaggacgtcggtgggttgctgccttcggtggggcgaggagggagagggcgagggcgtccgcggccggcgacgggcgacacgacgacggcggctggcgactggcgacgcgccgccgccattgctctcgtccgccattgcagaagccacaggcacggaggcggaccgccatcgagggatgaggtaggcaagcaaggggggcggggaggccggcgtcgacctcctcaccggccgtgacgtcgccatcaagtccttccccaaccggcgacgtggcggccagcgaggggagcaaggcatcggcgggg

SEQ ID NO: 25036 - DNA, 687 bp, Oryza sativa
  unsure (1)..(687): unsure at all n locations
gcnnnnnnnnnnnnnnnnnnnnnnnnnnnnnnnnnnnnnnnnnnnnnnnnnnnnnnnatcccatttggtttctcacttccttttttttttgcttgattattagtacaatttcatttaggttgcaaattggaatgtgctaatccgaatgcttctttcttcatgttgatttctaacctcagaggttgaacctctcacattttttgcttgattattaggagcactctttcgtttataggttgccaattggaatgtgctaatctgaatgcttcttgattgattcttcgtgttgatttctaacctcaaactccgggtcaagctggccgcggacaagaaccgccttaccgccgccgacgccttgctcccccgccgatgccttgctcccctcgctggccgccacgtcgccggttggggaaggacttgatggcgacgtcacggccggtgaggaggtcgacgccggcctccccgccccccttgcttgcctacctcatccctcgatggcggtccgcctccgtgcctgtggcttctgcaatggcggacgagagcaatggccgcggcgcgtccccagtcgccagccgccgtcgtcgtggcgccccgtcgtcgggccgccgacgcccttgcccctttcctacctcgccccaccgaaagaagcaacccaaccgacgttcttcccagctgcctacccagaca

SEQ ID NO: 25037 - DNA, 656 bp, Oryza sativa
gatggtgaagaaacattcttatgctaagacaggcacatgttttgcacaacacaatactcgatttcaaacagtccctcttcaattcatataatctgattgatttctttggcccttcagttctgagtttgcaaaatatagtgatttttagcaaagctaactgtttatttcatttaacagatggaattgtgcatcatgctgcttgagtgctgcagccaagagagaacatacctgcgatattatggattgctagggcagcgattttgcatgattaacaaagtttaccaagataactttgagaaatgtttcgtgcaacaatattccatgatacatcgtctggaaacaaacaaactgagaaatgttgctaaattttttgcgcatttgttgggcaccgacgcgcttccttggcatgttttagcttacatccgtttgacagaggaggacaccacgtcatcttctagaattttcataaaaatactcttccaggtatgctgttaaaattatgccttttctttactacatatgtcgattcatctttaccaaagcaagcaattgaaggttttgtttcttgttatgcaggaattatcagagcatcttggtattcgtctactcaatgaaagactaaatgatcctaacatgcaagattctttcgattcgat

SEQ ID NO: 25038 - DNA, 1202 bp, Oryza sativa
ctgttagtccatgatgatgaacttcagttaacctgaaattgccaatgcagatgagcctgtacgacatgaagaaaagcgactggccacctggggaactgatgtgcctaatgatattgttcttgacaagaagctgcttgatgaagccctaaagaaggttagcacctttcatcttatattatctgtttcgttctgtcaatatatttatttatgtagatgctgacactgagttccattttttttgcaggagggtgcgaggaggaaagaggagatggatgaaaggaagaggaagtacaatgtgaaatggaatgatgaggtcaccgcggaagacatggaggcttaccgcatgaagagaattcaccatgatgatcctatgagggatttcctccattaggccttgtatgctccatagttgctcatatatgagcacaacactctgccttgcagtgtcacttgtgtaatgtattagctgtggctatgtcttcctctaactggagtgataatttagagctaagagctctctacttctcttccagatgttaccatcctcttgtccggatgggtgggtttgtattgctgatctttctataaatgatatggaaaaaaggagttgcatacttgcatatgcttatttgagatgccgaagttatggatacgtaatgtacaaagcaggatggagaagtgctaatttttgtgtgtaagtgactcgattgtatttaccatgattcagactctttttatactttctcctgcgacggatgatcaccgttacccatgcaagattttttttcccctggagagtatgcaaactgatgatctaaacaagccggaaatccctgtttctttttttccttgtgaattgtgataaacacccagcaatatacatccatgcaaccaatgaatgcaacaatcctacataaaactaatatttacacgaaaagactccaaattcaaactatagcaatcttaagaacacgacataatctcctcctacctaagcccctaaaaatcttccaaactccaaaccatagctacctatcaataactcttaataatcatgcttagattatgattattatacaaatgactaataataaactaagatgatgatgtgtcataggcctctcgcgagcatggcttggaattcctcggcggatttctggttctgcagcctcatctcctccctgaactttctgatgaacacc

SEQ ID NO: 25039 - DNA, 1521 bp, Oryza sativa
  unsure (1)..(1521): unsure at all n locations
gggaggcaaaggtacggtgagggcgagtcgtcggagtcggaaacagaacgcggcggcgaggagtcgtacaacatcctgagcggcttcgacaccgagctgctcgccgagtcgatgcgcgtcagcccggacatcgcgcgcaagctgcagggccgcagcgacaagcgcggcaacatcgtgcgcgtccgccgcggcggcctccgcatgctccggccggcgacggagcgggtgaccgacgaggagatgatgaggggcgccaacgccgccgccgccggcgggaacgggatcgacgaggccgtctgcttgatgaagctccgcgagaacgtcgccgacccgatgaaggccgacctctacacccccaatggcggccgcatcaccgtcctcaacagccagaagctccccgtcctcaagctcatcaagatgagcgtcaaccgcggcgtcatgcgccgggtgagacgacgaacgatcactgttttaaacagttggtggacgtccacccgtttttttcatggcatctaaatccttaaaaaaaattttcaaaaaaattaacatgataagttaaaatataatatatcacttcagaaatatgtaaattgaaatttaacttatacaagttgtaacaaaaataacaacttgtaaaagtcgaatttgaacctgcatatttgtaaaatgatatattactaacttgtaattttttaaaatttttttttataattatttaggtggtatataagaaactagtagacgttcacctgagagtttagaatccaacttctatgattaattaacagacacgaattaatcgatggtgtttgatttgatttgcagaacgcgatcctggcgccgcactggaacatcaacgcgcacgcggcggtgtacgcgacgagcgggagcgcgaggctgcaggtggtgagcagcgaggggcggcgggtgttcgacggcgagctccggcgcgggcagatggtggtggtgccgcagagcttcgcggtggcggggcgcgccggcgacgaggggttcgcgtgggtgtcgttccagacgagcgacggcgccatgaacgcgccggtggttggcaagtcgtcggcgctgcgcgggatgccggcggacgtgctggacaacgcgttcggcgtgtcgagggaggaggcgcgcatggtcaagttcgggagggggcaggagctcgccatcttctcccccaagtccggcgccgccgcccgccgccgccgctctcccggccacagggacgacggcgtgctcgccgccccggcctgaggcgtacgtagataccagcgtgagcgcacgtgcgcatgtacatgtagtactaataatgtgcacgttttccgttaagggtgccacgcactgcatgcaccgtatgttggcccgtacatgtacggtgtacccgatctagaataaatgaagtcgctgctgctaccaaagtgcagtgtgttaattaagagctcgtttcgctttatcaattaaaatttggcttaaannnnnnnnnnnnnnnnnnnnnnnnnnnnnnnnnnnnnn

SEQ ID NO: 25040 - DNA, 1157 bp, Oryza sativa
aattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctggagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtatgcagtgaaatggactcgattatgtctaatggtacttgggaagtcgttgagcgtccatatgggtgcaagcccataggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagaattgggagaggctgatgttattcttaacatcaaactacaaagaggagatgagggtggg

SEQ ID NO: 25041 - DNA, 542 bp, Oryza sativa
cagcaattccagaacctacaaaaatttatagaaagctaaatttgagaaaacattccgaagtgaataagttgaaacagataaatttgaaaaaacttttcacaagtaaaaaaatcagtaaccgaaaagaaaaaaagcttaaggtaactgaccatccaaaagatcatcaacagactgtttggaatgattagcattaccaacttgaggggtaacaaaattcagatctaacaggaagaaattaaaaaaatattaatgcatgattaaaacaattaacagtataatttaacataacaaatttggtacaaaattaccatcatcacattgtcttgaatcattaagttcaacagcagatttagaaacaaaagcatcttcattttcctataaaattttcaattcaggaactcaaaaaacaaataatttaaataaacttggcaataattatgcaatatatgacaaaaaaacttacatgaaaagcattatgaataggagaatgagggaacacattatcattaggcacatgaacttctgcatataaaacgaacgca

SEQ ID NO: 25042 - DNA, 542 bp, Oryza sativa
aatttttttctctttcaagtattaactaataataaatttgtccttttaatatttttttggtaggtggtgtaccttgacaatgttgaatttggtgataccaatgtttcaaatgaaattccacgtatttgtgtttggaaaagtgacatgatccatgcttattctgagtttgataaaattgatgatgacacttttggtcttaggcctctaagggattttaaatctacttgctatttccaggttaatactatttttaaaaataaaaatgaatttctttattatttttccttataatgcatattgtattaatgttcttttttttcattgtagcctcaaccttgtgatgaaagaaggatttcttttcagcagaaacttgactgtgctcttcagaatatgttgccagtttacatgaaagagaaaatatgttctatgtttgatagtcattgcacttcacttcatactattgatgattcatcttgtggagatcttttgatttctgttcttgctatgattggtgaagctagctgtaatgaatcagatcaaaa

SEQ ID NO: 25043 - DNA, 1016 bp, Oryza sativa
caacgaacctgccgggttgagaaggatgaatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgctaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctggcaagtcgactagggtgtgctctttccctagtttttccaactctcccatgtcgttttttgtgcacacgtttttcaaactgctaaatggtatgtttttttttaaaaaaaataattatatactaaagttgttttttaaaaaaatcatattaatctatttttttaaaaaatatttaatacttaattaatcatgcaataataagtgtttcgttttacgtgccgagaactaacccctcctcgcgaacgcagcctaagaggctctaccatgcaacatatcatgtgtttgttttttgacgcatgtttcccaaactaataaacatggtatcttacacacacacacacacacacacacacacacacacacacacacacacacacacacacacacacacacacatatatatatatatatatatatatatatatatatatatatatattgtgtgtgtgtgtgtatatatatataattttactatacacacacatatatatatacatatatatatatatttatatatatacatatatatatacatatatatacatatatatatatgccttaaaaatcatattaacacatatttcttaagtttttttaagctaatacttaattagtcatgcgctaaatcttcgc

SEQ ID NO: 25044 - DNA, 3722 bp, Oryza sativa
  unsure (1)..(3722): unsure at all n locations
nnnnnnnnnnnnnnnnnnnnnnnnnnnnnnnnnnnnnnnnnnnnnnnnnnnnnnatttgcctgttataacagaaggctttcttttcagttctttctgattctcattacttggtgaatattccatagtgaattcactgcattctgaccagatgaactgttctttgcaggaaaacaatcctgccatttgctttgctgatgtagacaaaaccaaagaagtcgacccagcagaatcccaggaaaagatagcttctttacaactcacattcgacatagtctgcgatatttctcggtctaccaagaattcacttattacaaaacaggaactttttcacaatattcttgctaacaacttggagatagaagagacaggtatagcatggatctaacaattccaaccattttgtacttattgtctcatgctatactgaatgatttccctccttttatggactatcacttgacaggggagatagaagaacagctgcatattttggaggacctgtctcctgattggatatctaagaaggtgatacctggtggagatattctttacaggttagttttacatgacttgtatagggcatctgctaatatgtgttttgtgttcatttctaaataccatagtatctacaatcactatacaattctttttagtggacatgtaatttagagatattttacgggtgtcattaagtataaacgcctttgtttcccatgttgcagcattaaagaaatagcagatcagaaatcagttcgtgcaagactcgtagaagtcatatgagatactactgatgctttcaaggccgaagaatcaacaatgtgatgtgactactgatgttgtaggacttgatcagctggattgctgaaatcccaacttaccatcatgaaatcctctggattgctccttaatttcttcgtctacttccaaacattagcagaaacaaacgcagattactcaacatgttcttttactggcactcgacatttgagtaatcctctggatctctttagtgctgacatggtttggaattcacaccaccatataataggattgaaccatgctatctgtgagactctgaacagccttgttagattgcacgagagcacaagtgctgtggttgttcccacgagaatgcgatgttgcaaattcgatcggtttgtgtatgaatacgatgtaatgtaggtatgtagcacatgctcgtatggttctctgagtgtactatgttagtcatgagcgaagtgagggaattccttcagattggatcccttaggagagagagagagaaggtattatgaaatgtaatcagatctttgacgatccagtattagctagcaagtatatggactcagactttgatgattacctagtgtatgtattagcttcaccctttgaacatctcatttactctctctagctctcgattttactaataggaatgccaagtacataggtcgatgaaagttgacatctattttatcttacgccacttactttagcttgatttcgtgggagacacccaattgaatgatctcaagtgggttctattaccatgtgtttctggagctgatttcattcgagtagtttcttttttgtcttcaatccctttcctattcctctccacttggtgatgtgtggtgataatggtgcactagtgatgctggttgtatgatcctagtggtcacttgataatgctactgtaatcccaattgcagtactgtatttcctagaattattatgtaagcattcatctatgcattcatggcatatagacatcattcagcaaaccaagtcaattgacctagaacccttaaaaagattcttctattattataagtgtggtgatctttcaaatcaatatatcggtgtgatggtgtcaactgttaaccccaaataaattttctcaaccgcactgctctcaagtataactgttgcactttctacaaggcacattaacaatgaaatcatatagtcatacaagacaataatcaatttgcagaaagttgcagtcccaaggtcgtgtggatatatacgaatggatatgtacttacgttcctttcatgattctggtagcaaagctggattatataagctttgacgggttcatatttttctggattacaaactttgacgggttcgtttttcgtgatttgcttcacacacgctctctgacgagagcaactcctcgcccattcgatatgcgggtatacgcttctgttctgggcgaacttagagcatctccaacagttagccatctcatctcactcttcaagttaaaaaatatcaaacatagcaagaaaatgtgatccaacagcctctctatttagatggctaagccatctcactggccaaatgaccagctcggatggccaaatctagccagtcagtttggctggccaaacacagcatcaacggctagaagctgcaatctctcatctggctctccccatcgacgccgagtttcctcctccggccggccgggagccggccgccgcctcccctccagccgtcgtcgccctggccagccgccgcctcctctccagccgccgtcgcccctgccggccgccgcctacccttcgagtgccgtcgacggcaagagagggagggctcgacggcgacgagggagagcaagggaggccgccgaggagcagctccacgcgccagtcgccgtcgcctcactcgcccgccgccgttgccatcctcatcccaagctccgccaccgccccccatgccgatgtcgccttccccatcgcgagctccgccgccccccatgccgatgtcgccttccccatcctgagctccgccgccgcccctcccaagccgatgtcgccgtcgcttgctgctttcccgtgctgcctcccacgccatcagcatctgcggtcgacgggaaggaaggaaaggggaaaagaagaaaagaaaagagaaggaagaggaaggagagagagagagaggggaagaagaggagtagagactgtgatgtgtgtctatttgttattttagagaggattaatagagagtctgttggagtgagtatctagtttaactaggcaaattagatgaagagttggctatatgggtgtttagagactccgatttgaagaagctgttggaaatgctcttataattcatcttgttcatcagactacttccacaatagagtagataatttacgataaatatagtctattaagatgtattaaaaattttagtggaaaatttattattaatttagaaacaccaatagatatgaaatttcatacgtaagacgatttgaattttttaaagtaaaacttacagttttatagaaaagagatagcaatatttttaatgtttgatttaatgaaaactaacttagtattattgatgttggtaaatttttttataaatttaatcaaagttaaacaaaatttaattagagaaagaaaccaagcatgttagggtctgtttagatccatttaaaatagcaaatgacaaatggcaaaaattttggtatagcaaaagtattagttggtgtttagatgcatcctaaacttttgccattctagcactaaagtgagagagagaaagagagagggagtggtccaaagcactttttggcacaatttgctactatagactagcaaatgccaaatgacaaattgccaagttttactactagtgtttannnnnnnnnnnnnnnnnnnnnnnnnnnnnnnnnnnnnnnnnnnnnnnnnnnnnnnnnnnn

SEQ ID NO: 25045 - DNA, 12397 bp, Oryza sativa
  unsure (1)..(12397): unsure at all n locations
gcatctcccgcggcgacaagctcggcgccatcgtctccggtggtgcacggcggtgaatcccccgccccatcctctccctccccacacccatctcgtccccaaccggcggctccctccccctctccccttcccccaccaaccccccttcaagtcctcaactcactggcggtgttgaactcagtcgccttcgacatttccccagtccccctacctcagcggcgaacttcgccgccattggtttctctactcctgtcacgagatccaccgctgccagcacctctcccatcccagaaacaacaaaaagctcacggtggcagccgtccggcgcctcaccacaccgctcgagcccaacacgaggaaaccatccatgcccggaactggcctcaagctcggcggccatggatggatctagctataggaggcgagggccggtgagattagttatcggggatggccaaggtcgctaccgatagggagctcggcgtcgagctcgacagcatcttgtggggggcgtccgtggcgacggaggcagttgacggtcgaggatgcttgcgacggttgcatggtcctcgacggcagtgagcaagccgagtggggcttccccaacccctccgccagctttccctcccccttcggcgacaaccgccgaaacaagttccgtttcctccatctctcttctctcctccgtcccccttctctctctctctcccttcgcaggcgatgcgggtgtgtgggccggccctgacaaatattgacgaggaacccatggctcaagtatgctccgcggtcctcactttgtaacgagagatgtttgatgtggtgcggaatctcctacgtagaagggaccacctatacatttgtcgacaaattttctcctaaaaatttgactgatgtaattacagtacaatcgtagtgtaattactgtaacttgcatgtagagatggcaacggggaattccccgtcggaggttactccaccatacccgcctccgcggtggggaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataaaagattaacactcaaaatagcaattccagccatcaatttcagcacatgaacaacaactacaagaacacaagttcacagattcagatcacaaattcgcaaatgcacatcatcagttcacaaatgcacatcatcaattcatcacttacaacagcagtgcagcaacaagcagtgcaacaaaagtgtgcccaagaatacaatatccatcatattcccagattaagcaacaacacaataatacatgatcattcatcattcatcagtcatcactcattagttatcaccacattgcagcaacaacacatgttgtccatgcatacgtaaaaccatagttcggagtaggtcttttgtgccaaatatccaaaagcattgccatggtttacaagtttatcatgacacataacaggggttacaaacatccaaaatcattgcaagaacagtgcatgtccatacattcatgtcttcaaacaagagcaagtccctaaattaaagaagtagcaaaagatattcaattagtcaagtattttataaggatataacaaataatggcaataggagtttgattgctaatttcaagttgttgaaagaatacctcaatccgatcttggatatcttgaaggcaactccaaaagcttgctgcttcttcattatcagctacaagataacaattataacaattattttgcatccattgcattgtaaaatctatgctaagcatgatgtatgaataaaacatcatatgtacctcgatacttgtttcgcagccaatcttgtgagcacattaaggcctccaagagttctggagtaagccggctacgatgctcactaagaacccttccacttgtgctaaatgcagattcagatgcaacagtgctaacaggaatagcaaatatatctcgtgctaccttcctcaatgtaggaaagcttgtcccagccactttccaccaatcaagaatcttaaagttttctgtattaattgaaaccaactcatcctctaagtacctgtctagctctgatttaacgcgtattgctgctggtctcctactagtaacacgtgctgtgattgaagacaataaatcagaattgacaagtggaggagctgaagattccgtgttatcctcatcatcttccacttcatactccttcatcaaatcatatagagtgtctttcacctcagcaactttcgttgcacactcttcacttgactgaccagtgatggtttcaatgaacccaaggaggtagtcaatcttaaacctaggatcaagaatggtggccaaccccattggccctttaatatctttccagtacttatcaaacttttgaatcatttcaactgacatttcctctatagtagaatcaccacaaacagcccacttcctaatttgctctttagcctcacagattttaagtagttgaatattggaagtcacataatttgtgccagaaaatactgcagtgatgtcattaaacaacttgagcctatcaactacctcactagcaaaagcccattcttcttcactaggagcacaatcaaatagcttctcaacccgtgttgcacggtcaaaagcacgtgcacaaggtaaagcaatactgagcatcctataggtagaattccacctagttttgcaatcaaggcctaacttgttttccatcttaactttcacatgctttgcaatttcctcaaacttttctactcttttaggtgtggctgtccaaaaggcaacactttcacgaacctttgcaattgaatcttttatcacatctaaaccatccctcacaatcaagttaagaatatgggcagcacaacgcatatgcaaaagtttcccctctagcataagcttacgcttgccgatctttttgatgagttcagaaatcaccttatcatttgtggtgcagttatcaagagtcaaagttgatatcttctcatcaagattccattcaaccaacgcttcataaagatgttcacaaataacttcagctgtgtgtggagcgggcacatatatgaatctacaaatggaatattgcagcaagattaaaatgttgaatttaagatggtgacaagaggataatcatttgtgaatcatgtacctcatgataatgcttctaagtgtccatgaatcatcgatgaaatgggctgtgatagccatgtagcctcttttttgattatcagaggtccacaagtcagtagtaatacccactctagacttagctccagccatatatgctaatgcccttttcttttcttcctcatatgtatccataatgtccttcctatattcaaacattaatcaataaactcactaactaatcaaatttcagaaatgcaaaaccagcaaataaataatagatgaactgaaattacctaatagtgttccgagtcaccatcttgaataatggctgaagtgcactaacaaatcttcgaaagccaatatggtcaacaatagataaaggatactcatgtaatattatcatggcagcaagctctctcctagccactgctggatcaaatgtgtatgtgtccacagaaactttccctccctctacggaattgaacctcaatgaagattgtgcaagtgtctttggccccatcttgatctttctcaatgtgcaaattttcaaatggtcatgtagatgtgaagtcccattgctgctcttccctccaagccgcttgtggcaatgaaggcattcagccttgacatcaccacagactttgactttcttgaaatccttccaaacaacagaagtaagcttcctctttgtgccaaaattctcagaatcatcttctggctcatcatcttcaacttgtattggctcagaatcattaacagactctgcttgtggtggaagtgactgcgattcttgctggctgctactcccacaaccagtaccagcagttgaattcgtggtaaatctgacaaatgacaaataaatatagatcaatatatctttcagcctatagaataatcttggcaaacttgaaatgaagaatctctacacataaatcatactgaaatctgctacagcctatagaataataaatttcttatgatctacactacacagaatcggattcctttaatttcaaaaacttaagttcataacatatttataacttaacaacattcaatgtgcaaccatacaatatacatgtaaagatatctaattttctacagatactctaaatacaacattcaatatctaagaaaatcaagcaagctgcaaattaataaattgcacatgctaaattgttaggaacttaggattacgaaagtgaagctacaatgtataaagggttagcgtgaaatcgaaccccatggatttgaataagcgcaggccgttggcggaagatgaagcttctggagttcttggagcagaaggagctcctgccttagtcgaagcagaaggtgctcctgcaatcgcaagacggctttttgacctagtggtggtcctttttataggtggttgcggcggccgacagcaggcctttgcaccggagttggaggaaccagatctgcccacatgaacaatggcagatccagcaacaggcacgacagcgggtgtggctgcagctgcagctgcagcgcttatagcatgcgatggctggtccaactccgcattggcgtcccttattgtggatcgccgaacgtgagttagtgactcaacgagataatgatgcagccatggaagaggaatttagtggagggggagggggatatggtactataggtaggcgtctagggaggggtactgagttgggagtaggacagctagatgtgctcaccttgcatcatcgtcagagcttagcggtggtgaaggcgaagccatggcggactcgagcggctggtcgtcgtgtggactcgtcgttttcccctttcttgccaccgaagccttcacctgcatccaccttcagcaaaccaaataagcgtacatggcggatcaataattgtcgaagggtggaggagaaggccaacgtccggtggccggtgccgagtccacggcgtcctcggacctggaggctgggagtgaagggaacgggacggcgtggcgtggcgctgggacctggcgcggcggcctggcgctggagcggacggcgacacggagggcgtggcggaccggcgctggcgcggacgccggcacggcgggcgcggcggccctgagcgcacggacgcctgcacgcgcgggcgcggacgccgacacggcgggcgcggcggccctgagcgcacggacgcctgcacgcgcgggcgcgggcgcgagatcgggagccggcgccgctcagtcactgtggccgacggacggcggcgtggactagggaatggggacggaggggataaggattggaatgggtagggttacacaattgctttatatactctatgctttgggcctggtttttatgggccatatgggtcaaatacacaggatattactacacacatacttttatatcgggccctccacagagggcggggacgggggacggggaaccaaacccgcccccgccagacccgacggagaatactttctctccatttgattccccatggagacacaattaataccatcaccatcacctaatgggagaattctccacgggggaccggggaccggggaccgggtacccattgccatctctacttgcatgtaactacagtgtaacttgtatgtaagtttcacgtaattttaaattattagatctattataaagatttgttttggtgagaaagaaaaaaaatcacagtacacacatatctgaaaaaaaattgttcccacaacctttattttaccaaaataatatattatggagagatttttgaaagttacatacaagttatattatagttacagtgtaattacatgcaagttacagtgtaattacattacggttgtactgtaattacatctgtcaaatttttaggggaaaatttatcgacaaatatatagcaaaattgacgtagaattatatggctaaatgacacgtaagtgcactatgaaagccccaaggtagggtcatgagcatgcaggcccacaaacgactcaaccttggtgcacacggagtataactgaacgtaattgctatacatttgtcgaaagattttttgggtgtggatttgtcgtttttcctgccgttggattagcttttgcgattcgtgcggatggatggatagtcttgcttgtggtcaacgtgggccccaccttttgtttttttctcaaattttggattccgcgcctgtccttacctgctttttctctctctcattctttcccctcttctcgtttcttctcggtttctctggcgagagagagaacgagagaactcgccgacgatttcgttgtcgcggtgagatttcttcatttttcttcggtgaaattgatctctcttgcttgtagatttaggtggaggtggaggtctctctctcattctttcccctcttctcgttttttctcagtttctccggcgagagagagggagagctcgtcgacgattttgtcgttgcgttgagatttcttcatttttctccggtgaaattgatctctcttgcttgtagatttaggtggaggtggaggtttcttaaatcgttggcttgtgtgtgtaatttttttggtttttggttcataggttgctcttttgctgttgatttttctgttgtttctgaagtgttcgaactagatctcttacattttgtttgttctcgtttgggatttttggtgtatggatgtgtttgttgatccgattcggtgtagttgttctctcgtcaagcatgagctctttttgaaacctattttgattgagttttctcttggtggtcttcgaatctgttaggaagttaggtattatgtgatgttcgtgaactagatctgtgtgaagtagatctcggtagttttctctcgttagattagcaagttagtgtatatatgtgagctatttgaacaaaatttggtgtgcttgtgttttattatgctttagatctggggatgtttgtgaggtgttcgaattagttgcagttgtgtactgttcagggtagtattttgatggctggcgcgcatgtgttctattatgctttagatcttgggatgtttgtgaggtgttcgaattagttgtagttgtgtacttttcagggtagtattgatggcttgtgaggtagaattgataacttgacagctagttagtttctaaaattttgtgatgtctgaacttagtttgttgtatttttgtttttgttattattattactgtaattatttttgaattttgtatattgtagtagattaaactttttacagatttttagttgtaagcatgattctactttccatgtcccttggatagttgtaagcatttcctaattttttacttccaagttattcttgtgtaattgacagctactagtgcttcaaaatctactgattgttgtttgtcagtttttttttaattcctatcaactgtaccctgttttcttcatcttcattaacttgctgtgcctgttgattccattcagcttgttgttatgttatttttctgccaccttctccttggtatagcttgtgtgcagctgctatacttctttagtgaaatcttctgcttgttcttttgtttccatcagctgtgtcatgttgttggagtcttgtttccttgtgcactctccatgataaagcatctttagctgtgcactcctatttttttttgtttttcttctaattatagttgtaaagccaagttcatggtctgcatgatttgcctttttcattgttgtttgtcttattaagaaagtgatttagatatttgttttatattttttgtttagatggctcctgctgctaagagaaatttgggtaaagcacctattgtagatgattctgatgaatctgattgtgtaagttatagtcttttattaatgttttttttatgaaatactatgttatatgaatttagtttgtagtttactaatatctatttcgaaatatatgaattataggatggagagctttctcgtcgtgaacttgatgatattatatatgaaatttttagaaaggaggtagtattactttcttgactgtatttataatttgttattgttttttatttttttaatgtatattttttctatttttattataggttgttaaagatgttaagaaagaaatattgaatcgaaaatcttgttctcatgcttttcgttatgcgaaggtatgttgttatttactaagttcttttactgttatttttatatttgtaagtacattcctgaattttataggcagtaatttatttttctgatttaggtgaactacacatttgattttaatttttatattgcttgttgttatgtaagttacccatttcttttcctacatatgttctattttattgtactttagatattttttctgtttacttgtctcagattgtcttaagatcttgcatttgtttagaaattgttctttacttagagtttaagcagtattgttcttctactttacttagtgtttatttttttctactgttttctttcaattttgttttctgatgattctctatttagtagttgtttgtttacttgtctaagagcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttgttgtgctttacatatttgttctgtttacttttgtattatatatctattttttatttattttgcaatttttttgttatttaataaggataataagctaaaggaggctgcaaagattgattcatcatttacaaggttttccaccaagtatttctgtcgagttatatctgcactttctccacatcagaaaactattattcagggtgctggttttcagaatttgcttgagttcaacagcaattatgttccaaataaatttgctacttggattgcaaaacatgtggattttaagacctcacaaataattttaagagacaaagtaatttcagttacaaagcagactgtttgtgacatttttggtttaccttctggtggcttggagtttggaaaggattttgaagctggaaaggaatacattctttcgatgtatgggcttagttgtttgccttcagtgaggttctttggagaccagttcattaaaaaggaacctttgacaaatgagaaagtgattacttcatttcttattgttgctttggcttgttttctttgcccgaattcttctatattgccaagcaccaagtacctcaccatttttcaagatgttaataatctgaggaattatgattggtccaaattcatatatgattggtcaatgaactacatgaagaagtttgtgaagactaacagcttgggaggatgtttgtacatgtgggctgtaagtatttgacatatttgttatttttaatttttttctcttttcagtattaacttattattaatttgttctttttatatttttttggtaggtggtgtaccttgacaatgttgaatttggtgataacaatgtttcaaatgaaattccacgtatttgtgtttggaaaagtgacatgatccatgcttattctgagtttgataaaattgatgatgacacttttggtcttaggcctctaagggattttaaatctacttgctatttccaggttaatactatttttaaaaataaaaatgaatttctttattatttttccttataatgcatattgtattaatgttcttttttttcattgtagcctcaaccttgtgatgaaagaaggatttcttttcagcagaaacttgactgtgctcttcagaatatgttgccagtttacatgaaagagaaaatatgttctatgtttgatagtcattgcacttcacttcatactattgatgattcatcttgtggagatcttttgatttctgttnnnnnnnnnnnnnnnnnnnnnnnnnnnnnnnnnnnnaaaatgttgtattgagnaaaatgtaattaagaatgttggcacttctaaagctgatgatgacattggtatttcttctgctggtattagtgctcgtaagtcatatttttataatacttttggtgttttgagtttttcctcttgctgtttctatttttttattttgtattcagtttattttgttaatgcgttcgttttatatgcagaagttcatgtgcctaatgataatgtgttacctcattctcctattcataatgcttttcatgtaagttttttttgtcatatattgcataatttatttgcaagttttatttatattatttgttttttgagttcttgaattgaaaattttatagggaaatgaagatgcttttgtttctaaatctgctgttgaacttaatgattcaagacaatgtgatgatggtaattttgtaccaaatttgttatgttaaattatactgttaattgttttaatcatgcattaatatttttttaatttcttcctgttagatctgaattttgttacccctcaagttggtaatgctaatcattccaaacagtctgttgatgatcttttggatggtcagttaccttaagctttttttcttttcggttactgatttttttacttgtgaaaagttttttcaaatttatctgtttcaacttattcacttcggaatgttttctcaaatttagctttctataaatttttgtaggttctggaattgctgctgcagctgctgctattcatcgtgttgcaaaaaaatttagatcaagatttaatgattatgggaatgtggaaaatatctttaatcagtcaaggcccttatttagtttgctagattctgaagatgatgttagtgattatgaacatgttttctcagttcagaatgaagatgaaggctctgaaaatgtttccccttcttcaacccaagtaagaatttttatgttctttttttgcattgtactgttttgtgaagcaagttttatataaacatatatgttttcaggcagcatttgtattttcattggatatttttacattatttaatctttcttctctgttatatttgaaattgcagccttttatttcttttcaatcactccctgaaactccagacaatgatacttgcaacactgtcattaatgaaaaccctggaactagtgcagcacataattctcagaattcgaacaagaggctttttaaagatgttacagtaagttatacttttttttaatgttcttacttatgtttctcgtaacttcaaaattttctttattatgttttttgatctgatttttttttcaatttttcatttctttcacagaattctcctgatgttgtttgtttgggtgaaaataaaatttgtgattcatcaaaaagaatgtgtgttaaagctgaacagttatataattcaacaaatcaactgaacaagtacattcgtggaatgagttcttctggcggaaagcttcctatacatggtccaagaagggttttagttcctgctaggcatgcttctgatccttttgtcttttctccaaggcgtcgttttacagtttctgatcaagagaatagatattatattgcaatttgtcgtctttcagatagttcaaagtggcagaggtactaaatggctaatcttttaactgtttatttttatttgatttgattttagctttttatgctttatattttatttttgtagttactatgcagttgatattgacaatgtcaaagcaaagttctacagttttggtcattccctcaagaagaattgtattgtgtcaccttatgtcatttcagtcttctgccgtgttttgtttcaagatagtcatccatcaaagtctaaaagaaactacttttttctatcaattggtgtaagtatatatttttatatcttcagttttattttttttgccaaaatattatgcatatgttgattagctgtattgcatttgataggctgaattgattaatgatataagtgataaaggactggaaaaggttaagaagtcattcgaaggagctaccaatgctagaaaattgcatctttgtgacatggtattttgttagtagtattttttttcctcttattatttcaaccatcttttttttacttatatgtacttttgtcatatgtatttttgcagttnnnnnnnnnnnnnnnnnnnnnnnnnnnnnnnnnnnnnnnnnnnnnnnnnnnnnnn

SEQ ID NO: 25046 - DNA, 9019 bp, Oryza sativa
cattcgaaggagctaccaatgctagaaaattgcatctttgtgacatggtattttgttagtagtattttttttcctcttattatttcaaccatcttttttttacttatatgtacttttgtcatatgtatttttgcagttatattttcctattctacatcttcagcattggtttctattcattgtggatttaaaggatagaatgcttgtcatactagattgtgtatatcatgaaggagatgatttctatgaacctattatgactcaattggtaagttgcacttttatgattttagttttattattttgatttgcatttttttattttatatttaattgttattttgatctgttttattttcagataaataatctccagactttttgggacaaatttgaatgctctccaatgaattttagcaatttcaaattgaagtttccatctgttctagcccatatttctaggttagcttattttattttctctgatttgtttgtagttttttgttctgttttgatgttagcttatttttttcttttttgtttcatagtgcggattctgggatttttgttatgaaaagcatggaattgtggtctccaagagttattctgcaaaatgaattctcaaatgacaatatcagtaacattcgagttcagtatgcaaatagaattttcttccatcctagcaacaagcttttaagtactgaagttgaagatgtagttctcaattggtttgaccctgtaagttaaagttttctatcttctatatatttttttcattttaattaataattttctttgtaggctaagtttccacgtgttgatactcctggtgctgcttgataattgtttcagtctaaaagctatttggtttgaccttgtaagttaagttttaatacctgttctatattttatttactttgttttgttttgacttttttaaaaaaatttcctttgtaggtaaagtttcttcacgttgatcgtactgctgctgctttgaccagtgtttcagtatacatttcacagtttttcttgaaatgagttgtgtgacaaaaatttgtatgacgaggatatttgttctactggcagtacattagatacatataatgtagcactctagcagtatattacatacttgtaatgtagtatgagaaaaacaattatacaacatttgtagtgtttacagtctgaatgctattacatagaagaaagatctcttttttttttcttccattactgatggtattcaatttgtcctttcatttccaatgtctttggtcagcttgtctttgcatgcaacttctctttaggagtttcctcttgagtattgtttttctttcctgcaaaaaagaagtatgcattaggttttcattatatatagtttcatttttgtatatgtattataattgatttgtttattacttctttttgtagtttttgatgttttcatctcttcttgcttgttccctatattggttatctcacttgttcctgcaaaaaaaacttgttatttctacaatttatagttatatgtggattcttgatcttgctacacttacttgtttctgttgtgtgttgctcatctttacttttcctttttgaagtttctatcatcttctccactattcttctatatctttttggttttcttcctttagtattggccaaatctgggtcttctatttccacttcttctattatctcttcttctgcatgctgcacagtatcattttgtactgtgttgctttcatcttgtgacaggtgtgtttcggcctcctgttcaatcatcaattgcacattcatttctaatttctcaagttcctccatcatgaactgatatgttctttttctttttgatgcttttgatgctatgtcagcacctttccttgatagaacattaaacatcagaacagagttgtctgttgcatctgtatgtatgctgcctttcactttctccttcttttctttttttctccatctatcaataatgtatttttctggaatttttctcacattgagttccaacatcactttcaggatatgtgaacatagcattccatccttagagaacttcccacaaatgcaaccgaagttttcatttggtaagtcaatgatcactatatgtttcctttgtctatattcttgctggatgctattaggtgacacaaacacttcatacactttgccctgttgtatcacagatacttgcaaccttaaagtatcctttaattcattttggaattttctgaatatgtctagattatatagttccgatgcctgctcttcaatgagatagttgaaccatagtgtttttggcatttttgtccttgattggaaatctttgctgtactcagtatcaaagatagtatcatttatgttctcatattccttcataaaactcatcacactgtgttgtggtccaactcctcttttgaatctgctatttgttccctcactcagcgctgtgctttgtataaaagggcagaaatcatatttgaagtagacaggcacaaactgagctctattcttccacattagttgcaagtattttatattttgcaaactgaacttttcaatcatctgaggccaaagcacttcaaattcttcttctgttaggcaattgtttagtatgtcatcatattcctcatacaggtttctatttgcttttgcagagaacatgcttcctatcttttctctgcaatttttcttgatgtgaaatagacagtttctgtgctttgtgttttgaaaaacctgtgcaattgctgatctcatggcattatcttgatctgtaattatagtcttgggatgtttccctcccattgctgttataaatgtttcaaaaacccacttgaatgtctctgccgtttcatctcctaaaaatgcacaaccaaacaagcaagttgacccatgtcctgtaacaccaacaaacggtgcaaatggcatattgtatctgtttgttctatacgttgtgtcaaaactgatacagtcaccatattcctcatatagctgagtcgatctaccatcagtccaaaacatgcttgtcaccttgttttcttcatctagcttgaatttgtagtacattccagggtcatcttgttcctttttcttgagataattcaacacttgcttcatgtcattgtttcttgtctctgaatttattgctgtcccaacattacttacatccttcttggtgtagggtagtgctgccaagccacctcggagaaatgataatatcacaatcatgctcctagttggtatgttgcactcttttaatgtccttattagtctcttttcttcctctgtcatatccttatgagacctcagaaatttagcttctcttcttgggcaaagtgcatggttatgattcagatcaagccttgatatttgccaaaactgtccaacttcttttgctaccattgtacatttgcaatttgttttgactaggactactgtttccctctgctgttcagtaacttgttcattgctcttcttcttgtttgctggttcatttttgccttgcaagttgcatttgtatgtgtactttgtaatttcaccttgtcttttcttgcttgttgtcttgtagtggtgcgcaatcacaacagaaaaaccggctaggtatgcatagaagttgaagaagcctctagcttctgtatgtgatttgaacttcattcctagcttaggtatgtgtttatcatctattggtaaactgctctcctcttcattttgtaagaaattgtcaatgtcttcctcacttaattcctccccgttgttagtagctgaatttaaattatcattcatttcagcctctgtttgctgctgttgtatccctgaaatttctgttgcttcaggtcttgtttgttgctcttcaatatcttgctcatgaaagttttcattgtatggctgaaaacaaggattaatagtagtaaatcaaatttttttgcaaagctaatttacaattctagttaaagaaaacagaaataactttggaatcttcttagtgatctatatgtttattttttacaaacctaatcactttcaaagtcctcttgatctctgttctgagtggcccagcttgtaggaattccctgcagatatctcttacaataaatttttgatatgtagcctatatcattttaacatgattaaattattaattaatgaaagtacctgtgatttcaaatgtgtgttttgtaatttgtacaattcctccatagttttgtcaactggaatctgtatattttgatgaaatgttagcatactactcatacaaatttaaaaatgattataatttatttttgtaattgcaatttttacctctggtgtgatccttgcactgttgtagatttcatcaaattcttggtaactgtaatgtttgcttgggattaataggtcattgtttctgtcttccagcagcatgtcttgttcacaaactctgctcgtagttagtatcattgaattctgcagtgtggaaattttaaaaaatattacatacaattaacaagagtatttctgcaaaatcgattagtagctgtgtatataaattaagtttaaaataaacttacattatatgctgatggtgtttgaagcatacttgtgaaactttctagtcctcttcctccctgcatcatttttatattttgttagtgaagcatatgctgttgtacaataatattaatattacgaatctatatccttaccatatttggttctatgttaatccttggactatttattacttggtgcattagacttgtgtacgacaactgtgctacctgcatttcaatttgttagtatcaaataaagtgttgtgacatgcatttttctatgttacttgtttattcaaattaccggtgtagtatgtgacttaagcatggttaactcatcatgtagtaatgctgggctttgtggcgattgggttgtgccgattcctgtgaattgaaaagcatgatggatcagctagttgaattttcaaattgaattcatttggcgtaaattacatatggttaaagagtatcatttttttctgacctgtaatttgtgtgatactagaacttgtttcttcagtatgctttgtatctattttgtttctctctgattcttttaaacttctttctccatcttgtagttgatgaatatttgtacctgcaagaagtgtcaattttattggtaagtttgatatgtttcttttcttttttgtacaagtattggcatgtcagatttttatgatctagcacagtggatttgtatgtttactaacctgactgtattgttttgttgttaccctctttgcttccttgggttatactcttgctattctcatttggttcagcatatggcattatccttattcctacaaaatataacacaaaatagtgataccataataattcatgtttatacagatcatctaagaataatactaagttacataacaaattaaatgtatgtatatatgtaatttttgcttctgattcactgtacaaatcctggtgttttaattattttgatgcttgcttaatgcttgttaagtctattttctgctttatgcttatatctcatacctgcattttgtttcatatggttttgtttatttccctgtgtctcgaagctaactttctgtttatgttctgaaattgagttcaattctgcacaaaagaaaatcaaacagttaaatgaaagaatcctagaatatatgaagttatactctaattatattgcaaatcaactatacttacatgtgtaactttagttatttgtacatgtaaatatagatgaaatttaatttgaatgacacaaattttccatgttttatgagtattaaaaattatataagatcatgcatatttatatattttttttgctattttgcatcttggtctcgaatagtctacttttttttttaccttttttctccaggggtccaatgcgaactggttcggtaaatttcattcctgcaaaattcatagaataaattagtatatttgactgctgaaaccatcttacaagaatgctaagtagtagatatttattttcaaagcatatgcagcaaaattaaaatgaacttatatgcaagacaaattgtttttataaatgttaatttatctaattactaatgtaatttatcaaatatatgaagtgatgtaaatctgaaactttattgggtttcgatatagttatatagtcaagtataactgaaatcaagttagttacaatatgatttgactgtttttacactgcagttacatgtcagtataactaaagttacaactgtaacttcacatatttcataatgtaactttctatagttctttttatactgctgtttttcttgcaaaatttgccaaagttttgcttgttagtgttggatgtgtgtaatacctatgaactatactagaaatggacaaatatatttgctgtgtgcctttatggtggacattttgtattaatttcatgaatgattcttgctacttaacataaattggatttggagagaatgcttaatgtaggtgtttattttatatctgattgcatatttatttgttaattagagatatttttcatatttatctgatggcaaggactgtaactttatattatcagatttatttcatgtcatattttttctctgaattttctgactttttgcggattggcagtgtgcttgccatgtcctgtttactattttattgtttctccctgttctttccagtgaagttgctgcttgtttggaatgatatcctagagccattgagtgattaactcattgcatgtagctttattaactcattgatagctaactttgacctttaattgctgcacaaattccacttgactgattaactcattgcttgtagctttattacaaaattggttttttattttggacttctgatttggcatttgttacatatgttttcaaaagtggttaatttgcactgctgattattctacgtgcacatttgctgattgtgactgtcttgttctattgcaatactccagttggactagcatgtcaatccctcatatttgtccaactgatcccatgtgcatattaaattgaaatgtacatttttagtgatcaagtatttttgtttaaagaagtttgtccaacttgttttaatgtggtttgttgtatagtcagtggttaatgaaatgatattatctaatggagttcatgatctgatcagatttatatcttcagatgatatgtcagtttctaaacattattgtatatgaagtttttgaatgttggtttttttttaccaaattgatgtttttgttctctgaaaaattagtgttagctttcatttcatttgtatggcgctacaaatagatttgtatgaagttacaggataaaataatggaaattacagttgtagttacattggaaatatatatgaattacaaatgtaattttaggtctgtggtgatgtaagttgttcttcaagtcaagtataattaaagtcaagttagttacaatatgatttgactgtttttacactgcagttacatgtcagtataactgaagttacaattgtaacttcacatatttcataatgtaactttctatagttctttttatactactgtttttcttgcaaaaatttccaaagttttgcttcttagtgttgcatgtgtgcactagctatgaactgtactagaaatgggcaaatatatttgctgtgtgcctttatggtggacctttttgtagtaatttcatgaatgattcttgctacttaacagaaattggatttggagagaatgcttattgtaggaatatgtgataacttagtgtgttttttttatatatggcatgtgcattttgtatggcaatagatttgtatgaagttgcaggataaaacaatggaaattacagttgtagttacattggaaatatatatgaattacaaatgtaatttaaggtctgtggtgatgtaagttttgatattgttccaattgttcttcaagtcaagtataactgaagtcaagttagttacattatgatttgactgtttttacactgcagttacatgtcagtataactgaagttacatctgtaactttacatatttcataatgtaactttttataattctttttatactgttgtttttcttgcaaaaatttgcaaagttctgcttcttagtgttgcatgtgtgcactagctatgaactgtactagaaatgtgtaaatatattgttgtgtgcttgtatggtgcaaatttttcagttcaacatgtgtatgtacagtgtaattttctgtatttactatatgattgtttcttgttaattaactgaccttgtttggatcttgatgttttgattttttcttcagatttgatcttggattttggttcttcttcttctcttttcttctttgcctttttcttttcgctctccatgtctatcttcttcgatctgactttggatctgttttggatgggagaagcgttgattcgctggatgtgtgctttgatcacgtgatgtatgtgctgtccttttctccagctttcttgattgccaagttgattgattttgggctataatcataaaattatttgttgtgtttttggcccaatatgattttatcggcccattattatatttacacgttgcaattttggcccaatttaggccttttattttttttctatttgtttccttctttatttttgctgccgttggatgctaatccaagggatcagaaatctgacaaatttggggcctgaaaatttgtcgaatgatgtgtagagagaccctaactgaaataaaaataggacggagatgttgtaagttgtaaccgaacgcaacaaataccatatcaaatttacagcccaatgggctaaaagtgcataagacaacggcctcctatatgaccacacaagctagatatagatagatgacggcaattcgacatggcaacatgtaccagcagttgaacatagtcgaaccctccagcccatgaatgccactactatagtctatagtagctcactcatcgccatcgtcggaccaggtgatgt

SEQ ID NO: 25047 - DNA, 2585 bp, Oryza sativa
tccaccactttcgccaccaccgacctcccgctgccgccgctcgccgtgatcatgacccggtgcccgcaccgcgccatgccggcgaaccaccccgtcgacagcactccgacggcccgccgccgtccttccccttctcgaagctgttcagcgtcagcacggcgccggcggccgccgtcaccggcggcgagcaccggtactgcgggtacgccttgccgtcctcgcagcagtccgggtcgttgctcttctcgcagttgccggacttgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacatgatcgcccgcctgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaattttcaaggctcatgagaatgctctctattccatagcagcttttatataccagtgtttcggtgaagactgttaagttgaactttcacctagaaaaggagctatacctgaccacaactgaacaatggactatgccttgaattgtcagtcttgtgcagttaagtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacatggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactatttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcccgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggtagctcgaattcgccctatagtgagt

SEQ ID NO: 25048 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnnnnnttcagttgtctcgaatctcgatgaatgcgtttgagtattagagattcagagttggtgcctgttcttggccgatgcgaaatttgaactcaaaggaatagttgaataaaaacgtctgaataggatgcactgaatatatgagtttattccaggtgattaataccatatcatgagttggcaatgccgaaaatcttgtcatgttctttggatattctgaattcagcatctgttcacctagttcgtgttacaaagcggcaaccatcgtgtaatcaacatgttttgagtctgaatctgtcatcaagtttcgatcgagatggaacacgagctgctagtgtcgtcgttgccaccggtggactgaatcagccgtcagcgccatacgtgcgtgggctcggaagacattcgcacggatcgggcgcacggtggcctctagcgacagctggatcttcttcatacgaccgcccttttccccggcggtcaccattcttatccctggcgccattggtccgtgcgcctggagagaggagatttgaaatgtgtgatgattttatgattttggtgagatcgtgcgaaatcaatatgcaaagaataatgaaaaaaa

SEQ ID NO: 25049 - DNA, 1835 bp, Oryza sativa
  unsure (1)..(1835): unsure at all n locations
ctatagggcgaattcgagctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagtttgtagcggatggagagctgaacaaggacgaagtggaagctttgatggcattccaagtgcgtctctgcattccacaagaaactgttgatgctgtccattcagaaatctgtggcaagttgtttgaaaaggtgatatgaaatattctatgttgcctgttctatatttcccttgttcaggcaaagttgatggcctgttctgtgttagtggtgttcttacaaccgttagtgctttgcaggttgtcgtggaagcaatttcatctgttgatggatatgacactaatagacgacaggctgttaagaaggcagcacaaggtctgaatttgaaaaacgagtctgtcatggccattttcagcaaagtggtatgttaatccccattaccaaaaaaaagtgctagatgatattatttttcaatatattcctactgtgaatgaaattcacttctatattaccaaatccatgaccaggtacggaagttattcctgaactacattcagagagcaaaagcagctgggaaccgcattgaaactgcaaaagagctgaaaaagatgatatccttcaacacagtagttgtgagtgagcttttagctgacattaaaggagaaccaacaactgctgaacctcaaacatcagatgcaacctcagaacctgaagtcagcgagtctgagggggatgatgaatacgaatgggaacagctggagacattaaggaaaactaggcctgataaagagctcagagagaaactggcaaagtcaagccagaaagagataaccctcaaagatgacattccattgagagacagagctgagctgtatgaaacatatttggtgttctgtgtcactggggagacgaccaatgtttcatttggaacagcaatctccacaaagaaagataattcagagtatttaatgctgaagcaattaggagacatacttggtttaacccgcaaggaagctcagaatgttcacattaagatggcagaaaaggcatttgtgcaacaggctgaagtgattcttgctgatgggaagttaacagaggccaaggctgaccagcttgcaaagatacagaagcaagttggtcttcctactgagtatgcacagaaaataatcaagaatatcacaacaacaaagttgtcttctgcaattgaagcctctatttctcgaggacagattggtatacagcaggtccgaggattgaaagaagcaaattttcaattggacagcttgattgcagaaccacttcgagaaaacatttacaaaaaatccgttgaggagatcttttcgtcaggcacaggtgaatttgatgaagaggaagtgtatgtaaagatcccagctgatctcatcattaatgctgagaaggccaagtcgattgtccaggacattgcgaagattaggttggataacgcccttgtccaagctgttgctctgcttcggcagaagaagaaagatgaagtggtacgtaaggaatatccctgcatatctcctacttatttgttttatgttggaacttagtttctccaagaatctgaaagattaaaacactgactacagttatcaaagtactgatttagcgttgactttgatcttggtnnnnnnnnnnnnnnnnnnnnnnnnnnnnnnnnnnnnnnnnnnnnnnnnnnnnnnnnn

SEQ ID NO: 25050 - DNA, 1108 bp, Oryza sativa
  unsure (1)..(1108): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagagacggcgggagacggcggtgcaggagtgggaagaagcacggccgccagatccacgccgtcagtggggtgggggtgggagaggagggggcgggggagtcgctgctatgcacgtgggagctgagggagaggaagagagagagcggggaaggagaagaaaaagtggtgagaccagcttgaaaagaaaaggtgatgggcccactaaagctacgagtgcactgtagagaggggagtttcgactgcttttcttcctacgtggatatttgggctcctcaataagacaagccgcattgctattgccctatagcagcgatgcgatgctggttttactcagtgttatagacaacattctgttagagctagacgactcaaattatttttactttctaaggttacaatataaatatataaatatggtgtggtatgtgttgtgttcggttacaacatctccatccttcattttcttttagagcttcatctgtcaccaaagaatgataaaatttaagaaaaatttttatagtatctgagatgtaccaagaggtatcaattctcttagtataatttagtattccctctttattacttgatatatcaagaggtgtttaattttacaaaagaaaaattacgatacatcactgttagggaatatatataagcttattaatgggaaattatacggccgtgttacatggcgtctacgtcactacgtgtgtcgtcgtcgtcgtcaagcatcggcccaggtgatctgggcctcgccgtcgtccttgttgagccccagcgcgtcccacaccgccggcgacccgtcgacgatgttgttccggcacggcggctcgaacttgtggtcgctgtcgcagccgcgctgggagtcgcactcgtcgacgaccatgtctgtcacggacgcgccg

SEQ ID NO: 25051 - DNA, 691 bp, Oryza sativa
aacatgagacggtttttatcaagcatcaaaatgatgatttagcatgtaagtatgttgagttttataatataataaattatggttataattgctatatttatacattaaactttagatatttggtgggttggcgtggtattcttgcatgttaagttttaagatactaataattactatatttgtatgttgagttttagatgtttagaagctgtaactatatatagaagatatagatatattggttatgttagtaaaacttttataaatatgtccttagcttttaaagacaataagtaaaataaagtataataacaataccctaaaataaatgtcaaatttagttttaaaatttaaatttatctccttccgttgaaaggacggccatatttggtgaactctgcctgctgcagtttttttaaaaaaatcttcaactatagatttctacatttaaaaataaattaataagtagaaaatccagttttttttaggtcctcaccctcaacgtactcacttgagcttctcccacacgggccgatgttttttgaattgattatcggagtttgttgggaatctgtcgtcacggaaaaacctgttttttttcttgctgctgtccgcagcatcttgcattgcatctctcatctttctttttctggcattaaagagcttgtataatgcacaagcatcgatttta

SEQ ID NO: 25052 - DNA, 1211 bp, Oryza sativa
  unsure (1)..(1211): unsure at all n locations
nnnnnnnnnnnnnnnnnnnnnnnnnnnnnnnnnnnnnnnnnnnnnnnnnnnnnnnnnnnnnnnnntttagtttttatcaatttgggaataatggagtaatatttttctagcaaaaggcaacatatatgttgacagcgttccttatgatagaacctaagtactcaggtttaagttgtagattttatatgtgtattcgcatttacgattggttatattttaagtggtaaataaatgaaatatacgttgagagtgagatgcttgtgattatctaattaatcttaaaatatactacttaatttttcggagatgcttgtgtgtgttttataaggataagtgtggacaagctgtattgctgttctaataattttgctgagaatgtaggatagaattactatgctcattcatacataagttctacgtgatgagtagttaaccaacgtaagtgtggggcatgtgggctccttcttctatatttttcttttacggggaggacataagactggagctcacccacgcccagccgctcgtctagttttttttatctttaagatgcttttgctatttaattacaccatcaagatatggtatatcctaatactatgaatttaaacagagcattatattttaagacggatagagtatctatcaagtgaatggtgacactggaccaacgataagccaacaagccggtgtttttttttcttactaaatgcttttactatttattatgtattagtataagtgaatgttgacacttggaccagtgatcagccaacgaacctgccggcttgagaaggatgaatcggatgtagtgaaatcggtcaagcctccaggatggaccaatggaaatacccacaattcgtgcaggtcccatcctggctccaacttggcatgtacagcaacaagcaataaatatagctaggctttttagattgtcaattagacagctgatttgctaaaatagaggaaagaaaaaaatcaaatgtaaagcttcacaacgccttaaaattaactatttgcatttacaaaaggaatattttctatacataagggtaaggaaaatgaaaaaaaaaaggtaataaatattattttgaagtattaatagctagaaccttcgttgtctcaattgttatgcgaggttagtctctacatagctgnnnnnnnnnnnnnnnnnnnnnnnnnnnnnnnnnnnnnnnnnnnnnnnnnnnnnn

SEQ ID NO: 25053 - DNA, 652 bp, Oryza sativa
gtgctgccaggacggcgtccagtacatgacgtacgcctgctcgccgcccgtcgccgccggcggcaccggcaccgcggccctcctcacgctcaacagcttcgccgacggcggggacggcggcggcgcgccgtcctgcacggggaggttctacgacgacggccagctggtggtggcgctgtccacggggtggttcgacgggaggagccggtgcgagaaggacgtcgtcatccgggcgagcggcggcgcgtccgtgacggccatggtcgtcgacgagtgcgactcccagcgcggctgcgacagcgaccacaacttcgagccgccgtgccggaacaacatcgtcgacgggtcgccggcggtgtgggacgcgctggggctcaacaaggacgacggcgaggcccagatcacctggtccgatgcttgacgacgacgacgacacacgtagtgacgtagacgccatgtaacacggccgtataatttcccattaataagcttatatatattccctaacagtgatgtatcgtaatttttcttttgtaaaattaaacacctcttgatatatcaagtaataaagagggaatactaaattatactaagagaattgatacctcttggtacatctcagatactataaaaatttttcttaaattttatc

SEQ ID NO: 25054 - DNA, 1242 bp, Oryza sativa
  unsure (1)..(1242): unsure at all n locations
nnnnnnnnnnnnnnnnnnnnnnnnnnnnnnnnnnnnnnnnnnnnnnnnnnnnnnnnagagaactgtaggtaatattttaccgtaccccgatgttcctccgccctcactaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccgcatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgttttccatctcttatagtttgaaccatcaaaggcatgtggtttcagtgcagcagcaaagccaactaccgaaaatgacctatcaggtttttggattgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaaggatggtcctccgctggaagttgaggcagtattgcctccgttggtgttgacgggagtctccttctc

SEQ ID NO: 25055 - DNA, 4829 bp, Oryza sativa
  unsure (1)..(4829): unsure at all n locations
nnnnnnnnnnnnnnnnnnnnnnnnnnnnnnnnnnnnnnnnnnntcatggaataggaagaggaatggagcaactaattgtcatcaactagccatgaaccatccttcactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaggacttccccgggaggtagccgctgggacggcacgcgccgccggcgacggcgccggggcggagggaggaggcgaggtgggtggtggagagcgcggccaggaggaagatcatcgccatggcggccactgctctggcactcgccatcttagctagttgttgcgctaccttgttgtcttcagttttcttgatgagtttgtgctttgatttgcttgatggaatgggattagagatgcatgaggttatatagctttgttgcttgcattagttaatcaattggttttctggcacggcaatccgttgctgtgtgtgttcagatgtagctacacgttcacggactcgcattatctctcgacgaactgacgtgccgttccaaacgattctccaataccttttttttttattatctgtacgttgtgaatctctttaatttcgtgtctaacatgcataaaattgattgttaataatcgtgcttaattaagctttagttcaactaactcgcatgttcaattgattggtaataatcgtgcttaagattcacctctttagggcaacaacaatgcttaaaatcttggtgaaaatttaggacccatcatacttatgtttatgaccacaatgtatatcataaaatcttatagctcatttttatggcatattgtggatgttcttagtgtctgtcaaggaggcacacgagtgttattttttttagtgtgtgcattttttgtaaagtatagttttgtgagtattgagaaataccaagaaatgacttatttgagcacacagtactacagctgccgtaaatcagtgtacccattcctataagaatccgtaattttttttgcgataaaaaaaaccgtctttttttttcgataaaaaaaaccgttgtatagcataaaaaccgtcaaattcattattctgtcgaccaaccgtcaagtaaaaaccgccgagtcgtaagggaatattcagttttgttggccgccgaaagggaatgacctctttagcgttcttcagacaagaccacacaacctcgaattctcccacgctcgcgttgagcccaagcttctcccacaccaccggcgacccgccgacggcgttgttccggcacggcggcgcgaacccgtcctcctcgcggcacccgttcacggagtcgcaatcgtccaccaccctggcgaccacggacgatcgtccgctcgccgcgccggcgacggcgaagacgcggatcctccggtggcagcggcggcggccgccgccgaggcgcagccacccggaggacagcgcgaccaccagctccgtgttccggtggaagcgcatgtcgcaggacgtggggacgcctccgtcgtcctcgccgtggtcgaacaccttcagcgtcaggatcgccggcgtcgtcctggccgatcgacaccggcggcgagcacctgaaccgcgggtagcgctcgccggcgacgcagcagtcatggctccccttgggacacctcgtctcgttgccgtggaggtagacgtagccgctggcatggcagctggccgctgcatcagagacgccatggatggtaggggaggtagacagcaagctcatggcctgcaagagagcaaacagaaatagtatagccttgtgttatccatgtctcctactactgatttcaaagtttcttcttcttcgttttctttttaacaatgattcaaagtttctttgatggaattcaaattcatgaattcaagttcatgttgaatggatggggttaattacatgcatgtgtggcatatatagggagctctatgtgggatgttccagcaattcgtatgctagtgttttgactggacatgtaacacaatgtgatttttcttggtttgtcgatcccaaggttattagtgttttgaccaagaaattttatgtgtttccatgtgcatgttagaagttgaatcatttgataatgttaagaccagtgtcgtgttgtgttgtgttgtgttgctcaatattagctttggtactagccagtgattcactgagcaacggagtagttaatagcattggtcattatctcaaaaaagtaaactgaaacttaattgagctggtcaaaattggcatccttgtgatcgctatgaaagattatgtttgtaccactgaaaaatcaggaagcatatatagcgcagtttccatgaatctatgttcatctaaaaaattcaatcccaaaatctcaaagcgcactgttattacttattaatactagtagcagcactgcagcaacactaatactaacaatgttattatctgaatatttcaggtactgtggtatatgcaattgaaaaagctgaatccaagtgtttttcttatctgtgacttttagtggaaaactgagattctttcttttgtttttgtcccagctcatttacatttctcttggactgctgtctgtacacatcacatatcctatataattttattgtacagttcatgtcttggagttgtcattttctaatagtttggactgatggataaaactcaaacatttctatcattggaaggattcaaaacatatttattgatgtggattagaacacttgattgtgttgtcatagagatcgaagatgcagtaaaggagtatcctatggcaaaagtaaacattacacataatgaaattcattgcattagtgtatcacatattgaacaagtgcctttatgtgctaacctcctttgctagttgtaaatttcagggtttcaacaattgcatagacatcaattaaaaaagaaaaaaattgaacaaaatgtctggcctattttcttctgaaatcttgtaattaatcatgatagctgtgccatcactaaagtactgaaatatataatgagtcatttttcccacaaaatgctagatctactagcactaaattattttagtgcaaataatactaaaacggcatcacattacaggactatatacacctcttataactctatttatgctgtatagctctgtagactgactactgttctacacctggatattgctatagagttacagttatgtaaggctgcatgcattttgtctgtcctgcttacagtttatcttacattttagagagcttttgtgttttcaatactagctgcatggatcaactgaagatacaggtcatttcacaactcacgagagaatacagggtcatacttaacatagcaacattctttatgaaagatagcagcacagtacacattcaacataagcattatgttgagtagaaaatttaatgtaacaacagaaacacacactgtaatgagcacttttggggaaatgacaaatgccagagtaacggcttattcgacgacaacttttacggggctctctactagtatacgacagtatacccgttgtaagtgcagggtaacgtatgtattaattaatgtgtatatatatatatgtgtgtgtgacgtggccatgacggcatggctggttcttcagacatcagaccaggtgaccttgaactcgccgacgccctcgtcgaggccgagcgccttccacaccgccggcgagccgtcgacgacgtcgttcgggcacggcggctcgaagttgtgctcggcgtcgcagccgttcaccgagtcgcactcgtcgacgaccctggccagcgcggaccggcccgttgcggcggcgacgcggatcatgcggttgcaccggctggcgccgtcgagccggagccagccgctggagagcgccaccaccatggcggtgtccgggtggaaccggccgtcgcaggacgacctcccgccgccgtcgccgccgcggggaagcttgttcagcgtcagcgtcgccggcgttggcctagccgaggacaccggcggcgagcacctgaactgcgggtaccggcggccggtgacgcagcagtcggagccgtgcgccctgttgcacttgccggcctttccgtgcaggaagccgctgatgtggcagccgccgtcgccgccgccgccgccgccgccttgcttcggcttcggctcgtgcttgccggtggccacggcggagacgccgccattgtcgccgccatggacgacggcgtgaagggacatcagctgcaagagagcgagcacgaccaataccttcacgttagccgccatggctggatcaaagtgagctcttcgctggcttaattttgatcttgtgagtgttgtggcaagtgtattatatagaaggacttgctcgaggagaagcagttaactgtggcattaatttggtttacctagcaagccatgtaaattcagccaaatttcattggttttgtaaccccagtaaaaacttgggtggtgaaaatatcacaagtttgtttgcacatgaagatggaatatcatatatatcgtgttacacataattaagctgggttaggacaacatagctagcgtaatctgaatccaagtgccgtttccgtaattg

SEQ ID NO: 25056 - DNA, 7489 bp, Oryza sativa
tcgtgccgggccggcccgaagacataacagtccattatgcttctccaaagaatatgtctatttttcctccctcaactttttgggctgtgtctatatggctggacaataagtctattttgtattcctcttctctttgggtcttgtcttatatggttgattaagtctattttggatccctctactatttttcttcaattgtgctaggccgtgccggcccaccgtgccgagggagtagctcaggcacggcacggctgtcgggccgggccggcacgggcacgaccctagtcaggccgtattgtgcttgggccgggccaaattgccgtgccttgggctgggccgtcgagccgtcgggccatatggccatctataatttgaactcatttttttttaaatgacggtcaaggatcagccaaacttggtcaaaattaatccatctggctgcaaactttaactatattttatacatggtacacttgttttattgtatcatccgtaagcaatacaagtaataattgtataaaatccatagctatgagttccaacaatctatatatatatatatatatatcaatcaacgctggtaattgatctcatggcattcattctaattgcatgcattgatcgatcgatcgatcagttgccgtacttggccttgtaatcctgccacagctgctgcacggtcttcccggtgatctgcacgaagtagtcgacattgtacccgtccttcaacttggcattgatgtcggcgacgaaccctggcttgacgctgtcgcagtagtcgaagaacctcgccgtcacggagtagctgtcctcccagctgttcccttgccccggctgcacccagccggcggcgacgtagccggcgcgcagccgcacgaagtcggcgatcccctcgtacacccacgagtgcgccgcgtagtcctgcagcccccactgccacacgtgcgtcgcctcgtggtacagcacgccggtcacctccgtcctcacgtcgccggagctggagctgtagccgccgacgtaccgcgcgctcaggtggatgccgtcgccgctggtgaacgccacgccgtcgatgtcctccacggtcagggtcaccgcgtccaccggcttccggtcgccgccgtcgccgggctgctcgaaggcgtcccagatgaaggacgacgcgtcggcgagcacctgcttcgcgtagtccacgccgacctcccggtcgaaccgctgcccgccggcggtgctcgacgccgtgttcgtcgcatcgaacgtcacggcgccagcggccgtcgcggccgcggccgcggcggccatgagcgccgcgagagtggccatgtggaaaggcttcatttttctttttatgatcttgtattatcgatgtttgttacggaattttgctaaccatggtagggtttatataggttagagaaaaatgtgttttcgaaattcgaggataagtttgattagctaggtgattgtttttttaagtctatagtcaaatcgattgacttggaattagtcaaaattggttatatttcttctgaaatttgatggaaggaagctggcccgtgaagatttgatatggacatctaatattttatttttgtttttattccaatcaaaccaggagttgtttattagtctcagataaaagaagtgcagtgacggcaaaggaaacgcctgaaaataatctggcttttagtatcatgacttctaactcttctggatgcatcaattaatgtatgtttgcagatccgctagcaatttcactatgggtgtgtttagttgggaaaaagaaaatttttgggtgtcatatcagaagtttgaccggatgtcggaaggggttttcggacacgaatgaaaaaactaatttcagaactcgccgggaaaccgcgagacgaatcttttgagcctaattaagccgtcattagcacatgtgggttactatagcacttatggctaatcatggactaattaggctcaaaagattcgtctcgctatttccccataactgtacaattagttttttctttttatttatatttaatactctatgcatgtgtctaaagatttgatgtgatgttttttggaaaaaattttggaaactaaacgggccctctcttctctatctgaacataatataaatatgcgtgtcctaattaatatcaagcatatacatctgaaattatttttgccattgcgtgtcggcattacatttcgtgttggagacggtgcagcttgacttaatttgccaagagattaatttccatgttgccaataattagatacaattcagatcctcttcagtactacgcatgcagcactgcagactaacatgtaggcccgaggatttgtggggcccacatgttagtgagcagtactgcagagaacctcagtggagatgggacatgtgtgaccagccaatttccaccaataatatttcaaatctttcctgttgcaaaaatgaatatgtactctaaaatgagaagtttttttaggacaaactttaaatcctaaaatggcatcgaggaagtagtagcatttaggagtaaccatttatggagtcatgatagattgacaggacagtacttgaagctttgacagtgagcacaaattgattacagatggagtataacaagatcaggcagtagtatttcgttgaattttcagtaaagtttcaggcctgcttagattatagttaaaataaatattattaaattttattaatgctaaaattttagcaatttaacaatattgttaagttttgacaggatttcttatgtatttatcagagtttaataatgaactaaatggatgcatatatttaacaactttacctaaatttggtaagatttattttagctacaatctaaacagtccctcggacatcaaacatggctttatttattgccttattatccacatatctgatactaactacagtactactatagtactatatatatatatggccacctcgccggagctgacgtcacgtcagctagccgccgtacttggccttgtaatcttgccagagctggtcgatggtcttgccggagatctggacgaagaagtcgtcgctgtatccgtccttcatcttgccgttgagctgcgccacgaacccctgcaccaccgccggcgagtcgcagtagtcgaggaacctcgccgtcacgtcgtacccctggtcccaccggtcgccctgcccgggctgcacccagtgcggcggcgcgtagccggcgcgcagtcggacgaagtcggcgatcccctcgatcagcccgccgtcggcgccgccgcggccgtcccactgccacacgtgcgtcgcctcgtggtacagcacgccggtcacctccgccctcacgtcgccggcggcgctgtagccgccgacgtaccgagcgctcaggtggatgccgtcgccgctggtgaacgccacgccgtcgatgtcctccacggtcagggtcaccgcgtccaccggcttccggtcgccgccgtcgccgggctgctcgaaggtgtcccagatgaaggacgacgcgtcggcgagcatctgcttcgcgtagtccacgccgacctcccggtcgaccgctgcccgccggcggtgttcgacgccgtgttcgtcgcgtcgaacgtcacggcgccggccgtcgcggccacggcggccatgagcgccgcgagagcggccacgtgagaaggcttcatttttttaaaaaaaaaataaaaatcttatggatgcacttgcaaattcgataacaatggcagggtttatataggttagagaaatgtgttttcgaggataagtgtgatcagctagctgatgatttttaatctatagtcaaatcaattgacttggaattagtccagattggttatgtttcttctcaaatctgatggaaggaagctggcccgtgaagatttgatgtggacatacgtgtcatacctaatatttatttatttattccaatcaaaccagaagttgtttacagtattagtcttggataaaacaagtgcagcgacggcaaggaaacgctggaaataatccaagcttaatctgacttatagtagtgtcatgacttctaactcttctggatgcatcatttaatgtatgtttgcagatctgctcgcaatttcactttcttctctacgactgaatagaccctatctgaacataaaacatacgtgtcccaactcccaagtcctaatataaaccatatctgaaatcattttctagcatttgcgtgtcaacattacatttcgtgttgcagacggtgcatcttgacttaatttgccaggagattaatttcaccagatgacccaatataatcttggagatgggggcatgtacgagatctttgctgtttcataaatgttgatctctgtttggtgtcctgcagcgtacgaaattcagatagaccggcctaccacaagctagaaacatctggagaagcagctagctgaattatatcttttctgaacttgtgacggctgggagattcagagtttcgtttgatggtggcactgacaaaacctgaattctggttaattacaggtaacgcctaaaccagaatcgctggctcaccacctgtacacatttgtgcagcatatggtctaaactctgaagataatggagcgatttgtttgatttgcaagccggcaggcagctgatcggaatcagacgatacagacaaggcagtctgcagtccgaccaaccagtttagctggagcagttcggcgttttgcagaagctgcaggagaaattcgagaccttggatgtctcaatccgaactcactgttgaaaaccattttctaaattttgccacaaatcacggattaaatctacgtacgtggcgtgcaaatcctgtgcagaaaaaacggtgttccctgttcagttgcataccggcgactgagcagactcgctcctgattgggggaaaaaaataataataatctgcagccagctgcagtgcactcgcagtcgattttccgaccgaaaccgtacgtggcgttcacttcaccgtgggatcgaatcatccaaaaacatcaattcgatatttcgagagaaagcctggaaaatttaggttgacagctctgctgcccagagaaaaactcgtaacgaactctgctgaaatccaaaagcggaagtccaagtcaagaaatttatcatttagtacaccaaataggtcaggctgctttctttctctcttttttcccttttttttgtgagaataggtcaggatgctttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcgtttaatttggaacgagggagtactaacaaatacgtatacgtacttagcattgctgatgttcttttcgaagaaattcagacatcccgatgttggctataaatacttcctctcaccaattgcccacataactcaccaagaccaccagacatgaagcttcacgtcgtggcagccatcctgctggccgtggccgcgtcgtcgtcgccgccgcccgccgccgccgtcacctacgaggtgagcaacgaggcggcgagcaccgccggcggccagcggttcgaccgggagtacggcgccgggtacgccaagcaggtgctcgccgccgcttcttctttcacctggagcatcttcagccagccgagcgccgccgaccggaggcccgtcgacgccgtcgtcctcgccgtccgcgacgtcgacggcatcgcctccaccagcggcaacaccatcacgctcggcgccggctacgtcgccggcgtcaccggcaacgacttcaagacgcaggtaattaatagactccggctcatccatgttgactgactaaaattttgaccatccaaactatacacctagactgtgtttagactgtgtttagtttacgtcaaaattaaaagtttggttaaaattagaacgatgtgatgaaaaagtttaaagtttatgtgtgtagaaaagttttaatgtgatggaaaaattggaagtttgaagaaaaacttcggatctaaacatggtgacaatcaacgataatatttacggtgttcctactaagacttcgttcggcaatggctaaattaaagagagtaaaactatttcgttttctgcacgcacgtcccaaacattgtgtttatttttaaaaagttctagaaaagttatttttaaaaatatatcaattcgttttttaatttaaaataattaatgcttaattaaatcatacactaattgctcatcttgttttatatatcttctcaatttttctctttcccatcatcttaaacacacccactttaataaatgtgaccatagatgactagaattccaaccccgatcgatgtccccaaacaaaattaaatctaatcaaccacaacttttacgacaatctctagtttttccaaataatcaagttattttttctcataggtgaccggagtgttgtaccatgaggtggtgcacgtgtggcagtgggggctgcaggattacggggcgcattcgtgggtgtacgaggggatcgccgactttgtgcggctgcgcgccggctacccagcggctggttgggtgcagccggggcaagggaacagctgggaggacagctactccgtgacggcgaggttcttcgactactgcgacagcgtcaagccagggttcgttgccgacctgaacgctaagctgaagaatgggtacaacgtcgactacttcgtgcagatcaccgggaagaccgtgcagcagctgtggcaggattacaaggccaagtatggaaactgatgatcgatcgacgcagagaatgaataagacaagagattaccatcattgattgatatagattgttgtaactcatagctatggagtttacacaattattgtattgcttacggatgatagaataaagggacgctgtctagttttcaatcacatgaaaaatacttgcaaattttagtcctttttcaacggtctagattgcctcaagatttatgcgctacagtaatcataactaatctttttctcttcctctccctctctcctcactgactggcacaagcgtcagatcgaaaatgccctgtcgtcgagagccacctgtcttccccgccctagcacgtctcttttccttccctctcttcctcccggctccctaaggcctcctttggcagcccgggatcccggtgggatccccgcccattcccctgggagaaaggcccgcggtgaaaattttcacgggcttattttctgtccatttggaagcccacgaagcatggatttcccagcccaatccgcggggaagccctagggaaaggaccccgacctccggagatcgggaattttt

SEQ ID NO: 25057 - DNA, 9728 bp, Oryza sativa
  unsure (1)..(9728): unsure at all n locations
nnnnnnnnnnnnnnnnnnnnnnnnnnnnnnnnnnnnnnnnnnnnnnnnnnnnnnnnnnnnnnnnnnnnnnnnnnnacttacggatgatagaataaagggacgctgtcgacttttcaatcacatgaaaaatacttgcaaattttagtcctttttcaacggtctagattgcctcaagatttatgcgctacagtaatcataactaatctttttctcttcctctccctctctcctcactgactggcacaagcgtcagatcgaaaatgccctgtcgtcgagagccacctgtcttccccgccctagcacgtctcttttccttccctctcttcctcccggctccctaaggcctcctttggcagcccgggatcccggtgggatccccgcccattcccctgggagaaaggcccgcggtgaaaattttcacgggcttatttcctgtccatttggaagcccacgaggcagggatttcccagcccaatccgcggggaagccctagggaaaggaccccgacctccggagatcgggaatttttcctcgcgcgatccgccgccgcttctctctcgcgcggagtcttttctctcgcgcgcaaccaatgttgggcgccgccgcgcctccttcttcggggagacgcgccacccgccggactcctccggcgagacaccaccagcactgcacccgtactagggtaagccttcttctctttcccctcctcttcttcttcttctaggggttctgctcttcttctttaaggtttcccctcagatctttggctcagtggctcaattctctcttctcatcttcccccacaagcttctctagaacagccaccgtcaatcttgctcccacctgaagcaacacgacgcgctctctccagtggcagtgcgccagtgccccatcccccaggtcaacctcgatagccaccaagagcggttctccagtggccgtcactaagcatcgccagcaccgtgactcagttcgactggttcgtgtcctttatcccaaatctgtgctgtgattgtttatggttcagtttggtttgactggaaatttaatttttgcatcttgtgaatgtggaactaatgagagaaaccacggtttgtgtgaatgatctttgcaaagacttgttaagttcttgttttttggtagacatgttcaggctcagaaaagagttgatctaacgaaccgcaggagaaaccaatgctttgctttcttctggagtgtgaaatttgcatgcaaaaactgattagtaatgtctttgcacaggaaatttgggaccatcagtagagcccaggtctcatcattgcaagttttaacagacaacatattattcttattttgggaatctatccatcactagtacatgtccaaaagaggatagcattagtcagtgcttagagcttacagtcaagatggacagtaggttatcgtgcatgtgtgatgacaatttacaattgtgcaggttcatatgctttaacacataagctacgtggtaaattaaacaacattgattaagaagggaacacacgcgttcactgcttcgacagatcaactacaagaattgtcaagtatgcctccttgtacttcctctcttgccataatttaatttaaatttaatacgcaatttgcaaagggttattgtactttagcatgcactggtatgtaaacctcaacttcttcactcaagattactatttagttttttttctctgctccgtttggtttcccttttctcatctctagctctagttttaccatgattctgtgaaatgaatatttttagatctaacagagaatctttttttactggacagagaatcatttttgctggagttattaggaacattttatgtttagcaatagtatatgttctgatatcttcatgaaattcattattaaactgacaacaacccttcaaagctgaacactatatcgctcatccattagaccagctaatgctactactatttttttttctgaggagccaaattgctgcataggtatgtctgatggccctacaatttaacttgaaagctctgctatttgtatacttgattcaatttcagcagatgtaaattttacaactctttgtattcagttaatctggtttaattcttctctattcttgatggtcctagcttagcttaattctgattaattattgtagtctctgtcagggaaccgtataattagtgattaatttagcatgcatgtgagactaaataaatggtaaaaaacagatttttgataggacctcgctggccaaacaaagtgacctagtagtactaattaattaaaacaacaactactactactaattagtactgctaagtgctaaccataactatctacactaatgacagtgtttgtgtgcttgcttgggggcataaaactaagagacagagttagctggagatggccacggtccgtctgaagcattgcgcattaatttgcatctcaaactgtagtagcatgaggctttaatctgtctaatcagtttgcacctaaacagcagctcaatggcactgcagttcagctgaaaatgttgcaaaagtttacctaatgaggactcacatagggggtatatatatgagatgcacttcttttccttgtcatgtccataatgataattgtcctcttgcactcttcctcttgccatgattcaatttgaatctctggattggcataaacaaggattgtcccacacagagctatactctagtctgcattttctatacaagaagtacttgaatgattttttttctaccaacgctacaggttgcacccttacttgtgtttttaattcttggatgtaggcaacaggccttgcccttgtatattcagccttgttctcaatttggagcagcgatggagatagttgatgcttatgaatgcaggaggaaaacacatccaagatatttgtaaatgataattgtatgattatatcttgtatttgctgaaagtgatatttcttggatgctcatataatacttggctaaatactgtagatggtagctcaatttgatcatctcatgaattaagttgatgcttgtatctataatgttctctattttacctagaatttattgctctaattggagttcatatgatttttcagattttttttcttgcatttttaacttaattattctatttttgtgctcagttatgtttatttagacattttttttatcttgttgtgtgtgctccaactagccattatttggtagagtaggctcaaaaattaaaaaccctaatcatcccccagtcccgtgagctgcttccaaatggtagcagggaaatctcccctagcgggaagtgcttccctagatattttggggggattcacttggtacagggaaaatccctgtatggggttttttcccaggggttttctccccgtgcatccaaaggcagcccgggatcccaccgggatcccagcccattccctgggagaaaggcccgtgggggaaattgtcacgggttttattccatgtccatttggaagcctgtggatttcctggcccaatccgcggggaaaccctagggaaaggtccccgacctccggaggtcgggaatttttcctctctcgatccgccgctgcttctcgctcgcacaaccggagtcgcttctctctcgcgcgaacaatagcgggtgccgccgcgcctccttctccggcgagacgcgccaccgccgggactcctcctccggcgagaaggataagcccttctcctcattcccctcctctcctcctcctagggtttccgttctcctcctcctctagggtttccgcttcctctagttagctcccaatctcgctctctggtctcagcgcttgcatcgcaggcaccgacgcgtggcaccacggcagccggggcaacgacgacgaggcgacgcgccggcagcgcgggcacacggctccaagcaggcggggacagggggggatccaaggcggcgtgactcaccggcagaggaggcgctgaggcgcagatccgcctcctcctcctcgctgcgcgacacccaccggcggttgcccggctaggtttgtgcatgcccttgtagctgctgcttgattcttgggggttcgttcagtacttcagttttcttggtgtatgtatggtatgtttcttgatttggtttgggagagttgtaatctgttctcctgttctttctaatacattgtagtattgtaccctgcagtagcatttcattttgttatggaagcgattcagaaggggatatgggtgggcgtatggtgctcttgttttagatcatgaatgagttttggtaagatgatgttctaatttgatggagtaggttgtgctctggttttttctgcagtgtaattatcatgcttagtgcagtctaaatatgtgagatcaatgcaccagtcccaagaaatgaggaattatcacacatgcagtgaggatcattcaactggtgaggtatatgagaaattttagtctgcaaaccagtaacagttttttgcagttaattagagatgcagttcttttagttggatgctgtcagctctgttaacctagaggtagatcttagtactggttgagctgctagcatcaagtttttttttctggaggcattttttagtctaatccattcttgtagtctctgtcagggaactgtagaattagtggtcaatttagcatgcatgttgggactaaataaatggtaacaatcatatttttgataggaactcatacttactacaaaaatgaagtcttttatgctctatacttatacattagtctaaactttagtttcatgtcatgtatcaccagcagaaaatgagcaaggtggcattgtgcattcaaaaaacacaagctttggcagcaacctatatacaaagacacgcacacacaggtatttcaatctcctctctctcactcactgcacaatacactggccaaacaaagtgacctagtagtactgattaattaaaacaacaacaactactactacttttttttccttatcatgtccataatgataattcataattgtgctcttgcattcttcctcttgccaggattcaaaggattcaatttgaattgcatgctcaacttactttcaaatatggacttgaaatagagtattgttggaaaactatcaatacaaaaacatggacttcaaattgtttgatttaaaaataatggtgtgtatctgcatgtagggtgtttgatctaaaaagaaagtgcttataccaagagtttgtttacgctgatgaagctgacaattgcaatatgttggttgatgtgcatgcattttttcctaagctagtatcaatggccgtccttcaaatttgattgctgaagtatcactattttatatttattacttaaatttcagattatctttttcatcctggcagatttattagaacaaatgaagatttgtagaagagatgatgaagaagatagaagagataaagatttaaattgtgttcttgatcaagacattgtaaccctatataaatatgatgtacagttctatatttgtggatgcaaggatgattccaaagattctaaattttgtatgatatggatgattctaaagtttgacttatgtcatgtcacgaagttggtttccacataaactaatctatatttctttgttttttctgaatttctaatacttgttgattttttttatgtttttattttttttttctggaatttttttaggttgtttcctatttatatggattttctatattctttctatttttcctgaaatttctataatatttctaaagacatgttttgttgttcaaacactatttagcagtttgcctctctaaatcccccttcccccatcaaccccctccccctactcccaaatggtagtagagaaaattcccctaataggagtgattcctctggaggtggaaggggatcggttggtacaggggaaaatccctgtacgggactttttccctggggtttcctccccctgcatccaaaggagccctaaggcattgttcggttacacaaggattcgttccgggccaggaatgataggtataacaagaaatttataataggtataacaagagaccgggatttattccagatcaggaaccaatttacttatattaggtacaacaaaatatccggattagttccacacctcttaactggtggattaattcccggtctcttattgtccctatcatgagcaaattagtttccggcccaaaataaatcccgacctctcgttgtatctatcataaatttcatattatacttgttattcccggcccggattgaatacttgtgtaaccgaacaagggttaaaccggcgatagcaccattcctctacgccattctcttcgatccccgtctctagcagcgagccgcaggattcgtcatctcctaactccacagcctcccttgcaccctatcatctcattgcccaaggctattcctctaagcttaaaaccatcctctcccctcccctcccaccctggcccttacccaaaacctaaaaccttattagcataaatcatctttgaaaatacacagtaaaacatgaaggctagctagaaccgtgatacagtaaaataatatcttctcaagaacagtaaagcatctgttaaaaagagagcatggtgtgtatatctttcatgcatgctcctttgatctaatctatggattagaaggaaaatataacatcagcacttatattttaatgagaaaattactctcgtctagcttgcggtgatcaaaactctcaatagctgtattttaactgcaacaacgttaagttctgaacactcagcctctttttctcgaactaacaaattacggtacttttcatgcgagatactctggatcaagtcacaaatcgtggctcaaatgcatatacgcacggtgacgtgcatgcaaaactgcagatcatgggaacaaaatggtgttctctgttcagttgcagaccgagtagtgtgcaacaagcaagtatatattgaggaccaaattaaacacgacatgagactcgactcaactcaactcaaatacctcctgattggacaaatctggaagccagctgcactgcacattcagtttgtccccatcaatcggttgctatgagctgattataagctaaagtggcttatatacatgttcttagcggtttagaaataatattctaaaattaattttaaaattaagatcctgcatgtctaatgtaaatgatgaggctggttgtctatatattttccgacagcaagggcgtggcatccctttcacaagggaatcaaacccttccagaacttccagtcctgtgagaaaaaaagcttggaaaaatcgggctgacagctgctgcccagagaaaagctccgcactctgccaaaaatccaagactccaagtcaagcaacttatactgaagactacttatactgaccaacaacgacgtatatatacgtacacgtttgcacatgcaggacatcttcgtgtgcctataaattcgggaaatttaactatttgtcacttttacgtttggcaattagtcaaataccttttttagatttgtacttaacaatttgccatgggaaagagaagcttttgtatttttttttgccactttgtgcactgtagagcgtcacctgtgcatgccagcatggaactgacgcaaaaaataactaatctacccctgctagcaattggtactgtcctgagttgataagcttgaacacattgaatcttagtcataattttaactggagagataacaagagaaatcggcaacatgtccaatctatcctttttaaatttgcaagacaacaagatcaatggcaccattccggttacatcagttcatcaacttgtttaatcgagctaagtttgggtggcaccatcccaacaatgccagccaaattaaataccgtttttaatcttaggcccagttttttttttcaactacaaattacaacttcctcggtttccattatcacgtttttcaaacggttaaatagtgtgtttttataaaaaaaagttatgtaaaagttgtttaaaaattcaaatgaatccaatttttaattttgtaacaattaatatttaattaatcatgtgctaatgagctttctcgttatatgtgcgctggaaatttctctctcaactgagagatcgaacaggtcctttgatgtgtccaagacccgggcattttttgttggagaaatacaagtggccgtgcaggagcaattcaaagaatatatatatataggttcggttcttgtaccgataggctaattaaccaactatcattaatagggtcattagcggctggattacccaagtaattagtacattttactatctgccctgtaacaggggaggaatttttgtgttgttctgttgagagttctccaggaaagctgatggcgatcccatctgcgaattgacattattgctgccgctgtgaaggttggagaagaagctaggtctggagattattttcctggtcttgctacttggtacatgttagtgccctttcttctgatcgtgtagaaagcacgggtagaggattattttatctagggtttggtcttcaactgttatacgccgagctcttgattatttggtttgtttgctgctgaattttatctatatatgcaagtctggttaatccatcagtgttgagattaattactggagttgtgatttttattagctgctgattcagatcgttggtgacctcacgctgcctggcaagttcagaaagttaatttgttaattgctattggtaccgtaaaagagagggataaaattagggtactcggtgttgggtaatcatcatccttacccataacatccggtggatatatttcttcaaatattggttcgttattcgacttggcggtactcgatcttttatacaaggacgagcaggttgtcctcggatcatcaatgaccacctcataacagtgaacaacatccatccagattcagcctataaaatacagccaattgctagcaggggtagattggtcatttcacgtgcctggtccaccctggcatgcatgtgtggcgctgcacagtgcaggaagtggcaaaaaattacaaaagcttctctctagtggcaaattcttaagtgcaaacctaagaagggtatttggttaattgtcgaacgcaaaagtgacaaatagttaaatttccctataaattctgcttcaccacactcccttaaatcctacactaaaatttttcactctatcacatcgaacatttcaacacctgcatgaattattaaataaaggctaaaaaaatatcgaactacgtagattgcgtctaatttgcgagacgtttaagcctaattgctccatgatttgacaatatggtgctacagtgaatattggctaatgacggattaattaggcttaataaattcatctcgcagtttataagcggattctgtaatttgttttattattagactgcgtttaatactttaaatgtgtgtccgtatatccgatatgacacgttaaaactttgcacccctgaatctaaacaccccctaagaaatcctatacttttcttaaaaaacaatcagacgatgatatgccatatttagaaaatgcgcaaatttttggattagatatttgaactggcttccgtcccacatggcactaacgtggcattagaaataaaaaaggatacctaggacctaattgtcattcacattaaccatattatggggaccactgacatggaaggcatca

SEQ ID NO: 25058 - DNA, 2694 bp, Oryza sativa
tcgctcgccatggcgctctccttcgcagtgatggtcacgcggcgtccgcatcactatccgtaagtccgccgcgaagcgcaagccatccacctctggcagcccgtggtacggacccgaccgcgtcttccgctccaccgatccggctaggcacgtgcggagcccggcaaggaggagagaggaagatgggggcggcctccgccactagctctctccccgccagccaccgtcgaccgccgggctctccaccgacctgccatcactccggccctcgaccgcccgccatctcctctactgctgcctcctcctcctcagcctccatccgcgccgactccagcccgaagcgccgccaccactctagcccccgcccatcgccatcactgtaaagaagggaaagagagggaggaagaagagagaggatgacatgtggggcccacacattagtgggccccatattttttttcgaatgacaaatgggtcccacatataactctaatgccacctaagcgtcacgtcaacgccatagactagtcaatattgtctcgtagacgccatgttagtgaaaccaccctccaaaaccaccgagggagttaaattgcaccggttttaatagttaggggtcgagatatccggtattgcgtttgaaggatacagataacattctgtcactagttaagggagaaaaattgaacttattccattttctgacgcacgcatgaaaggtcaagctcccactgaaaatgggccgcactaaatggaccggacggcccacaaaaagaggaggccacgtggccttgctactaggtaacatgtgggccatcgcgtgggcgtggtcggagtttaattctccgaaccctgtctaacatgtctctggcgatataccagcactccagcatacagcagctctagccttgctggttactgtagtctgtagttagtagttaatcgtaaaatttgccaaaatttgaagcagaatgttatgctgaattttcgaagttctcctgtgatgtctgggagatgaatgccaacaaacagataaacaagaacccaacaatcaaaaccttctgtagcataacctgattcagtatcatgtcatgtgcatgttttcaaaacaagaaaacatgttaagccatgcaaggtttgcttgttccactgcatgcgtataacaaaaacccgcagtcaggtaacataattaatctaaccaaggcggtgatgaattcttgagtacaattgctggaatgttttgtgttgcgtcaaacaatatatataatatgtgcggccatgaacgactccaaacctccaaaattaaggaggttactgccttactgatcacgttgcagtgtttcttggatttgcatggtagctgatctcagcagagccctaactgaaatataccataacatgatgtcaatgaggggtcggagttttaaactccgaactcctttgggatctctgacggccatttgatcacgcttgcgtttgcgcagattgaacagtgaaccgatcgagtagagagagccacggcggactcgtcgatcgaacacatgtgacatctcgaaccactttacactgcatctctgacatgccgcgcgccggacttgtggcaattcgtcagtaatcgccgtaataatgcttgtgccgcatgaacgaacgaacgtacggcgcctgatcgagatgccagatgaaccaacagtaaggccacccgttggtaagaaaggcatgtgcgcgcggcgagcatctcttcgccgctgatggcggccggaccttggtcagacgtcggtgcgcgcggcagcgatggcatggaatccggagtccactatgaggaaagaaagctgtagtctttgttcggtttagagaggattgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggaccatgaaattctactccagcaccctcttttcgaaaagaacaagatatcttccataccaagatcagaggcattcttctacttcgcccttagattactttgccatgttgacgctctgcatagcttttctctatcgtccgtgagtgccacggtgttcgatcgatccgtgtggcgctcgagacggcggccggccgtcacagctctaagccagcatggcggttcaatcaagcccctgtgtggcccaaatgagactaaaacctgtgtcaatgcggttataatttgaaaatttttagtttttatcaatttgggaataatggagtaatatttttctagcaaaaggcaacatatatgttgacagcgttccttatgatagaacctaagtactcaggtttaagttgtagattttatatgtgtattcgcatttacgattggttatattttaagtggtaaataaatgaaatatacgttgagagtgagatgcttgtgattatctaattaatcttaaaatatactacttaatttt

SEQ ID NO: 25059 - DNA, 14173 bp, Oryza sativa
  unsure (1)..(14173): unsure at all n locations
tacatatatatatatgccttaaaaatcatattaacacatatttcttaagtttttttaagctaatacttaattagtcatgcgctaaatcttcgctctattttgcgtgttgtgggccgggggaggggttccaatccccacaaattgtacgggtaaaatcgaaccatgcttgaaaaaatcgactacaacacactgcagcaaccaattgttatatgttaaagtaaaatatcgaccacaaaagaagagtcgaacttagcgttaaaaagatggtttgcagctgttggttggctgcacaagatagggatgtacgcatgtgattagagattctttttctataagggtccaacgatccatgtcacatattgtagccaacaaatcaaaattttgttcgaccatactaatcgaactagaactgcaggtaccctaaagctgacaagttgtattccattcgaaagaacacccttacagttacatccactatccttggccatgggtggttgcttcatgtgaacatatatgtggactgtgggcctgtggcttgctagtgccaaattggttgttgaagaagggccgttgacccctagtcaatgacagtgaattgtactcccctgcctgtcctgcaggtgctataaattctgaacctcaagaactagaccaaagcaacaaagcgaggtgcagtttcagtgagggaggaaaaaaagagtgagaagaaagtcgagatcatgtccctttggaaggtgctcctgatggtaatcgcgctcatctgcgccctgcatactacttcaggtaaacgagttaataagttttttttactattgtaaatttataattaatgtctactaccttagttataaaataaatttagaatatcttaaattgatgtctaaaatataatttattctgagacggatatagtataatctctattattagagaatagagagaatagactgaggaatttaattgtataatttgatgcagggagacctcccgtcgtgggatatcctgctcctcgtcccaacggtagctcgggcacacgatgctacgaaggctgcaaccctccaggtagagatggcaacagggatccataacagagaccctctgctaccctccaggtagagatggcaacagagatccataaccagagactctataggtttttattttattaggagtcatatatgatctaattcttgtatctatggatttatcaacagaaaaaaaatccttacatgttggatagatgggtattagttctttagccactcgtaccccttacctatgggtaaaaaatacctatatgcttagcgtgatagtttacttactttgaacgttcatgtatggtttaatactagtatggtttatttacttgttatatatggtttaattcttgcatgatttgtttacttgtatttgaatgctaatactaaaaccaaggttacttaatatgatgtcgatagttgttatcgtaatcgtttagttatagataaaggggaagggagaagttcactttagttccctcaatttatcgtcgagtccgaaatttatctttgaaatgcaaaaccgggtacaacacatcccctagcttacaaaatcagtacaaatatggggtctctcggcaatattgtgcccagttttggttgacgtggcgtctacgtgggatcctttaactaggtgttcgttccacgtggtattgatgtgtcgcttacgtggaaattcgatccgagaaaaataataaaaaccgtaggacccacatgttagctacacacgaaacaaaaataatagagggtccgtgtggccccacacgtcatcctcactcctccctcctctctctatcccctctctctcctcccttcttccagcagcacgccgccgctgggggattggtcgccggcggtggaagtgttaggcgcgggcaggagcatcatgacagcttcggcgtcttcctgtacaaggtctcctgcggccggcgtccagcggtggtggtcatgaacggcggcgaggacgcgatccacctcgtgcagtgggtcttgggacacgcacgggcggcgcgcggtggcgggggcgacattctcgacgcggccgacacgcggctgaacggcgagttcgacggcgcagacatggagcgcgcgctgaccgcgggctgaggccgtcagcgtgctgcggttcgtggcgccgctgccgagcctcccggcgaagatgccggtggcgagtacgggccgccggtgtccacagcgccggcggccagcagcaacgatttccatggctgccggaccaggccggctcactgcttcagctactgtccaggtagctcgttcagattgatgaatgggtattgatgaaatggcaagccatggatgcaaatctcaatcgaattagcttattattcagttgtctcgaatctcgatgaatgcgtttgagtattagagattcagagttggtgcctgttcttggccgatgcgaaatttgaactcaaaggaatagttgaataaaaacgtctgaataggatgcactgaatatatgagtttattccaggtgattaataccatatcatgagttggcaatgccgaaaatcttgtcatgttctttggatattctgaattcagcatctgttcacctagttcgtgttacaaagcggcaaccatcgtgtaatcaacatgttttgtgtctgaatctgtcatcaagtttcgatcgagatggaacacgagctgctagtgtcgtcgttgccaccggtggactgaatcagccgccagcgccatacgtgcgtgggctcggaagacattcgcacggatcgggcgcacggtggcctctagcgccagctggatctcctccatccgccgccccttctccccgccggtcaccatccttctccctgccgccattggtcgttgcgcctggagagaggagatttgaaatgtgtgatgattttatgattttggtgagattggtgtgaaatcaatatgcaaagaataatgaaaaaaaaaaaggataggaaccagagacgtggcgctagcctcaccaaccgggaccaaagattttcctctttactcccggttggtgttactaaccgaggatctttaatcccaggtatttgaaccgggactaaagatagcgatctttagtcttggattcttagtactggttggttaccaaccgggagtaaaagacatttccccaccagtagaacacagccatattgatagagtagagctaatggttgggcctcagaaaaaatatgtataggacatgatcaaatagagccaatgtcggcaaaagaaagctccagaaaaatcactctcccaaaggttgcaaccccgcgaggtcttgggttcctgcccttcgccacgatacatcgtcttcgattatctagatgattattattggcatcgactaataaacatttaaacaacatatggtaagtggtaagacatagaacactctgattacacactgttctttggaagaatttctgcagagtactactactactaaacaagcaaaacatcaccagaattcaaggccagtacaagatcaggacacggccggaaccataataccagaaataacgagcaactaattaattgatcgactcgaacaatgaaagaaattaagcgctaactaagagcacccacaatagttatctatggctctctatgagagattcatgtcggtatatttttctacttagaagagattaaataaagagagagagtaaagctatctactaaactgaagatagtctatagagaaaaacgaggcaatggattagagagctatagatacccatgtagacatactattgatcaggtggtttactgttaatctagtctattgctgagatgtacatgttttataaagaataccttactttaccattgcaattactgcgtgattgatgggtgagctatctggtgcctttaattttgtatccatgacttgagatatctgcagctacagatacaactttcgagacgtacgcaaaggtacaacgtcgactcctcctcgatgccgtaggaggccagcgtgcggtcgtccgcaagctccataccggagaaaaccagccgttgcttgcacggcatggtcttcttcttcttcctgtagtacagcttcaccttcacgcttcccaccgtgtccgacggctgcaccttcagcgccgtcgccttcttccccccgagcactctcacgaagatctgcatctcatccgtagcagcaggtcgagtcgttagggtttgatgatgctcttggatcagtttctgcgcctccatgtgcgtgcggatgcagtcgcagctggcgaggcggccgcagaggttcaggtacgagtgcttgcggatgccgcaggaggccaccgtgtcgccgtcgtcgagctgcctcccctcgaagatcagccgctgctggcacggcggcagcccgtccttctcctggagctgtagcttgacgctctccaccgtgtccgacggctccacccacagcgtccaggtgttccccctgagcccgctcactaagatctgcatctccgtagcggggtcgcggatgccgtagtcggccagcgtgcgatgaccgtcggcctcatccatctgctttccgtcgtacgccaacccgaagtcctcagtgatccccgacatggccttgatcttcgccttcacgctctccaccgtgtccgacggctccacttccagcgtcaacgtggcccccgtgatcaggtccacggggatctgcatcctcttccccctggaattaatcgtcgccgccggccaccacagtttcgtccaggtcacgatcgagctggtgttgctctggttgttgcgcggctgcgtgacttgccggaacgacgtgtatataaataatataaagggcagggcaggcttaggtcagaacggttctggtgttggagttcgaaccagtcacgacggcaaaagtaggttcggatatgaatctcaaaatatatttgggatatattctgcggcgatgaatcccaacatacatatatacgagtccagaggcgctggacacgttggagttgccaagaaattttcttttcatattccctttttgtttatgtttttcttcccttttaaatatgtgatttgaattttgggttcacaatatatttggattatagtattctaatagaacctgactattagattagttttctagtataactcttagtctttattcacgacgactcctagttttctcctgtgtatatccctcgtaagccgcactaggagggtacgatagcccaatgtatctctgcgtttgtatccaactcctcaatagtaattattgttggttggcgcccgtggttttttcccaaaagggttttccacgtaaaaattcgtgtctccgctgcacatctatttccataacacactttattttgggttcgttactacctgcttagtgcttagtgctacgtgacaggtggtacaagccggatcgaagcaatgtggcttggtaggggtgggcaaaataagaccgaaccgaagaactggaccgaaaagaccgagaccgagaccgagaaattcggttagtgattcgatatcagccatcaaaagaccgaatttttttcgggtaattcggtcataggcttccgttaaccgaattaccccaaaaaactgaaatttggcctaacaggtgtacgaggcctaataagcccactaaatagaacaaaccctagagggagcaaccgagtaaagtcgctctcaggtctctcagcggctcagcccctcactgcctcgcatccatcgcgtcgcctccacgcctccgccttcgcctgcatcgcgccgcctccgccctccgcctccagcaccggcgccgcctccgcctcgacgtcgcctctgcccttcgcctccagcgccagcaccgccgccgccgcctccgccctccgcctccatcccacctttgcgcctccatcccgcctccgccttgtaccgtgggtctgtggctgttgtgacttgtgaggttcagacttgagatctatcctgtgataatttggtgcttgatgttgcctattgtttggtatttttgtgatatatatgtctgtgaaaaatttctaaaaagagggaagtgctgtcaaaatttttcattctcctgaaatttcggttagaccgagtccaagaccgaatttgccagtcctgagttttttttatgaaattcggtcctgactttccaaagactgaattacccgagaaaccaaagggaattttttagtctgaccgaacgcccacccctatggctcggtcgaatccagatttgtcctagcatctctgcaaccctctgttttgttttgtttttcttcacggcaactttagttgggaaaagctacgactttagcaaacgatttaactgtgacctttaactcaccatgcatgtgacatgtgggtccgacacgtaacgacgtgagttttgcgcgtgccagagttgactaacgggcctaaaattcatcaagtgtatgaagttgcacttttgtgataaaaaccatttactattgttgcggtttcatgaaatgtttcactaaagacatcaacttatggaatagtcacccgaccgatccaccgtgtccaacggctccattcttagcttcactctcagtgtcactgtactcctcatcaacacactttcacgtagatctgcatctcagtagcaggctgcgtggaatgtaattgagctagggtttgatgcttttgaattagtctttgtgtctcgatgtgtgcgcagatgcaatcacaactgtcagcgaagtgatagcagaggttcatgttcgagtatttccaaatgccgcaggaggccagcgtgtcaccgtccttcagctgccacccctggaagatcaaccgttgctagcacggcaacatcttttccttctcctagagcttcaccttcacgctcttaaccgtgtccgacggcttcacccacagcgtcctagtattccccatcagccccctcacgaagatctccatctctgtagcaggatcatggatgccgtaatcggccagcgtgcgactgccgacctcatccatctgcttcccatcgtatctcaaccagaagtcctccgtgatccccgacatatccttgatctttgctttcacgctctccaccgtgtccgacggctcctgatgtgaccatggctattatagatacaaccgttgctcacatcatgaattaacaagaagacatcaagatcaagtcctccatgtgttgcaatctgattcggccacgtgctacattgctgacttcaaacggccgccaaatctacatacgtgctccgttttgggcccgtgagtacttgatggaaagctctcgaagtcttctttccaacggatccaacctcatctcggaattccatctcgtttggccataatcacagaagcaaagtgttgcgtcacctgtaatgggcctatgggcttgtaacctcgtctgggatcccggcccaagtgaggcccatgtgggatgcatcccaatctggtgaagcacgacccttggacaatcttggtcgtcctcctacctctataaatagttaggtaccccttcagggtttttcgggttttgtttagatgaaagtttagctattgctacttccttgcagcgcgcatgtgggctagaccgtccgtctgcttgtaatcggaaccccaacttatcatttatgctcaattcctatttgtaattcagattgcttttatcttgttcttgcttgtttcttcgatttgcttgcaggaacaaggtcgatctgcatcggctccatcaacaaccaacggagaggtgtatcgatcgctaaggcgcaacacaacgtcttgtacggttgtagtcgggtcgtcaacgtttctctcaaatcgtagttatctcaactcactgaaagatcgggccaacaacagccttgagtgtcgagtggaactcagggttcatcagctccacttccagtgtcaacgtacccccctcccacctccccccctgatcagctccacgaggagctgcatcctcttcccctggaattggcggctgccaccgcagtttcgtcgagatcgaccgagttggtgttgcacggctgcgccgggaacgacgtataaaaagggtatgacacgacggcaaaagcacaacccggatacaaattcatacgaatcccaaaatagtttgggatacattctgtggcgattccggcgatgaatccaaaaatacatctacttgtttcaggaatgctttgactcgagcgttcgatacgcgataaaaaatcggacgccaccaccgagtgggtcccacctaaccactcttctacgtacctttttctcatcaaacttatccctatctcaaattctcagccacttgttctctctctcccccatcaacaccgtagcggcaaggtaggaggacaccaacgacaacgtgaaaagggaggaggatgacggtgaccacgctggcggtgatggggcggcgcaacatggagaaggaggcggacgctctgcacctcgttgacggcgcgacgtgtagaggggggaggacgccggcgaccttgctgacggtgcagcgtgaagagggaggaggacaccggcggaggcagagcaggccgacccgaaagggaggaccaaatgaggcaccactggtggagcagccacgagcccacgatgcgaaggaggcgttggaccggatgccgatgcgactggccttggcgaggtcgccctttcgacatggctgcttgcttgtcctcgtctacaccatcaccacacctcacttgtctcgccgtgttggccgcttgatttcggtgaccggaatagaagacagaggtgggttttgttaggaattttagtgatgttacagtttatttgtttttttggttgcactttgttctatcaagttgtttcattctattttgactcaattttgcgtacattgtattaaggtgttgcaatcagtatgttttactattgcatttggttgaaacaattttactcaagtgttgaaacatttttatctggtagtgaaacatctgagacaatttttatcgagaggtgaaacatgtgaaacattcttcaacaatacggtacaacaccgtccaataatttgcatcaaatcggacgtccgatccgtagcagtctccatttgtttcgggctagtgcgaacaagtccaaaagcgctggacacgctggagttgcgaagaaattttcttgttcttccctttttcttttcttttttttctttttaccttttttttctctggggtgattacaacttgctgctagtgctatgtgacaggtggtacaagcctgagcagtgtgttgctcggtcgaattcagagatttgcaccaacgtctctggaaccctctgttttcttgttttgtttttcataaatttcaataaaatgattcgaactattagtatactaaaagacaggtatttcacaaagctacaattttaataaacgattttatcaataagatgcaacctgtaagttatcatgtgtgtgcgatatatgggtctgacgcataactatgtaaattttgtacgtgtacctactagcgaacccaaaattcggtttgcttttatatttatttttattgcaatgtacgagcattatgctactaaaataaagctcttcattatctaaaagatttatatggtaaaccgatagtaaaatgttttccatgctatgaattcaaccatggcacatcctaattcttacttgcactgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattgttagtggataccaactatatagaaagtatagatttattgtggtagtatttttatttcatatatatactcctcgtatgcgtcttaatctacgtatgtatactgttgtgtaaaatcttgtgttgaggatagtgctctctatccatttgcaggctgaaaacgtgtcctaggtaaactaggaataactggaatatctggaaacttgattagcgtaactaattaataagtatagtagtaagcacaccttaaagacggtaaaaagaataaaatgtcaatagtcagatattttcaaccaaaataattatatgtatagaagtatagaaattcaaatagccataacactaattcatgggagaattttccagtgcagtgctaagaccaacacagttcaagacaagcaaagatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatgctttcccttcttaggtgtcgcgtacgccttcttctttcgcttcttgttgccgccgccgccaccacagatgcgaccgaggaggtgcagcgtcgactcctcctgaataccatagtagattagcgtgtggccgtcgtccagctgatgcccctggaagatgagcggctgctggtctggcggaagcccctccttgtccacgagctttacctttacgctcttcaccgtatccgacggctccatcctcagagccgtcgtcttccctgtcagccctttcacaaatatctgcgtcatcaccgtcgacatcgccggccgccggggttccgcgagatcgtgtggcgtgtgccctaagttgtgttggtctcagctgcgtggcggactcgttgggaacgacaagtataggcgaggctcgtcgacgtgggaaggggtggtccgtccgatctgaataatcggacggtggtgatcgagtagagtccggttcgaaaccgacccggagaccacaaggcccggcccaatttggttcgagccttcgaggccgcacgcgtcgcggttgcgaacacaaggcgaggaggggagagaagggaagncggcncgccggcgagnagggaaaagnaaagnagncgncgatgncggcgatcggctcctccaacgtcgggttccaggtgcgcgaagctctccatcccactgggcttccgtccgttcgaatcccatgcccatgggagtgggtgggtgggtggggctagggtttgatgctttgttcgatttggtcctctgcatctcggtgcgtgcgtctcgtgtcgtgtcctgaatccggagctaatcttaagtgatcttgttgctgctgcagctgctgaagaaatcgggctggaaggagggcaccggcctcggcgcgcaagagcaggtttgcgcctctgttcttgcgtcaccggaaatcttttgtgtgtgtgtgtgtgtgtgtgtccatttaccccaattgtagttatattttggggttttgcactttgatgcttaattctgttcatcgtgcatgtgattttgttttccctcggcttgtttggtaactcgagggaaggggattgggagtttacacgagagaatttacgatgagattaagatgggaatttgatttttaatcccaatgtcttgtttggtagatgtgatggaaattgatagggagtttagttggagattagctcattaataaaaacggatggctgagatttgcttagaccaagtaaacgaggaattccctcccaattacctgcccctacccaggtattgaaaaggagggagtttcttcctcaattctccatcccaatcccaccaaaattcccatgtctcccaaccaaacaaaacacttaatagcctcatccctctaaactctcaatccctctttaaaactccctccaaccaaacgggccgtagttgttaatggtgcgtagagttaaatgttgagacaaggctactgcaagttgaactgttgaaagctcaaaaaaatgtgtagatcaacgtaagatatatgtttagtttctggataatggttagtggtctctggaggaatggtaaagccaaaatttgtttccgaaccaagtaggcaggtagcttaccttagttggctgttaactccaaatgtttagtaggatctgaaattatatatcattttgaccggaatgattatctcgcatgttcataggtattaattaagagctgatgtttagtagtcatatatgtgttacatactatgtttgcatgtcacttggatgaagccagtttatgggttagatttgccttttatgctgtgtttttgttttcatactcacttagcccaatttaatcctggaacagggaagattggagcctgtagaaagtcgtgtgaagaataacaagcgtggtttgggttccaaggaaccaaagctaaagccaaaggttgacgaggatggtgaaaaagaccctaaaaaacccaaggtgagcaaaggatatccagtttattcatgatacccgcatacaatacctaattactttctttggcttccttgtaattctcattccgagcattgtattaatagttcactattatcattagttctacttaatagccttttttattgaaaaatactgatgactgctctatagtgtagttcagtaaaaaggtttcagactttacagataaacgtggttacttgcatcgttactaattgtattggtaccagttattctttatgcattataatacttgtctcatttggtagctaatactgctgctttgatatgtatttgttcatcttcaacaagctacttttagtaaatcacacttactgatgggattctaactaactgattcaaacgtgttgcccttgtcagctggaagcaccgaagaagaaggccaagttggccgcgaagaggatacggaagatgcaagaagaagagaagcggttacaagagagggaatttgaaatggctttcttcagggaattttggcccgataatgtgtagaacaggaggttaaccttgctgggcggttcgacctgctggcttcagcttattaggctcccttgtacagaacaacagctttgactcccttgttgtatgtggctaaaatgtttacattgattcaatggatgtttctggagagaatgctggtcttgtatcatgattttgttgtatagaactgtttgcaatgctgttacatgctggccgaataccttttttttttgttaccaaactggcagagtacattcactttacagtcataaaaggaaaaattttcatccataatcgcccacccccaccccgttttttttttcccaaagtggccgcgtttatttttgaagtcataaaaggagaaagttccatccataacctgaggaattggaatttgaaatcccatcgcatagcatttggtgtgtggtgtacacactcagtttgataatgtaaactgaaagaaaaattgctgaaacatattggctacaatgacccatacaaagggacacatatcatatgctgcagttgagctacaacaaaatcggattttatgactgaggtagcagtggcgactgtgatacataatgaaaaggggaagaaaaaaaatacaaaaaaaaaagctctcgctatggtctgaaaatgaaaaatgcagcaaaagagatttgtcaccaaattcggtgccaatttctgtctatacaaacagttaacgcacgtcaggattatgcgttgcttctcaaaaccatatgccagcgcctagctacaatagcagcggttggcgccacagcaccaagtatggtaggtcctcaactctgnnnnnnnnnnnnnnnnnnnnnnnnnnnnnnnnnnnnnnnnnnnnnnnnnnnnnnnnnnnnnnnnnn

SEQ ID NO: 25060 - DNA, 1714 bp, Oryza sativa
agaagagaagcggttacaagagagggaatttgaaatggctttcttcagggaattttggcccgataatgtgtagaacaggaggttaaccttgctgggcggttcgacctgctggcttcagcttattaggctcccttgtacagaacaacagctttgactcccttgttgtatgtggctaaaatgtttacattgattcaatggatgtttctggagagaatgctggtcttgtatcatgattttgttgtatagaactgtttgcaatgctgttacatgctggccgaataccttttttttttgttaccaaactggcagagtacattcactttacagtcataaaaggaaaaattttcatccataatcgcccacccccaccccgttttttttttcccaaagtggccgcgtttatttttgaagtcataaaaggagaaagttccatccataacctgaggaattggaatttgaaatcccatcgcatagcatttggtgtgtggtgtacacactcagtttgataatgtaaactgaaagaaaaattgctgaaacatattggctacaatgacccatacaaagggacacatatcatatgctgcagttgagctacaacaaaatcggattttatgactgaggtagcagtggcgactgtgatacataatgaaaaggggaagaaaaaaaatacaaaaaaaaaagctctcgctatggtctgaaaatgaaaaatgcagcaaaagagatttgtcaccaaattcggtgccaatttctgtctatacaaacagttaacgcacgtcaggattatgcgttgcttctcaaaaccatatgccagcgcctagctacaatagcagcggttggcgccacagcaccaagtatggtaggtcctcaactctgctggctacctaacaaaaaaagaccttcacatctccctccctagaataccaattcatcctcctcttcagttgcaacggatagtgtgcctgccgatgcggcatcccgaatctggccggccttctcgtcgcttatgccaagcagatactgcaaccttgacagcttttcaggcttcggaatgctcttcatgtaaatgccgtacagatcatccagctctcctgatgtaggccatgataggggcttcgaagcaggcacagccgcgtcgcatgcaagcaagtcgttcaaggatgcgacctgcattggcaatatattccaagtaaaaattagaacgctgagtaattctaacagtgcagttattgtaactttcctatttatactctagttgaatttcttttgtcattatgacgtgccagttatcaagaataggttaatcctgatatacaccaagatcaaagtcaacgctaaatcagtactttgataactgtagtcagtgttttaatctttcagattcttggagaaactaagttccaacataaaacaaataagtaggagatatgcagggatattccttacgtaccacttcatctttcttcttctgccgaagcagagcaacagcttggacaagggcgttatccaacctaatcttcgcaatgtcctggacaatcgacttggccttctcagcattaatgatgagatcagctgggatctttacatacacttcctcttcatcaaattcacctgtgcctgacgaaaagatctcctcaacggattttttgtaaatgttttctcgaagtggttctgcaatcaagctgtccaattgaaaatttgcttctttaaatcctcg

SEQ ID NO: 25061 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnnactttgactaattggcttggtgataccgagtactgctcccttcgttgtaaattgtaagaaatatattttttatataatttttaatgatatattttaaccattaacgtattccatattatgtttttaataaaatataaaattagcatcacacgaaagtacttttaaatatgaatctagtcatataacttgtataataattagcatatatatggttagtttgattattagagcttttcttagaaaagaggtcgtcgtttaatttggaacgagggagtactaacaaatacgtatacgtacttagcattgctgatgttcttttcgaagaaattcagacatcccgatgttggctataaatacttcctctcaccaattgcccacataactcaccaagaccaccagacatgaagcttcacgtcgtggcagccatcctgctggccgtggccgcgtcgttgtcgccgccgcccgccgccgccgtcacctacgaggtgagcaacgaggcggcgagcaccgccggcggccagcggttcgaccgggagtacggcgccgggtacgccaagcaggtgctcggcggcggctacttcttcacctggagcatctttagccagccgagcgccggcgaccggaagcccgtcgacgccgtggttctcgccgttcgcgacgtcgacg

SEQ ID NO: 25062 - DNA, 986 bp, Oryza sativa
agtatctctgaaatctaagttcaaatgcttcgattataaagtggcttggctcatttttgagtcatcaacaagcatacagaaaagttccatgcattttttttcttttttcctcttttttcagtcatggtagctacaaaaatcataggcaaacaccagctggtgttcttcagcctagcacacactgaaacacatagatacagtcatacacacactaatcatcaatcacacaatcacataaaccaaaacaaagctctctgctatgcttactgagagagtaagctagaattatccccttctccacatttttttaacttcctactgggtgctgtttctgacatgcacaagattcctcagctcttcaaatgcatccatggtctctggatcgaatcccccagcaaactgcaaaaatgagcggcaatttagaatatgcagctgacattaaggtttaaataacacatcttaatatgtcataacaagagttaacagcagaaaatagcacaaacgtaatgcagaaataaccataatgtttctgaaggacataaaacatatacaagcacctgtggaaaataaatatgtgcaattatatacggaatgggaatcaggaggcagatgaaacaattatgagatgtggtataacataattgcccaagtatacatctaatcagaatggagtatgcagtatgcacaggggaattttctttttgtggagttcctgctagaaatgtgttacctgatgcattctgaaggcaaatctcacagcctgaagtagcatatactccaaagctggatctttgttcagaggtcccatgtattgaagttccatagcaactcttttcatgtacatctttgctaatttgacagaagaaaattttatctgcagttatcaaggaaatagaaagacaacgattactccagttaatagaaaggcaatgattaatccaacaggatgtaaacgatggtctaggtgatcgttgcaaactgcttct

SEQ ID NO: 25063 - DNA, 1370 bp, Oryza sativa
cctttttgtggtatcaacataatctgcaaaatgttcacaagcaaacaacagtggtacctatgcaaagcgtaccacattcctaagtttcagtagatgaaaataaccttagatactatataacaagcacctcaagttaaccaataggtacttgaaaacttatcctggtagtctccatgctatctattctgaatactggtaaccaacaaattttactttttgcaggccaagcatcataattctgactaggtcatttcctgtatcatatgctgacaacaatgtagcactaagaaatcaaaccttcaaatacggaaaattatagaacatataccttgccaataagattgttgtcgagcatccagtcagtaggaatattaaactctttacactgtctcatcgtagcatcccttgtcctcagaagattgtagacactccgctcagtcctgaattaagaatgcaaatgaaaatatcagtattcccatttaagtttaccactatttctgttaaatgtatgtaatctgtatacttatagtaaatttagtcgtacttttctgatattgtaaccattttcttcagtgcaatgtcacatggaaggcgaggatcatctttatagtttgaaacttcagattccaattttttcaggtcttggtagccaaaagctgcctctcgtagagtatctgccttcctttctggccaatcaaaatgcttcagcactgctctctcatccaccttcaagtaatgcaattacatgagtgaaaaaacaaagtaaattgctcagagtatagtgctactgaacattcataccaggaaaccaagctcatcatcaagccatttcacaaatgcaaccacatcttctatatctttgtaagctgcattggtcacctccttgatcaatgatttcacaaattcaccttgagtctcaacatcagccttgatctgaaaatgaacaaagagtaaagtaaatagccatacatcagtgcgagaaccagctagcttttcattggtatctacaattctacatatgtccaataatctgagcagaatattctacttacagcctgcaaatgcgaagaacggttctcaatttcaccaatcatgctactccgcacatttgctgagttagcagtttcacagattccactcccagaagtatccttttttgagtcccttctcataagtgaatggtaaagctctgcaacttgtggtgccctcttcatgaccccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatc

SEQ ID NO: 25064 - DNA, 4718 bp, Oryza sativa
  unsure (1)..(4718): unsure at all n locations
ctgaaggtctaggaggagggtttggaatacgcaaggcacgcttttcaacatccatactttgagacttgcatacttctgacttgccaagaagaaatcttgagctttcagatcgaccaaaatcatacttatccacaagaagttcacgcttctccctgattgtctcatccttattacaggagattgcctcatctgttgcttcaggcaggcagataaaggtatcagattggcgcctcttcacaatgctaaactcctgagcacatccttttggtccacctagtgagtgcctgcgtgtcgggcttctgcattctgcagcttcaatccatgctctgtcaagaagggcctcctttttagatgcttcacaattcttatcattctgagaccattgtttgatacgctcagcaatgctgaacttcttgtgatcagaactgttctgatcaagtcttgcatcaccatcacaatcatcaacatgacaagcaatttcatcattataatctgcatctgtcattgctctagctgcttgatctgagttactgagctcatgacgtagacaagaattgatccaccgaagataggcaagctcctcaacttcagttagccgactcatttgcagaccctcaacctgcttgctcaagtttgcatttgtgtgccgcaataatgaagcctcagcttgaacctttgcaactatctcactctggtgacaataagcatggtatagaaaaggttagctggaaacaaactacgactcaacccacctgaaaaataatttagtttaagtaatgttacctcggcattcttttcaatgacagccaatttggactctgctgaagagagtttaattgcgaggtttcgtttctgaaattgaagctctttgtttaaacgtcgcagttcaacaacttcaatctccaagttttctgaagaagatgcattgcccccattcatactagaaacccgattgccatgcccatccaaccttgcattttcttcatgctgctctaccatacaagatagagctgatagctgttcagaaaggcttgttttctcaacttctagtgaagttttaagtcgcacaagcctgtcaatttcattcttccttgaatcaagatccttttcaagttccgaaactctaggattttctctgcattgccgcaactctgactgtaatgctagttccctttcctttgactcacgtagttgttccctgagatgatccaactcaagaaaaagatcatgagatgctggggacctgatgccatggcaatcaaagacatgggggtgaacctgagcaccagcaggtgaacaagggaaatctcccataagagatctcttaaccctagaatgatatggaatctgttggttgctggtgttaacattttccacacttgcaagaggtggcttcttgcttgcagcagctgctgtcttcttggtctttttgtcagctgtgaaccctttgacaatttgggaaccccaagaggatccaaattttggcttgagcacatttatattgcttttggagtcaacccttgatctgcatggctttgtttggttgtcaaacataatatcttctttcatcttgtagcgattttgcctgacccagaacactaaccatgcagaggtgactcgacttgattaaaatgttccagtacctgtactaacacctgcaaataagtgagaaaaacatgaattgagctagcaaccaaacatcaataacacagatgaaaacaagaataaagaaaaaaaatgaagaaccagatatgaatgccttttaaaatggatgccttcaaaaattgtccataaataaggaaataaagcatcaattcaggagtactagactaaatgaattctttattgcaatgctacccagaaccatatcaaaccacatctttaactacttccatggagtccatttgtgtactactctgaagagagcaacatttaagcagcattacaactgcctttatctctctctttagaagcatttgtatgaagcaaataaataacatcaaggtctgagcaaatcaagcttaatacttttttgagattatcgtttccaaaggctaaaaagaagcactggctttcaatttttttgtggccgtacagtacacatttgtagcatcgaccatcaatgcatcgtcgacgaagatgaaatctcccgaaacctaatcaccaaaaagcagaaaactgctaactgcaaacaagcatcctcttgaactaactaaaacacgaaggagaaggagcaaaatgccccaagatccaactccctagaaccaaaatcgaatgagaacagcaaatgggaccaaccgattttggcgaagatgataaacacaatgccaatcaaaacccaaaagcttccacaaaaatcaagcatttgaacacagcgagtagactgaacccacattgggctcatcatcaagaaggacacaacaagtaaagcgcgactcttacctcccaccacccaccatcgatttgtacagatcgaggtgaaagcaaactcccccgtccacaaaagaacccagccgttctgcacaccgagcgagctcaagacgatcgccaatcctgaaatcccccactaatcaaagccttctccctccttttgacctcctcctgaccgcaagtccgcaacctatcatcccccgctccagcaagaaccccccaaatcagctcgatttcaacttaagaagacgaaaaagaaaaaaaaatcaaaaaccccgcagtgccgtgccactcccgacgacactaccaccactactcctactagtagtagagccaacatcagccagtggcagtaaacaaagaagaataggaggatgaagacaagtgcggtggagcttcggatgctttcaccttcggcctcgctcgccttcgatcgccgcgccccgcgcccacgcgcggatttttctacgagctcgtcgcggcgagttcgaggattcggttgctctctctctctcctctcctctctcttgcgctctgcttcttctcgggagaagagaaaagtggagtggagagtggaggggggtgggtgtgtggtttgaattttgaaatggggataggggttttggacgagacgagtagccgtagcgcctagggggggacaagacattggcagagcaggtactgacaggtgggtcccactgagcagtttctcgcctttttctttttctctctccctggtttcttgtcgcttttgtgagaccgagcgtactgggccgccagcaggctactgggccgggtacttctctctaaaagtctgagtgttaggtgtgggctgtcttgttatgctggaaataaaaaatggaataagttcaattgaggtccctagatttgttgactgagtctgaaatttatccctaaactgaaatactagatataatggataccccaatttgcanaactagatcactcgaggttctaggcagtttatgcccggttttggttgatgtggcaagatgggtcaacgtgggacccccgtgggcccccgtatgtcagtagctagcactttcttccttctcttctcctctcttcccaatcccctctagggcgacgaccaacgggaaggacggcgcgatgggtgagattttgttggcgctgtctcctctccccatcccctgatgctgaggagacgtcaccaacagagcgactgagggggtgattgatggtgacgagcagtttacacagctctcggatcaaccgcgagtagtgctctctgttgtcgttgttgtcgtcgctgctggccccaccatggcaatggaaactcgagcaacgaagtgaatcaaaggtcggaggtggaagatggtggtcgtcgacgtagaagatgatggtggccgttgacgtagaagatgacggtgccgtccacgtagaagatgacggtggcaggggtccaggtgatggcataggagtgggcggcgactatggggtcatcgaaggagaggaggtagcgctcctcattggcacgggtggtgctatcgttgcctccatcttcgccccttccccagccaacgatggggcatggaggaaatagatgggagatggggaatagatggagagagaggggaggctagaggtggagagaggccttacatgtgagccccactcgccacgtcagctaaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgacaggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgattctcttttccctattcaattacacggaagacataactgtaagtgtatctcataacattagcttataagctgtagataaat

SEQ ID NO: 25065 - DNA, 1180 bp, Oryza sativa
attatttcccatattcatattgatattaatgaatctaaatagatatatatatctagattcattaacatcaatataaatatgagaaatgctagaatgacttacattgtaaaacggagggaggacatccttgatcgagaggcgaacttggaaaaaccaaacacaaaatccaaaaatcatgggtcagatttggggggcttttaactatttgcccctcttacgagtggtgcttaacgatttaccactagacctacatgtcatagacacatgagggcccatatgttatagacacggtgtggcaaatcgttaattgccatgtcacaagagtggcaaatagttaaatttccccagatttggcgtattcaattttctattctacaatgttttggagtgacaaacgatcacccaaaaaatcacaatcacaaatctctgaagagcaatcactgaaacaaccatagatgtgtgtatttgtgtttgtggttgaggagtggagcttcaggaggccaacaattgcgtcgccttcaggcttcttctccatgccacacatgacacacccatgccctcgttgcaatccagcgtcgctgcgccaggagacgaggcgaccacctgtgaagagacgcacttcagaaacgggaacatgttcaggaaacggatcaggtattcaggcctagacattcagcacatttttttatatatactccaacaggtttagaacagtttcaattcacaaaagcaaggagcagcaacaacaggagcatcaagtcatgtactccctctgttccataataggttcatttttagctcttatttgtcccaaaaatagtttattttattaagtaattattgcatcagaatttataaaagtagaagtatagtataaatgtattggaagtagataaagagaagaatcattgtattatgatttgataaagtggggatattatagtattttaggttttgtattgatatgtgttggatgagtgaaaaatgaacttattttaggacagagtgagtacttcttaatagatccactcttggatgaagattgatctgattatattagagtggagaggtaaaatgagccaaaataatttaggggcttaaagtgatccaataaaattgttcaggagagtaaaatattttgtattaataaaagcttttctgtgtaaaaacgtaagcatgg

SEQ ID NO: 25066 - DNA, 10377 bp, Oryza sativa
  unsure (1)..(10377): unsure at all n locations
nnnnnnnnnnnnnnnnnnnnnnnnnnnnnnnnnnnnnnnnnnnnnnnnnnnnnnntattagtgcccaaacaccccatgcgacaccatatataatacccgatatgacacgccaaaaccttttacccctggatctaaacacccccttatatattgtgatatattgggaacagttgcaagtgaccttaagggtgaaaagaaatcaataatatttgactctcttccctccaagtctctcaccagcaaaaagtagtactccaaggtgtgatgcatagtaagattttttttaattgtgtgggacccagtttagtgtttttctttgccacgtactctctctgtcccttaacatagggatgttgatattttgattatactgtttgaccattcgtcttattaaaaaaaaattagaattaatatttacttttttgacttactttattatccaaagtattttaagcacaacttttcattttttatatttgcacaatttttttgaataagacaaatgatcaaacagcacaagcaaaatgtcaaaatcccttatgttgacggagggagtactatagtacattgcaacaattaccatatagctaaagttagacccagcttatggctcaataagactttatacatctaaaataacaaatagccataaaggcatcatattcataattgaaggagcccctcctattattttcaacccagactcgtcatttgcctgttttacattatatgattcataatggtggcgtcatgttccaaagttgcaactattatcactttcactacagaggctaatcagtccttgaaccccgatgctacagtggcacgtactggagagtagtactttatattttctcttaatttgcttggaatatttttggatttcgtacatgtaagtctttgcaattattttaatatgcgtatccaagcacgatacattaataaactaattgactaattatacactagctgtaaagctagtgcattaacctggattggaagcttagacctagcttttcttaaggtctaaccgtccaacaacatacacatgcatgtggagacaaatatgtcaaatggattgtactagtacatgtatgacccctttaaccatttgaaaataggagttagcattttttttaaattatgaaatgtcacttatgttatactcctatactccataacacctcatgcagttagagctgcttggacatacaatgattaccttatagctatgattatttgtcgaattagttgatgcatgcatgtggtgtgcatgcacacatgaagtcatgaacaatttgtcaatcagatgcagggtactagtagaaaccaacatgtgtcgtgcgccctggtttttttgtttcttcttttttttaaagcttttcttttcttctttggtgccatcgaaatgatttttaaatatttccaacatcttgtaggagctcaaaaaaataatccaaatttataaaatttatatccttccaactgttttcaaaatcctgcatttcaatccttgcaaaagaaaccctgcatttcatcgctttctccgtgtataaatataaaatattttttgaacgactataaatttaaaagatgtttgtctataagttgaaatttggggtttcaagacatgtttttaccattcctcatctaccaactttatactaccccttcccaaactaaagtttgtagtttattcctcacctgccaatttatgtgcaaatttatttttctaactacatgtcttatgttataacttgttgtgtcaataatttctcattttttttaaaaaataatactatgatttcctaggattcgttcttatagcaaagcaaagatagaaaatatgtcgttttgtacgcatatgcttccaaaacagctaaatgatatgttttttttggcaaaaatatccattaagaaagttgcttgaaaaaaccatattaatccattttaagttgaaagtaataaatacttaattaatcatgtattgatggctcaactcattttgcgcatcttcttaatcttatttttttatttcaaacacaaccttagggcccctttgatttggaggaaaaacatagaaattttgaaggatttcaattctataggaaaaattctatgaatgcctttgaaatagaggattgaatcctatccaatttttgaaattcatatggaatagaaaatcctatagagattttgaaagaaacttagcaatagcttaaagctcttagaaaatttcctttagtctatctctcgcatccgattcttgtgtttttttacggtcattcttgtattttttctatgttttgaatcatttggtttacactttcattcctgttagaaccatatgtttttcttatttctttgttttttttcattcctacgattccaggagcccttatactactccgtatttaaggaagaatagtagagtaagggcaagtgctataatgctagatgtattgcccctaaacatgccacataagattgaatgatgaggtggaagaaataagtgatcaaagagaaggtgagccacccctcatgcgaggggcaacctccacacaaacccgaaggaaaaggagatgaaaggaagagtagattagacaaacaaataaaataaaattatttgggttagtatgctagaggtagttgtagatgtgatgtattgtactccctctgtcccataatataagggattttggatggatgtgacacattatagtacaatgattatagagagacagtttgtccagattccctacaatctcttatattatgggacgaagagagtatatatcatctcttattttaaatagataaaatagatatggcagccaccccttctataagatttgccctaactctttggttaagttaaaaaggacatctactcataaacaactgttaatcaccatttgattgggatcatcaattacatctgtcaggagggtgtctcctcgtcagaaaatgcagattggattcgacgccgacctgccttccgctgctgcttttcgagattgtcgacatgaccacatgtaaacaaaggctgtggccttgtttagattcttcgggttattaaatagcccttcgaaatcttgctatttaagattattaaacgtagattatcgataaaactgattccataatcccttggctattttgtgagacgaatctaattatgtatattaattcatgattagcagctgattactgtagcaaatcatggattaatatatctcgttagattcgtctcgcaaaatagcctagtggttatggaataggttttgtcagtaatctacgtttaatactcttaaataacgagattccagagggctatttaataaccctccggatccaaatagggcctgtgtttagttggatccaaagtttagattttggttgaaattggagatggtgtgactaaaaaattgtgtgtgtatgacatgttgatgtgatggaaaaggactgaagtttggatccaaactttgaatctaaacacagctaaaatcgatgcttgtgcattatacaagctcataaatgcaagaaaaagaaagatgagagatgcaatgcaagatgctgcggacagcagcaagaaaaaaaacaggttttccggtgacgacagattcccaacaaactccgataatcaattcagaaaacatcggcccgtgtgggagaagctcaagtgagtaggtagagggtgaggacctaaaaaaaactggattttctacttattaatttatttttaaatgtagaaatctatagttgaagatttttttaaaaaaactgcagcagccagagttcaccaaatatggccgtcctttcaacggaaggagataaatttaaattttaaaactaaatttgacatttattttagggtattgttattatactttattttacttattgtctttaaaagctaaggacatatttataaaagttttactaacataaccaatatatctatatcttctatatatagttacagcttctaaacatctaaaactcaacatacaaatatagtaattattagtatcttaaaacttaacatgcaagaataccacgccaacccaccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgagggaggagagagagagacatgaaggaagctcagagagagagaggccctgtttggcacagctccagagctcagccaaacagtttcagctccaccaaaactgggagtggagttgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttcctccagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtacatgattccgctaaacaggagggcgagtcagactaggggtggtagatctcgatgccctttctttctctttggttatttactgttgctttagatatatgtatatgcgtctaaataatgttgttgcctttttgatcccctttggcccttgagcatgtgtaccaaccaatagtggcattttttttaatgtttagtttgtccatctaatctatgtgccccatgaaggaaactgttttttttttaagaattgctccacctgaaaaagctgtccttttttctttgccatgggattcacttggtgtacaagcacatgaacacctttcagaggtcatttcacatgcatatgtatgggctagatatttcatatggcaagcagtagtgtgtcttttgatggtatgcactattgccagcagtgaagaatttcttagcaaaaattccttttcagtagatgatcccagcccatttcttctgccttaagtaatgcttgttatgtgcacattaagatttcagtcactacacagataggcaagttgaactaaagctattaggtgcaatatttcaactgaagtcaactaagacatgcaaccatatcgatcttgtttttggtagataaatctttaagcaagcagttgccactttgctgatatcgcatttcaagtcaaagccagagtttgcttgctgtgtagtttcattatcaatgaggactggttcatttgtttgtgcggaacaggggatccatatatctgacattaattaggttgctcttttgtttgaccatgggtatgctttaatttattcaactgttgtaatggttaaatgtttggtcattccctttatgttgtaagttcatcatgttgatagggatggagtacttcgatgctaggcggaagcctcataatgttgggaaagttattgcagctctggtcctcacaacactatgtatatttattttgaagcaatctcctggttttggtggcagtagtgtggtaagatgtctatatttctttttttctcttcttcttctttcatccttattcctttaaatctgcttttaagatcagcctttcctcacgttttcatgttttgatttgtaagtcactttctgctacctataggtttaacttttggacttttctcaacttactttctcttatgtttttcttggtacacaaaaagcaattttaattttgagtatcacctgtattatagaatatgtccttgtataactagcataaaacaaaatgatgactgctattgtagttgtttcaatacacatatcttcatttctgctctcagtgctaacaagcaggtgaggaaagtgacatctctccatccaattgcctttgttattgcaatgtctattacattagttcatgttccaacttgatatttcaatacacatatcttcattagttgtttgccacttctcgttgcggcaagttgatgcctaaatggcatcctaacaaactgtagctttcagccacgagaccttctgacagctaatcaatctgcataataattttgacatgttcctgttcaagaaaactacgatatgatttgcagatgtaaatatatcacatctctaaaactacaggctaactatccagttctttagaataaaatgttaagagactgttgcagagtgaaggtcaaacatagcacattacttttgttgtctagaaacatgtataagctgcgatgcagacctagtatgtgtatggctaaacttggatatgttccatctgttttgacttctgttgcttaatctttcaactcttcatgcaaatccgcctgttatgtttcttatgctgcaattattattatgccattcttatatttcccctatttttaattcaactgtataactgattgtggggttatgtatcttgcagttttctcgccatgaacctggtgttactcatgtcttagtaacaggaggagctggctatattgggtcacatgcttcattacgcctgttaaaggacaattatcgagttaccattgtggtaattaagttttcctttgtactgaatttctgaactggtttgttcttcaaatgccacccttgatggttaattgtgatttttaggacaatctttctagaggaaacatgggagcagtaaaggttctccaagagttgttcccccagccaggaagacttcagtttatctatgctgatcttggagatcaaaaaactgtatcctcattttgtacttctaaattacctcctcgtaatttttaaaatgttcaaatgccagtttttcacttaactggctcccaggtcaacaagatctttgccgaaaatgcgtttgatgctgttatgcactttgctgctgttgcctatgtgggtgagagtacattggaaccccttaggtaagtcattaccttattgacagtttgtcagttccatgagcttgggggacctcttattctactaacccctacagacgttaccattgtacacacccttgtctaatggcctaattgtagtgctaggggaaaaggtccttatgataaaaaacagttttcactattaatccatggtacttggtatgctacaatgttaactccataatcaagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatggcgtctcatggagtcaagacccttatttactttagtacatgtgccacctatggagaaccagagaagatgcctattgtagaaaccacacgtcaggtaattaatttatgatggcctcaaaactgcagtgtttggattgtgctgtgctatttcatcttgttgctggaaaggcaaactcaaggctgatgtgtaaatattatgtacctaattggttaataatttactctgttacagttaccaattaatccctatggaaaagctaagaaaatggcggaggacatcatactagatttcacgaaggggagaaaggacatggctgtgatgattttaaggtatgttgtttttccatggatataggcttgcaatttctgaacacaaaattggtatgtactaacatgtcaccttttgcattagatatttcaatgttattggatcagacccagagggaagactaggtgaagctcctagacctgaactacgagagcatggaaggatatccggggcatgctttgatgctgcgttaggaatcattccagggctgaaggtattttctcttatactttgactgtacagtacccctggtgtaaagcataatttagtgtattactaccatatatcagctttggatgttgataatagcaatatgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagagactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtacctcagcaggaggccaggggactatgctgaagtatacagtgacccaacaaagatcaacacggagctcaactggactgctcaatataccgacctcaaggagagcctgtcagtcgcttggagatggcaaaagtcacatccacgcggatatgggtcaaactaaatatagcttgctgatcaataattctgctgaatcgtcgatatattgatttttttagttagtggtataggatcttggtgcgataccgcttccacagtcactcatttgttatttttttctctttttattttcaaaggtttgttgttattttctagcaaaaccataagcagtgatcttgatatgctggaaatcctggaagccttcctgtaagggcaaatttcattgttttttgacacaaattgctgataaaaagaagtgtacattgtctcttaccattctgagatgcaagcttgtgaactgaactatagactacaaatatccctgtgttttgttatctatggaatgctcatcaccatttcgtgccaactgttgggtacacgtgtattgttaagcagtatcaaatcaggcgttgttcttgtgcagcctcacctgctacgcattttcaggcaaccggtttgacatgctcatgttgttttgtcagatcaggcatgcttaggttgtcattaacaaactttcagtaccaacttgatttcccatgaatgagcctgggggttgttttcaaattttgtttggtctacatttgacttctgtttgaaggtggcagcatggcagagttatactgttacaaatcatataatccctccgttttttaatagatgacg

SEQ ID NO: 25067 - DNA, 4084 bp, Oryza sativa
  unsure (1)..(4084): unsure at all n locations
catctattaaaaaacggagatagtacatgaatagtgatcgctgactcactcctgtcaaacatgttacacaagtcctgggaataacattcaagatcttgttatgaattttggagggagagatcccctaacaacaaatcagatgtttttcaattgaaacctgaaaatgttgccacctgtccatttttattcaataaaaaggtactaatccaaagtgcctaatcaaagtttaaatgaagatggctccacaaatcaacaatcccaaaaaggacccatcatttataagctgcctaatctcagctactaccatttgactaaaaagctcaattaggcctaccagattgcatcttttttgtcttggccatagtctccaatcaagctggagaaacagagaggccatcatagataggagtagcaccatgaactctccaatgctcatgcttaaattctgccggttcatgcgtctctttgcaggttggtgagcagtgcgttttgcctcctctctctttcagtttttggcagcagatcagttaatatggtatgctggggtttgcatgaagtggtagttagcaacttgcaaggctgcagcaacaggtgaccaaacctaacgcacatgcacaagcaaccaggatttcttttggagagagagtgatggatttggatcatattggtgtatgcaagtgcccacaacatgtctctttttttagttgccacgccaagtctcccccattggtttacacaaaaaaaattcctcccattttgttcggcatggtgaattttgaatagatatgatttctcggtttatcagcagcatccacaattttagtgttgattttaccttttttattatagtctattttttagtattggtttttaaattgtgaataatatagatataaaagttttattaataaattatgtttagcttttcgttcatatttctataagcttatcagtcgcatcttaaccaatgctattataaagacgcaaatgttaggaaaggatctaatatcaaataattagaaggggcgaggtttcgaacccaggtcatctagcccaccaccttatggagctagccggaagacccccgggtatttctcaccaatgctattatacatctcgatgcagaggctggactgatttctattataaaaagaaatagatatagttatcatgtagatggtgaatgtttatggtactaccacatagaacggctaaaattgtcacatgataaggatgagatgagagtgtgcttctggtaggatgaaccgggagcaaattaagctttgttggtcatcggttagctgacaacatttatgtgaatagtatccagagtactaaccaaagtatggtactccaaaaagtacagactatcataacttttagtagtacgtcactattattattatttgtctggaattttagtagtatgcgagacaaatacggagtactatgatacatgcatgattcaggctgtaaatctcagtgtaaatctcttccattatcttaaaacggcaatgcttccatttatctaaaaaaataactatcattagttataatataatattgtgctaacaatttgcatgatgaatttacccacagctttcttttcatcacagaaagatccttcttttcccacaactaatttggctttttgctaaaatttatacagcctatagtaagcctctgttcgctagttctggttgggaaccgatgccccatgcacggaaaacggagcggtcaattagcatgtgattaattaagtattagtatttttttcaaaaatagattaatttgattttttaaagcaattttcatatagaatatttttttttaaaaaaaacgcaccgtttagcagtttgaaaaacgtgcgcgcggaaaacgagagagaagagttggtaacctgggggaagaacttagcctaagctgtactctctccatatgcatagagagtttcagcagtgaattcaacatttcacattggaggcttggatagcaggtcatatttagatttaaattttatgttatcccttggttaattgttctaattttatttccaggtttactgatccaaattccacaacagagcctaaaattgctgtggtaatgtctaatacaactggcacatattaaaaaaaacatgactaataactctatacaaagtgcttatggtaataaaattttgaccaaattttattacaactttcttataatctaactaacttgaatttccatgcaaaccagaatcactccaaattttgacaggaaaaaaagggaagagtttatacttctcggggttttggcccaagttatcgcagcctaggcccaacaacacgggctgttctcactgggccaagacgggccgaagcggcccaagcccacgttccggaagcctctccaccatcctagggtttgcttccccgnngcncctatatataccaccacgcgccgcctctctcccacttcctccctttcccaccgccgccgccgccgccgaaaaagaagaagaagccgacgaggaggcgaccatgagggccaaggtaaccaacctccccgccgtctcctcctcctccctaggctgtctacgcccatgtgttgttgcgtcgtcgccgtgcttgttcttggttggtcgggggctgtgattacaaagagagaggctcgagtggtgaattttcacgggaaaccctagcgaggcggcggatctcgccgtgtgcccccctcctccccacgagcaccccgtgtgttcacggcggtggagtggatggaacccgacctgccgccccatcgcgatgttcccttgggtatctcggtagttgcatccataactcaccatgctagcactactccctccccgtccaaaatgttcttgctacttcctccgtttcatagggtaataagttcatttttggggagggaatgcatggcgcgtggtggtgggttgctgtctcgtgagggggtttcctgccacgatgaaggcttcgtttttaacgcatacacttgatatgagccccctttatgatggtattttttatgatggtatttggttggcgagctgaattcctgttcttgcaacatctgatggatggtgcgtgatatttgcttggattacccgtttgtcagttagcataggaaattaggtttatccattagatgctgaagatgctcattaattttgtggtgctcactgtttaaataatactccgtagtactgtctgtaggaaattataactattatatactaatagtagctgttaagttgatcagtaattatgtgatgctcactgtctatatgctattcctgctgtagtttcagtaggaaattatgaatgctttcaattccctgtgaacatgaaattcagttacataactgcattatcggtgattacctaagttaccatttcatagtagttatttttgtggtgcaaagcttatccagggaagtacatcttaatcattcattcatgatttgatagactttgtaatatgaaattgtcattctgtattttgtcaatctgtattgccattttgccatccatgatgcccctacttcagttggtttgttcaacaatgtctatgctggcattcttgaatcacccaagcaatgaatttaaatcaactaaatttgctgtgatgctatgttgcttcttgcttctgcgttccagtttctgttcacccttgtgttctttgagagaaggctactgtgttgtgatcttttgcagtttcttagctatgctaccatgcttatcggctaattttcatcagttaactttctgtgatctgatacttctgtttgtattgtattcagtggaagaagaagcgcatgaggaggctgaagaggaagcgccgaaagatgaggcagagatctaagtaggcgaaggagatgggcgatcatggtgatggcgtgtcgcagtgatccatgtcttcggctgccaagctcgttgatatgtcaagctgcttggcgtggtgccaccattcgactgttgaatggcttatttacctgtgctgttatcatcttatatccctagttttaccaagagttttgcaccaagacatgtcggttcagttatgtgaacttgttatggagccg

SEQ ID NO: 25068 - DNA, 1640 bp, Oryza sativa
  unsure (1)..(1640): unsure at all n locations
gcgcgggcagatggtggtggtgccgcaaagcttcncggtggcggggcgcccccgcgacgaggggttcgcgtgggtgtcgttccagacgagcgacggcgccatgaaacgcgccggtggttggcaagtcgtcggcgctgcgcgggataccggcggacgtgctggacaacgcgttcggcgtgtccagggaggaggcgcgcatggtcaagttcgggagggggcaggagctcgccatcttctcccccaagtccggcgccgccgcccgccgccgccgctctccgggccacagggacgacggcgtgctcgccgccccggcctgaggcgtacgtagataccagcgtgagcgcacgtgcgcatgtacatgtagtactaataatgtgcacgttttccgttaagggtgccacgcactgcatgcaccgtatgttggcccgtacatgtacggtgtacccgatctagaataaatgaagtcgctgctgctaccaaagtgcagtgtgttaattaagagctcgtttcgctttatcaattaaaatttggcttaaactgtgaattaactgtggaacaatccgaaattttgtcggtcgatcagcgcatgaatctatccatggctgtgttcttaagagcaagttcctaacactcatctctctcattttccacgcgcacgttttttaaattgttaaacggtgtattttttttaaaaaaaagttttctatgcgaaagttgtttagaaaaatcatattgatctatttttgaaaaaaaagttaatatttaattaatcatgcgctaataaactactccgttttccgcgcccattatgcaggttcccatcctcccctagcgaacacagccataatattagttttacatgagctcgagggaggagtcgtcaaccatcgtgtgtagttgctggaagtagggacgtaggcgggtgaccgtgaacttgtttataggtcaaacaagtagtaaacctgcgggttcatgtgtcgtggtctaacttactgtatttatggatgtaattgagtcaacccatgaatctacttatatgtcaaaaatactagtaggcaatacacaaatcaatctgtggcttactcactaattttatctataaatggattctccgggtcggcccacttatacatccctagctggaaggtgagcgaggaggaagagaggagaggggggagggggtaaggaagaaggcaagatgaggtggaaatcacatgctaactcaacaagttaaccacgatcaaactgccacatcagtagaagccattttcaaaaccatgaaaggagttgatttgcaccggttttcaaagatgaaaaaggtatactctttttagttttgcggttgaaggagacaattcaactggggagcaagataggggaggaaagacagacttattcccaatgcgtacagaatactggcccaagtccactaaactgcccaagattgcaggctcacagcacagcaccaggattgctaactcaacaagtcaacacgatcaaactcccacatcagcagaaaaccatgaaatgagttgatttgtaccggttttcaaagatgaagtaggtgctacactcattttgcacttttgcggttcaaggaggcgattcgcgagcaagagaggagggaggaacaacagact

SEQ ID NO: 25069 - DNA, 2589 bp, Oryza sativa
  unsure (1)..(2589): unsure at all n locations
nnnnnnnnnnnnnnnnnnnnnnnnnnnnnnnnnnnnnnnnnnnnnnnnnnnnnnntacagaatactggcccaagtccactaaactgcccaagattgcaggctcacagcacagcaccaggattgctaactcaacaagtcaacacgatcaaactcccacatcagcagaaaaccatgaaatgagttgatttgtaccggttttcaaagatgaagtaggtgctacactcattttgcacttttgcggttcaaggaggcgattcgcgagcaagagaggagggaggaacaacagacttatttacaatgcgtacagcccaagattgcaggctcacagcacagcacagcaccaggattcctccatttccaccggcgccggcggccgccgaaaccgcccgctgcactccggcggccgcccaccgtttccccccaccaaaaaaggtaccaccgcctcgctccttaacccccctacccccgaccatgtcgccgcgttctcctccctccaatccgccatggcggcgcccaagccactgtccccgcgcctcgccgtcccgctcgccattgctctcctcctcgccctcggcctcgtcgccgacttcctctggtcatcatcttcctcctctggcacctccggccgcggccagctcgcctccgcttccaggacggtaagcgcttgattccgcccaatgcggcctgccccgccgccgtgatgcagcttactctaccagcctatgcaggcaacggcgaaaaagagcggtagggcgcgcgggaagaagccggcggcggagggctacctcaatgcgacgtacgccgacataccggcgccgcggtgggactgggaggagatgccggcggcgcccgtgccccgcctcgacggctactccgtccagatcggcgacctgctctacgtcttcgcagggtacgagaacctcgaccatgtgagaatccccccctcttacaattccacactctctttgcaaaaatgcattctctcatttactaattttctgctttctgttcacctcaatttcaggtgcattctcatgttgatgtgtacaatttcacttccaacacatggacggggaggtttgatatgcccaaggagatggcaaattcacatctaggaatagcaacagatgggaggtacatttacgcgctgaccgggcaattcggtccccagtgccgatcacctataaaccgcaacttcgttgtagacacagtgacaaaagagtggcatgaactgccccctttgccagttcctaggtatgctctatggagtctgtcatcacttaccattggtgcttatgttatgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtgatgggtggtggaaaagaagatcgccatgaacctggattagagcactggagcttagctgtcaaggatggcaaagcattggagaatgagtggcgaactgagatagccataccccgtggtggacctcataggtttgtacgagtgtacttgttgtcagttgtgccgtttatgcagtttgctaattgatgtgcagattttattagtgagaacacatgcaactgattagaatattgacagtacttcatttttgtcttaactttttacagggcatgcattgttgctaatgataaactctttgtcattggcggtcaagagggagacttcatggcaaaaccaggctcgccgatatttaaatgtgtacggaggcatgaggtatgtatgcttatgtaactccttgatgttacaaattgaagattacttacctgcacctgatgtttattcccttattatcaaaatacaagatataacgctacagtttgcattggccacttagtgatattaacacttgatgtttttaactattctaaacaaaaataacagtagttacacccagtgagtacttatcattgttaaaaaaaaaagtgacatgaacttccatataagaattctagttagtagtctctgtttacattttgatttttatgttctagccgtttatggctatagcttgattctgccataaacacaatttgcacttttgcaggttgtgtacggtgatgtgtatatgctagatgatggaaataaatggaagcaactatctccactgccaaagccaaattcccacatagagtgtgcatgggttatagttaataactctgtaataattgttggtggaactacggaaaagcatcctattaccaaaaagatgattcttgtcggtgaagttttccggttcgatttggatacactggtatgtcagttatatgcacctttcatggttatattctcccaagcatagtcaaatgatttgacagataaac

SEQ ID NO: 25070 - DNA, 2678 bp, Oryza sativa
  unsure (1)..(2678): unsure at all n locations
nnnnnnnnnnnnnnnnnnnnnnnnnnnnnnnnnnnnnnnnnnnnnnnnnnnnnnnnnnnnnttatagttaataactctgtaataattgttggtggaactacggaaaagcatcctattaccaaaaagatgattcttgtcggtgaagttttccggttcgatttggatacactggtatgtcagttatatgcacctttcatggttatattctcccaagcatagtcaaatgatttgacagataaacatctggaatgctcctttttcagacatggtcagtcattggccgcatgcctttccgaatcaagacggccctagctggttactgggatggttggctctatttcacttctgggcagcgagatagggggcctgataatcctgctccaaagaaagttgttggttgcacgtggagaacaaaactacacctttgatgtggaaagttttagctgttgttactgtagattataggtcagtatctgtttcccttttctaactgctaggctctccagaagctatttttgtcctgtattttgtatgatagattgacttctgattcatagtgtccttgttgtctatattgttgtgcatccacatttcctagatgaatttcttgccatgttcttctaaatggccagaatataatatattaacacaatcattttgccacttcttgctgccttatgtaagatagtcaccttgttggtcgtaccatggactgtatctgcagagttcgaactgaagtttctgttgcgtgttctgaatgttgacgttcctcctgattttgatgctgtctacttgtgttctgaatgataacttgtgtcctgattttaatgctgtttacctgcttgtcttcattctcacgtttggaatcggaataccagaatctaggcatatctccaaacaacccaaatgaacttctgtaacagtattttatagatccaatccatttccaaccttttttgagggtagcagcagtcaaggaatcaatatagatctactgtatcgaaattggattgtcgtcctctgctttgtcattctgttaagctatataagtatatggtttacttatgcagcaaccatttttgtcatgttgcatggctgtttgcacctttgacaatttggtatgttaactggcttcaattcaaggggctaattgactgtgaaacgtgaaccattctgcgctaatattcttttcttcctacgttgcttgtgacgaatattctgctagattgagttgcggctgatttagctactatgtttctttcaagtttcattgcacgtagcagctttagcagataagctttaatatattttatgactatgcttcaatctattttttgcctaccttttcttcttctaccatatataattttcatgtacaaaagggctccacgtcgagttacaattattttatttatttaactaatcatgatagcattggtgcaattatttgcatatttattagagatagaaatagacttcatcaatttaattccaagatataccaactatttcctcccccattttcttctcatttgccttgatgtcaagaaagaatcatttctcctgcaagaattattgaaccccattataatatagttcatgatacattttctcctcttctggtgcagatcatgaccagctgttgggtgattactgatgacactctctgctggatgattgtgactcagtcatttcttcttcttcctttgtgtagcttaaactttgccggcattgacaggggacctgtcacaattaacaatggctaatcatcaccgcatggaactgacttggtcttatcgtcttatttagtaggatttaattaggcccaacttctccgtggacgcccggtctggcggtggcggatgggcggccggcgatgagctcgccgtcgttgtcgccgctgaggcgagctgctcgcccggtcaccgactaccacctcaaatccatgcatgccgatatatattttctgaaagctcacatcatcgtatgatactaagtagggtcaaaaattaaatttggttcgagttaaaaaatgtagctgttcttgttactgaaaattagatatcatagaactgttgtgttgtatatgaaaactttttagtaatcatggcttctaagctacatcataatcatgtagcctcattatttttactaatgaattcctggtctcctggactattttcttttgcctgggtgtgttgctccttttttgccacaaagtcacaggagaaaaaacagccaatcatgggatttgtgttgatggtgatgtgctaattcgattccatttgtgtatggacatatggtgatcggcatggggccaatgattcagtggctctaacacatgtcaagaaaaaaggtgatgactaggatcaatcaaaacacatacacacacaaaatggtttcagaagtagtcgcgagttgcagtagttgctagctacatctagtggttaaccaacttttatctagaggttacgtctaattgcaacagctgctagttactagtagctacatctaactaatctaaggttaactacatgtaactaatctaaaggtgtttacccttttttggtctagagttttcttactgtccccaattcccatgatcacctttttagcacaaaaatcatgtcaacaggggttaaattatgagctgaggttgtttatggcctaacatatat

SEQ ID NO: 25071 - DNA, 4982 bp, Oryza sativa
gtaattttggattacactgaaattcacctagtcattgacttcaattgatagggattagcgagtttttttagataatgatagtgattagtgaggagtagttgctaaattgttttatatttagttaagacattttctcgatgaattactactccactactagattatggcatgaaagtaggtgtcattttactgcaacttgtgcatttgaaggagaaatttgtggactcaggtggaatgtgatgttcagattgtttagcattgaggaaacctggaggattttgaggctgtggttgtaagcttgtgcttgcatctaggttgtaatttagtacgagatcttttgtatggagttacattttttattatggtagcaccttggattcatgggattgtcttcagtgaagggtgaactgcggtgattgattctctcagttatatatgcatttgcatgttgctacttctacttatgcccccatgtgagttgatgtcatgtgcatgggaggtcactttttttgtctgtgccgacaaacctgtttgtgtttttttacatgaagacgcgtcattaggggctgaacaaagaatcgtgctctggaagactcacatttcttcagatatgtctttagcagttctaatgggaggaatcaattgaagcataaagccatacttgatttgttatcaatagacaatgtttggttaggaaatgggcacactctgatttctgtacttttttctttttggaacagaagacaaattaaaaataaaaatgagctgtgtcctgctaggtctatggtctggctgaaactgctatcaccctttgcgtgatgcttcatgctttatttttctagtggatgttttaattgcaaaatttaatgtttaggatggtaataaccatgcatttgttatttgatatgccagagttttgtttgccatattgacatgtgttttcaatctctatggcaggatttcttcagcacaattttgtggtggatattgccatgctttgttgtgaaagtcacacgagaaatgttccgtttctcccatatcttccaagagtcgacttggagatcatgtgctgtactgtttgcttccatcatgtcatggatgtatctgaccacaattatattaacctcctgcatgcttttcaacttggtttgcaacctacaagttattcatttcgatgactatggaaaacttctagaacaagattcagatcctttggtctatttaaaagagcacctgcagcttcgtcataatctctccaaaatcagtcacaggttccgcatgttccttttgctgctcttcttttctgttacagcaagccagtttgccattctgttcaagacaacagcatatactggaccaatcaatttcactaatggtggtgatatagctgtgagtacaatattaaaaatcacataatgttcccttctggttatgtttaaaaacaaaacagatcataaatagatttctcttatgatgcaggtctcttccgttgttcaagttgtcggtcttgtcctttgtttgcatgcagctgctaaaatttctcacagagctcaaaacattgcttcactggctagtcgatggcatgccttagtaacatgctctagtgattctacttatgtaagcacaccaaacagttctgggaaccttgtgccttttccagcacatatgttcttgagagacttttcagaaagtgatttggagtctctggagagtggctcagtacaaggcaattctcatggcacagctcaattggcttcatacatgtcttcataccacaagagggaatcacttggttagtaaatctaaagcttccatttgaagtttgcattgcttaatcttttttcattgtgataacttggaattaatgcataccttactttacaagacattcttttcttttatattgttaagtgttaaagctaacatttcatatacagattttttttttgggtgtcctgtttgattcttatgttttttttattcttctgtgtttcactgcagtgctgtatcttctgggcaacccaggtggcatcacgatatttggctggatcgttgatcggacattcctaaatacaattctgatgctcgaattaacacttgtgctcttcgtgcttagcaagaccgttgtggttccggccaaaacattagttcttgattacatcaggtttccatgatgggggctatcacatctcaaacatctgaatttggtccggatcgctagatatggtgaattgaggatacacatcaggctcctattgccaccatgccagaatccgatctggtggacagaaaatctgatcttctgaggattaaaatcatctgctggatctgagaactacaaggttggtctctcttgaggatttcctgatgaacaccctgttttgccgctaatccacgtcatgccaattttccatgagaaacagagagaacatcatgtaattttgaacagttgatcactgaaactccactctaggctgtgcgctgtgcatagagccagcttcatccatgtaaattgctgtaggcttctcctgtcttttttgttgtgcatattaagatttaaaatttaggggtatagaccacatgatcgatactacaactgaatctaaagttttcgtttatggttgagtggattgttcagatgcaaattttatgcacatctgcatttctgatagaatcgtctctcggtaattattggctcgttgcaaccgtaacatacatgcacttggttgattgatcagaaagggtattttgtcatacggttcaaagtcttcaatatcatcaacgaacaattacctcagcttaacaacagtccaatgcataacctgaattcttattagcaaaaacttcttcatcatgaatatatatctggaaaaaaagatgtgtagaaaaaaaatgttgtgaaataggagtatgtagaaagtgggaaaaggcctcgctgcccaaggttttggctacaaacatgcacctcgaacagaaacagaggaacagcagctgctggctatacacagcatgaacacagagagagctaacaacaacctgagctaccaatctaatcaggatggccccggcgatgctttggatgggcaaaaaagaatcaattttgactacatatttctatctggtgaaacctaaacgaactcctactgagagatttggacaggtggaaaaaattcagtacatccctttgaaaacggtgctggtcccgcagatgcttgctccatgctcctcgtattcttcctttgtgtggcaactctgaaagagaacatacaaacactttagattccatcttatcactttattcacgtgtgcagtgcatatggtttgcattgacctgaagcatattattgacttattaacaaagttatatggcagaatatgtcatattattaaatttgcagaatgaggtgtcaagactcaaagagtgtaaagtggaaggcacctcataaaattcagggttagaagcagctactgaacccccgaaccaagctgcataactctgtataggatgggcgaccacattgacttcaacaggctggaaccaaaacattagacgaacgaaacactcaattaattgtcaacaaagactcctgagacaacaggttgagacaaaacacaaatggaatagttcaagtattgccgtatgaactcaaaaccaatcatcgttgtacttactttcacctccacatggtgacgggcattagttgcggcaacacgctcatctactatcttctttatgtcattctgaagtctcttgtggaagtccttaaacattgtagatccaccagacaatactatattctgcaaatagtcaaatatcacataatcaatatatgtcacattcttagatgtgtcccagagttcaaacaaagcaccttatacagatctctccttgtgtcaattggcgcagattgaacacagctatcaattagttcaggtagaggagtggagaagtcggcagagtaaatctcgggatggaagaagatctgcatttgcgctagtagaaggttagtaaattacatcaaattcatgtttttctccttttaatgtcatttcaaggtgaagagtccaaatgtcaataaaatgacttctggaggaagcatttatcagatcaacacaaaatttacatttgacccatagttcttattagtcctttttgtgttgaagcccctggactttcactaatactgaatgccctagagaacagaattactcttccaactaatcatacatgttcaatcataacatgggctttcagttcattccaacaatgcacatgatttcatggagtagcacattagacaaacaaacaggacacaatcaattataacatcaaaagctgtaaaaatgttatcacgtcagtagggtagcacgcctgttcaaagcatgattggtatcatgtcaattgtagcaacactactaaaagaacatggaaactagatgatagaaatgggaacaaacctctggtccaagaaaacgctcatatccaatatcaattgtgtatgggactccagtcttgggcttaatagcagaccagtgtttgatatacttatcaggctttttgtcatgcttcttgaactcctgaaattgtaacggaaacacataataacctatctgttcaagataagtctaaactacagttcaatcttgctggtagaaccagaataataatatcatatgtagtatatattagccagcagataaatccatgacaaaagtaacatcacaaaaaatttaatctctgccatccgaatcatgctgcaacttgcccatgggctattctccaggcattaactaatccgtgataatcataacaaaacaaattacaattcacaacaaagttggcattttttttgtttcttcaaacataattgtttcgcatttaaaattcaaaggatgatacagcacgccattatctcctgcgtattctgaaaaaaaaatacagcacaccattcctttcatggaatttgttgtgttgactcgat

SEQ ID NO: 25072 - DNA, 1496 bp, Oryza sativa
  unsure (1)..(1496): unsure at all n locations
nnnnnnnnnnnnnnnnnnnnnnnnnnnnnnnnnnnnnnnnnnnnnnnnnnnnnnntctccaggcattaactaatccgtgataatcataacaaaacaaattacaattcacaacaaagttggcattttttttgtttcttcaaacataattgtttcgcatttaaaattcaaaggatgatacagcacgccattatctcctgcgtattctgaaaaaaaaatacagcacaccattcctttcatggaatttgttgtgttgactcgatagtcgatatacagatacttcaacagaaacatcactttcaactatttcatcaaagaatgtatttatgtacaccgttggaaaattacaacaaggtaccctaaaaaacataaggtattattgagtaagtagctccgaaaccaagcagcataataccttgacaatgtctgaagaagtgtagcaatacatttctttcaccctacgagctatatccaaagaatcctcaggtgcaataagttcacctctttcctgcacaacaaaagatgccattaatcactaaaaacattatgtgacaggccacaactaattatagaggcaataaagatctgggagcagcataactcaaattacagatgaaaactgagtagaacattgagaatagtatcaattgttctaatttagtactgtaaaaactactcgatgctcctttcaatgtatttgcactatatgaatgctagatacacacacacatcctgtttatgaacaacatgacttatgaggagaagatgaaatacctgtaaaagctgcaaaacaaactgtgtaacgtcacttcctgaaaatggaaaagacttgatgctactcccaattacgtagccgtttacaaccggcaccacatgtggagctccatccccaatatcaactactacacctgtcatatcagactgacaaaatatactggtcaaacttaacaataataagtagcatggtgtaccagaaattttaagggcatgtaattaaaagggagcatgaatagacccaacagatatgaattatgggtgttcaaacttttgcaaggttggtactggcttgctaggaactacagatctttatcctcaaccaaactggcaactaaaagactaaatttacacagtcatattgtattaatgttgatttctcatagtgcttcaatcagtattatctgtctttcatattgcttaaatatatacttctcttcgcatataacacaatatgcagaacatgtttatttgcataccagtatacaagggaatagcaaaacaaaactgcatacaagaataggaattctaggaacaacacaggcaacaaatatctatggataatatggcaggaacagactggatttttttttttgaaatgtggctatttaaatatcttaaagaaagggagcaaaaacagagtttgtcatagcagggctacatgtcattaaaacaagtttacaataattttgtaatacagaaaattcttttcagtcaaggagatg

SEQ ID NO: 25073 - DNA, 1553 bp, Oryza sativa
  unsure (1)..(1553): unsure at all n locations
gagctccagttccccttcggctcacgcctcctcctccgccaccgccgccgccgcgggagcaggagacgccgccctgtgaaccatcccggggggtgggggtggncggcgcgcgccgggcgatcgaccggtcagggccggcccggggcgatccgcgacggcgaggtggggagggggggaggagaggggagagctcgtcggcggcgagggatgggaggcggaggcgttgattcggttgacgagggaagcgggaaggggggagagaagaggggtgggtggcgtgggcgtggggatgtgttggggttggggttgggtggtggcgcaccactgcggcgtggggatttgtcgtgttgggtgcgtgcgtgcgtgcgtgggatcggggtcggtcaatacaatccggtgcggtcgtacgcttccgttccagccgtgtggaccaggcacacttttaaggttacacacaaagggggcacttttggggcgcttttctttttataaggtttacacagaggatgcatatagacacaaaaccacattcacaccgtgtacccacgcacgtgtacgtcctgtataggatagagattagaggtctctacggattagtttggtaactcgggagaagaggaatgagagtttacacgaggattggcatggagtataaagactagatcttaagggtgtgtttgcttgtttgcacgtatctgagtcaagcttgcatccgatgaaaaaaaagccccatggataccctaagcaagaaggaccgaatcgaacttcattacttgtcctggatcgacgtgtgtaggcgcgcaacccatgtgtggggttactattggggcactttatttttctaagattacacaaatgatgcatatatagggtagatagtagaggcttctaccgcttagtttggcaggagtataaaagaggaacaggtaacgatattaatatgaaaaaaataattataatatcttgtttggtagagttagtgggaattgacatggagtacaaaactagagactagatcttaagggcataatcggttgcttgtatcaacctggcttgtatcttccaggtgcaactggctccttgtttggttacctacacatgtcccagatctaggcctagctgatgaaagaatccctcgcatcctgcttgagcaggaatgaccgaatcaagattggatacttgttctggctcgatgcgtgcagttgcgcaactcacgttacactcgtgtgggcaaggggttgcgatgggtcaccggtcaccaccctgtcttcctcctcatttctcccccaaaccaaaaactagggtttgttggtgccctccttccacctttgttaactccgatgagctggatctgaggtcacgagcaccgccacgtggcaaatctggcacccaagagctcaagctcgaccaaatcaggtaggaaggaggacaagaggagggagggctcgatcagattccggatctggaagctcaaggggcatctgttgtcgttgttgacctcaccttgtcgtcaccctccatccgatgaactaaacagatattaaaaagcaagt

SEQ ID NO: 25074 - DNA, 554 bp, Oryza sativa
gaaagaatttcagctgcacgtttccaattatccacacaaaacatcattgaacaagataagcatgaagcaactgacatctgaggcctcccgctatcataaataagacaactttgaggggaatacttttctgaaaacacattgatatgatagctatgcaacccacgaagacatgtttttatcccacataaactaaactggcaatatgaatattaaatcatgtgtagtgtaaactgacaagacatacacagaaagccaaaatatctctcaacagcttaccttctgcagcttccttgcgggccatatttgccttcatcaaatcagccgatgcttcagcagcctcaattccagttaagccagtgcagtagctatttcggatagtctgcttgcagcatttgtagccccactgatgatctttccaccatgagccccatacggttgtatggttattaatgaaaacatcctcttcatatttgctcttgggaagggctacatcctgtatgaaatgaactttgagaatccatgaactaatacatgcaaaagacaatagataatgt

SEQ ID NO: 25075 - DNA, 1300 bp, Oryza sativa
  unsure (1)..(1300): unsure at all n locations
caaggagatgcagtccatgtggaaacaaatgtctcactggagcaaataaaaagcatgaaaagcagatgtttacagaacctaccacagaaaccgagttctcatcagaaatacttttcagaaaggcatatccagcagaaagactgaggacagattgaacagaaatatatagtccaggaacattgaaagtctcaaacataatttcccctgcacattcacgactttcaggtgtactgacaggactatcggtaagaaggaagtagtgctcttcaggattgcaccgtagatagttgaaaatgcactgttgccaaaatctttccattgtatcccagtcatcaacctgcaaaagggtaaaagggacatactatagtcgtataacatagaaatataaacaattgttgttattacaaacagaaaacacataaacatacctgaccatgattaattgggtgttttctagtgtacagcccactagatttaaatagtgatagagcctcatcaccaataaaaaaatccaggtcagccatgacacctgcattgtactgtgctatccaatttgcactactgcacatctctgactggtccagaaaagactcattcacagctactacagtagggatggtgaaacatggctcagagttaccagagaatccaagtttgctatacctaaacataagatcatgcaagatggtgtaagaaaacaatcaaacataaccttattggggtgacaatgtgcggccttcaagcaattgcagataaatcaagacacagcttcaggggaaacatctttatcctacaaactatttatatatgttttactctatttcagtatcttcaggtattgcccgattctggtatctaccatttttagcttttcaggaatcaggatgcttcaagtaagacatattttcagacactaaatcaaacccgtcagtcatgagagctgcatcatgtcctggctaattagggagttaaccttaaatgttccatccccacaccccaaacatgaacccaatcctattccatttgcaactaatgcaactaaacaaaaaaggcactccaatccaacacagcatcactcggaaatccaatgatccgaagttctgaactatatgaagtggagttcctactgattgactagaacctcaagacgcgaaatgggaaacctctgaacgactgaataatccaagccacagatacacgccacggtacaggcaatccatcgccataacacacaagggacatacgctcgcctcgcggaatccannnnnnnnnnnnnnnnnnnnnnnnnnnnnnnnnnnnn

SEQ ID NO: 25076 - DNA, 642 bp, Oryza sativa
  unsure (1)..(642): unsure at all n locations
nnnnnnnnnnnnnnnnnnnnnnnnnnnnnnnnnnnnnatttgaatgagctttattttagtagcataatgctcgtacattgcaataaaaataaatataaaagcaaaccgaattttgggttcgctagtaggtacacgtacaaaatttacatagttatgcgtcagacccatatatcgcacacacatgataacttacaggttgcatcttattgataaaatcgtttattaaaattgtagctttgtgaaatacctgtcttttagtatactaatagttcgaatcattttattgaaatttatgaaaaacaaaacaagaaaacagagggttccagagacgttggtgcaaatctctgaattcgaccgagcaacacactgctcaggcttgtaccacctgtcacatagcactagcagcaagttgtaatcaccccagagaaaaaaaaggttaaaagaaaaaaaagaaaagaaaaagggaagaacaagaaaatttcttcgcaactccagcgtgtccagcgcttttggacttgttcgcactagcccgaaacaaatggagactgctacggatcggacgttcgatttgatgcaaattattggacggtgttgtcccgattgttgaagaatgtttcacatgtttcacctctcgataaaaat

SEQ ID NO: 25077 - DNA, 1348 bp, Oryza sativa
  unsure (1)..(1348): unsure at all n locations
cgagaaagtgcgagacggtgatgggcctccatgtaatgggcccacatttggatgtgaaatgggctgtgcggttatatttgggcctaattcagtctatgaataagttcactttatatccctcaaattatcgctgagtttaaaattcatcaatcaaccacaataatatgcatcgttaacattgaacagtatgcaatgagtagctagaactgatccttccaacgcagcgtaccaagaaaagctaccagaacacagaggtcgaaacaccgtgaaagcagcgaaataaacgaaaaatatacgttcatgaacatgatttagacggcttccatctaatctttccacgctacatctaaaacagatttaaacaacctatccaatgtcacaccattgctcacgatatgaaataaacgcaaaattacttaaccgcaatgaacagcaaattcaaaatttgcaaaatatctccaaactacatactcctagggcttatttaaatcaaactgttttgagctgcacctctcagaaaataaactagagaaccaagatgtttcagcttcgccttaaaagggatcagaacagactggtatgctctcaaatcatatgctttgtttagttcctaactttacttttccatcacatgcacacataagcatttcaaaacttaaaagccaacattaaaaaaaaattatgttaaaagcatttcaaaatcaaattttggtttattctttagctgtttaggccaaacgatagggctaataaacttccaacttttttcttcaaacttccaatttttagtcaagcttccaattttagcatgaaactaaacacagccatagactagagagcagggttcaggctgctctccaaagccaactcttgagttaaatttggaagttaaaccctgcaaaacaggccttaagtagaacaacaaacaagctaccacaggaagcaagaaccagccgaagaactgcagacatgcaaaacaatgttaagcttctaaagaaaaagtaaggcctgtccaggctgagcatcagcgtctccagggaaattcctacactgaaaccatcaagcaagcaataacgcagagatcaacacaccaatgctaacagataaagcagcaatcaatagatgttaccacagagccaacaaagcaattactcaacggtaggtaaacattagcagcaaatacggctccataacaagttcacataactgaaccgacatgtcttggtgcaaaactcttggtaaaactagggatataagatgataacagcacaggtaaataagccattcaacannnnnnnnnnnnnnnnnnnnnnnnnnnnnnnnnnnnnnnnnnnnnnnnnnnnnnnnn

SEQ ID NO: 25078 - DNA, 608 bp, Oryza sativa
tgtggagaaagtgcagatataactcgacagaaatacttggtggaaaaccttgtaaatgatgaatcaatctttgcagcctcctttagcttattatccttattaaataacaaaaaaattgcaaaataaataaaaaatagatatataatacaaaagtaaacagaacaaatatgtaaagcacaacaaaatgtaagatatatacctattatgtgtattggcaaaccatttgcaatacgcagcgaacataaaacaggtaccaatgttcatgttgtggaagagcaacaataatgaaaaagctcttttcaagtgagcaaactaattcaagtgatcaggcaaaaaaaaatttcgcatatgatggtgagaagagtttcttcactattggtgctcttagacaagtaaacaaacaactactaaatagagaatcatcagaaaacaaaattgaaagaaaacagttgaaaaaaataaacactaagtaaagtagaagaacaatactgcttaaactctaagtaaagaacaatttctaaacaaatgcaagatcttaagacaatctgagacaaggtaacagaaaaaatatctaaagtacaataaaatataacatatgttggaaaaga

SEQ ID NO: 25079 - DNA, 706 bp, Oryza sativa
  unsure (1)..(706): unsure at all n locations
nnnnnnnnnnnnnnnnnnnnnnnnnnnnnnnnnnnnnnnnnnnnnnnnnnnnnnnaatgcaaaaggtgacatgttagtacataccaattttgtgttcagaaattgcaagcctatatccatggaaaaacaacataccttaaaatcatcacagccatgtcctttctccccttcgtgaaatctagtatgatgtcctccgccattttcttagcttttccatagggattaattggtaactgtaacagagtaaattattaaccaattaggtacataatatttacacatcagccttgagtttgcctttccagcaacaagatgaaatagcacagcacaatccaaacactgcagttttgaggccatcataaattaattacctgacgtgtggtttctacaataggcatcttctctggttctccataggtggcacatgtactagagtaaataagggtcttgactccatgagacgccatagcctccaaaatcaataaggtgttcgatgtaatattgtgatagtacctgttaaatacttaagattatcagagatatactagacatgtttcagatatattatacagttcatcatatctgtgatagcagataatataaatatctgagaactaaaaatcagaaagcacttgattatggagttaacattgtagcataccaagtaccatggattaatagtgaaactgtttttatcataaggacc

SEQ ID NO: 25080 - DNA, 290 bp, Oryza sativa
  unsure (1)..(290): unsure at all n locations
cattctccaatgctttgccatccttgacagctaagctccagtgctctaatccaggttcatggcgatcttcttttccaccacccatcacatggagccgtccacgccaaagttgagtagcgggtgcatacctaaggggtgttacaacataagtttgttttgtctacctgattgtttatatggtatagcaataagatcattacatagctttagaacatcttaaaatcatagcagaaatagcagcctttttcagatnnnnnnnnnnnnnnnnnnnnnnnnnnnnnnnnnnnnnn

SEQ ID NO: 25081 - DNA, 4311 bp, Oryza sativa
gtatgaaatcattaaccattattttttaaaaaatgtgtctccattgtttcacttatgtttataccataagtcaagttaattttaagacttaattatgaagttgattttgtggattttttcatcgtgatttattttacaacattggcctttatatcagtaaagacacacacatataaaaattttacgtacaaattattttttgtttgctactagtaagctggacaataagcacaagataagcgaaataatggggccaacggtttgtgtagatgaaaaatttacttaaaaaaagggcacacttccgtcacctccgtcgccggcgaaaatcctcttcttccgccgtcgccgttggggttgaattcggtggcgccggcggcggcggcggctgcgaagtgagaaggcgtcgatacggacgaactcgccggcgtcatcgccttggtagaatagacttggtcaattgggcccagcccaattacaccaccgggcccaccttgtcagcccacatcaaaccgttcgtctcgggaagccaccgcacgattggattggattcgactcgactcaagaaaagaaaagcaggagagacacaaaagaaaaaaaaaagaagaaaccctagctcgccggagcaccgccgccgtcgaggcctccggttccccggaatcccaaccgctggtcctgtgcggagttgcggggtggttcacggcgggttcgctatggccgcgtcgtcgccggcatccagcgggaaggcgggcagcgactcgtcggcacccgcggtcgcggtcgccaacggcaatgggacgacgccgcagaagctgcccccggcgtccgccttcgacatgcccaagcccaacctgcgcggcctcaacaagcccaagtgcatccagtgcggcaacgttgcgcgctcgcggtaagatttttttttttttgttttggggatttgtagtgatggttttctaagagaaatcgatgcgctgtatcggcatgtcgctcctggatattttttttaattcattctgtgtaatgtaatgcttggcctttcaggtgcccgttccagtgttgtaagagctgctgctacaaggctcagaatccttgccacattcatggtatgtatgtgtaatgctagtaccatttgagtatatatctgctcctgtgcaacgaattgtgcttgtaattagttgtattaagccgctgactgaatacctgtacatccacttattcgatcatttgatccaaccaatttttttgacaggcgtgatttggtcttgcagttttacctttctgtggactattactcattgtttggcagttggagatttacctgttttattgtttacaatttattctgggaatgcttatcacgtttagctacttagcatcaaagctaggacaattgcttgtaagtggggtagtgggatacttcaattatggaggaattttaaggtacggtcactttcttatggaccgttgatcaaacttataatgataagatttgaacatgctcatttcaacatctaaaagggaaactacaggtatagaaatgcattattataacgttttgttccattttggatttttatttttctcagtactgacaatgttgtcgcgtgcaattgaacaacattaacaaccaattaatgcttctccatcaggctgctcaaatagtgggatgatgttggtcaacagaatgtttgatcttcatattttgtagggtttagggaaggaaatgagggaaagggtgtagagaagaatttcagtatgtttgtcaggttggatcaaacagcggcagttttcttcaggactgtagtttaggatgtgggatgtgaccctgaaccctaaccaatgaatctaggtcgatgaacaagctacttggtctgtcaaaataaattatatggtataaaataaattactactactttatggtatgtcatacacaaacacccaaggaagataatcagttttacactacaaggaagggaacacgaaattagacaaataaatatttgggttgtagagacatcagacatgtgacccatccagccacacaattctgttgctctatctcctcagttctaacataatctcatatcctcgccatcgatgcagtttcaggctttcagcagacacccttgccaccatcttttataagcaaatgccctagtcttctccaaacctcctcccctcttctgctgacttgtcttgcatcggcgacagagaaccttgagggccacgagatcacagggtgtagcaacttggtccccatcttctactgctggattatcccctgcagtgtgccaccacacaccttcacacatgccagcaccacctgaatggcgaggaacctggccactgttgccccaatcaaaatcaggtaggtttctgtacctgatttggatgcctctaataaccaaacacggcctggaggtgacctgcatcaactgtgaccagcaaactgggacaggttcaggaacgacagtattgtatcatgatctagtgactgtggtaatgactcacttgagtgccatgagcccatgacaaccttggtttctaaaattaaattgacccttgccatagcattattattgccttggtctctaaaatcaaatggaccttcagaaatgtgttttggagggataatggcctcatgggtgtaccttgaagggctcttatttgttgtattgtacctcttaaatctgctttcgaattatattcatctctctctatactcttcattatatggcactgaatgttgctgtcaaaatttattctctctggtgtataagggattagcaacatttggttacatacaagaaattttgatttatggctatgatgttatgcctgtctacatattttctgtgatttgtctggactctgtatttttctaatatttttgaaaaagccactaaccacctcttatcaccaatcatgacagttctgaaacagaacaacacattgccagataagccacctctgtcaacagctcctctgtcagagcaaccatcagctaatataccttcaaccgggtaaccttctgaaccaggagttttatcttatggtaaaatctgtcattatttctgatgcttgcttgaaatttgctgctgcagttcatcaaggttggcttctctgcaaaggcttccccatcatttcctgaattccctccgaacaaagaagtcccttgccaaaaaggttctagctgttccattgtttgcgattgttcattgtttagtttcgtttcttttcttccatgatgagaccatgattaaggagttaagcatttatattacaggatgttatgggcataaacaagtggaggtttgagaagctaaaagaacatatccaaggagacatcgatgctgaaaatgaagcgtatgaaaggtatacacagaatgttgggttactggaggaaacgttcggtcttacagaagatgctgctgatgaacctgaacctgaagcaacttcttcagaagagaggatggaaacattggtttccgaggcaaaggtgaggctgaaatcggactctgcaaatgcagatggcttccgggacaggattgctactattttggaccagaagataaaggaattgctagaaagcaaaagcacctacgaggatgacaaccctcctgaccaaaatccagatgaccatccaaagcctgtcaagttatccatcaagcagcaaatggagagaggtgcaaagatgactgagctccttgctaagatgataagagcacagagtgaggttgatctgaagatctgctctggtattgcggcgcagctgtttggaaagaagaatgaattgagcaaccaagaatctgttgcatctgttacgattccttattcttttccaaagctctggactagggtggagattgatgatgccatgatgtgtaagatcaacggcgaattttcgtcttcgacagaggtaatgcagctataaacctggaattaatctgttcagacccaatgcttgtctacactagaagaacatggttgaaccacagcttcttttctgcttaacctactgttcgtttaatgtaagcaattgtaattgttttcatcagagacaaaaaccatgagagcaacacagtagtttgaccagtttgtattaaaccatgacatgagagcaatacagtagtatagttgtttttctttattgtctatgagacatcgcttgtctccgccggcggcggcggcggcggcggctgtggcatcttgttcgtctttgagacgcgtggctcgccgaagatcgtgactatacactcgatcgagaggaagtcgccggcgaggaacgccggcgtctcgacgaactgcacgccg

SEQ ID NO: 25082 - DNA, 731 bp, Oryza sativa
tataaatacttgttgtttatgtcatgaatcggataaaactttataattctaatcaatattttttaaatggttaattagcttaaaaacaaaaaaaatggtatacatatatttgcatcaaaaagcaatatcattatatcataaacttattaaatttgataaactgataaacttgatggtcgaaattttaaatttttgatcaaatcttatccttaacttcaaacatttcagatttttgccaagatgttgaggatcgcgggaagtagcaagactgtgatcattatctccaaactagaatcagtcaatggtttatggttacatgctggcattttgatgcgaatttgcaaggaaattcaagaaaattagtccttgtctcttgcatagatattgggaataacagaataagaggtcatcttcctgcctattatctcccacaaatccaccatgaaagaagggcaagatagcttcatcttctcgtacccttggctttccatgacgccttccatcttcttggaggtggccaagaactcgatgcacgcctccttgagcttctggcaatggtgctgatccgccattgccagcgtcgccgcgacggtgtccacggcgatgctcttgcagagcatgagctcgcagatcagcttcagcctctcgacgtcgtaccggtcggcggcctcgagaaggtgcatgatcatatgcgccttgtcgtcgtcgtcgtcgtcgaggtcgtccatggc

SEQ ID NO: 25083 - DNA, 2236 bp, Oryza sativa
ctacggtggtggtggcggcggctaccccaccggtggtggtgacgaagacgacggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccgagaagaaaatattcatcagcatttggatgagtactttgtgtgaatgtttcttggccagatctgatctgaaattttgtctctgtctcctgattcaaatctgatgcctcttgtactctgctgtacttgcagggtggtattcctgtatggtttatgcagcttgggttgcagattactaatcacctgtttgacctgagaaattgattatgtcctttgctgtacttgtagagtggtattcctgtatggtttatgaagttttatgcttgtgtttcagatggctaatcaagtatgcagttttatgcttgtgttgctgaagttttatgcttgtgtttcagatggctaatcaagtatgcagttttatgcttgttgctgaagttttcaagtatgcagttttattcttgtgttgcagatggctaatcaagtaatcagttactacttggtgtactgattacacaaaccaggggcgatatactgtatttcatcatgtggtagtggtacctgattgttttttgttgatcagacttgaagggttgtgtctaattgttctcttgttcagagtactcttgtctgttctgttgttcattcagacaatctgattgttgttttgtgcagagcctgctgttgtgttgtttctcttgttcattcagagaatctgattgttgttttgttcacaacttgtttgttgtgttgttcatccagaatttctgagtctgtttgttctgcttgttgtgcagaatctgcttgttctgctgttcattcagaaattttagtctgtttgttatgatgttcattcagaactttagtgcatgtttgtctgttgtttcattcagaattatcagaggggacaagtgcctgttgttcatccagaattttcagagcaaatcttgttctgtttcactagtaaaattacagagtgaatagttggacctgaactgcattagctttatttcttttcctgcaggaaaaaatatctacaaactcactcgtatctgaacatcaactaaactacaactgagctaggagtacctacaagtcagtaaaccttcacaaactatgaataattaagtggtgagtaaacaaacaaaaactgattacgaagattaagcgttcattgatagtaccagaagtaaaaataataagcacgctgttaatttgtttcactggtaaaaccacatagaaactcttgtatgaaaaatcgtccttttcttgtaggataaattatttacaaactcaggcatatcagaacatgaactaaactggttagtaaaaaaccacaaactaattcagaatatataaatgtccattggcagcatcagaagttagaaaaatcaagctcactgactaattaatatactcaacaagctactggggagacaaactactcgtgagggggagtttttagagtcgaccttcaggcatgcatatcagaacatcaacaaaactgcaaaaaagctacctggtcagtaaacaaccacaaactactaattaagaagattagccacaaactgtagtaattaagaagattaagcgtctattgactctatcagaagttggaacaatcaaacactcttgagtctaactagtaacacagtttagtggacaaactaattaagaaaagattaagagtctatcgacagtagtagaagttgaaataacacaatcactctgaatctttcactaattaaacacagtttagtggattttgagtaagctgccgatctggtagaagaagtatttgaagagcgagatacagctgagctggtcaggatgccggcttatcaccacctcatcgttcatacccatggcgatgacgaactcgacgcaggcttccctgagcccgc

SEQ ID NO: 25084 - DNA, 4857 bp, Oryza sativa
ccttctccttcatggcgccgtagagctccgccttgaacaccggcgaccgcgcggcgagcatcaggcggtgcgccgtgaacgtctccccctgcacggggaacgtcacgtcggcgccctcggactccacctgcgccaccagctgccggagtatgttcgacggcgggacgtcgtccggcgcctcgcggcgccgcacggcggagacgacggggtcgtggacgacgactcggacggcgcagtcgatgacgacgctgtcgccgcgcaggcacgcgggcgacgcctccagcttgctccgctccatgaacgcgcggcggccgaagcacgctgtgccgggattgctcgacgcgaacaccctgggcgcgccggaggcccggtcaacgtcggcggcgcgtccggtgtcctggtcgagcaggcggagctcgtagaacgcggtggccgtggcgcagcgggtgaccagcctgagcttgaccgagacgtgttcccggtcgccgccgccccgccctggccctccgggtagaagcagatgcaccagtcgtagccgccgacggtgaaggtgccggagcgaatgcaccggccggcgccaccgcccttgcacaagctgtagccgtgaaatgtaaaccggtgcgttcctcttactgtctccatcttgctcatcgactccgtcgccgtcgtcgtcgtcgtctccatgggcattgctaatcagatcacttgctgctgtgagatcgatcgattcacgcgttgcgatgcaggtgtgggagagattaattaattaattattaaggaaaccctagatcaacctatcacaatttgattttagcagcgccgtgagtactataaagagtgttgaataatatagggagatcgagagagttataccgaaaatattggacttattgacttgttgtattgaatcttagaggccggtatatataagagcatatatgtgacttagattttaagtaagtttagagatatagatagaaactaattacttttattcggtatgacaaacatatactagagttttattcatatacggagtactaagtaggacctttgtcagacattataagacccggtcaaactctaattcctgagtagttacgctgtttcacagtatagaaggccacagtttaatttgataccatcttctaaactattattttctcatagatcatatttatagcaacaaaatctttatagtagaaaagtaaattcaaatatctactactaaaaaaattcggattgatgatggtgaagctaaaatagacacacgatccaacatagaaacgtacatccacacgttttggagcgacaaaaataaaaaaaagggtacatgcgatccggaaggaaaaaagcgtaaaaagggtcgatgcccccgcgacccgcgccccctcccacgcgtcccttgaccgcgccgcctcatcgccgccccgtgctccctcctcgccgccctcgaccgccgccgccaccgcaacagggcatcgtcgccatttttgctgtgccctacgctcacgagtggagttcgtcgccgacgccacaacccaccgctcgtggcatccatgccgcatctccctgaccgtcgccaccgttgctccattcatctggtcggtaacgatggaggaggcggccttgagtgggcagcggtgaggttttaccattttagtatggtcgctagagcaccgtggcacactggcacgcggaggtccatgcaccactgcggcggctggagaggaccctagggtttgcgcacgcggctagattgaaaggctgcaatgtgtcctggcattcaggcaaatcatccatctccaagtccgaccgctgacgctcgatctgaatcctctgcctgaaaatgggctgctggccggtgtgtcgttcctcgccatcccctccaccacagttcggtatcttttatgcttaatagacttctctttgttaattcctcttcttttgttcaggtaaattaggcagttccagaggatagagcaggaagagagtcagcaccatgaatgtgagtccatcttattagtcattgctgttgtgttcgatggtgttctactgctccaaaattttcttgcgctgttgtcacccctacctcctttttctacatctgctacatatgaaataaacaatggaaagcaactgataggctgcagattatctatcctatatattgttcatcaagttatgctcatgctgcacgtatttcagattgaattgataactgatgcattggagtgacagtagagcagcagagatttgcttgcaaaccggttggctgattttctgtaagtcaatggcttggaaatattttgctcctgcatgtttgcctgtatcactgcatgttataggggataagtttggatatttacctaaacatctgagacgtacgtgtgtaatgctgatatgttagagcaattttgctaatagcatatggtttggcaaaattgtttctttggtttattttcatgttaaaatctgagtaagtttatttgccaccaatttatctctttctgactttccctaatggcctaatcccttcttcacatgaacaaaaaaggtagtaagagtgtagtggcttgttttcctgcagtgttttattgcttgatttctccacctctttgaaggcaaaaatgaggtgttagctgagtgatctccttttttttctctttgattgttttagagctctgtatatcagtatatccttatctcggattaaatcttttgtcacttttttgagaagtaagatatcgtgccagcatatctatattactaccaaaggatttctgcttacagcactgaaaatgtttgtttttattagtcatccaactgaatgttttagcccttttgccagaatgctagatgtaacccagggaaaatgtctttaatacattatgtatttacataaacattgaatcttttgtcacttttttgaaaagtaagatatcgtgccagcatatctatattactaccaaaggatttctgcttacagcactgaaaatatttgtttttattagtcattcaactgaatattatagcccttttgccagaatgctagatgtaacccagggaaaatgtctttaatacattatgtatttacataaacattggcttccttaaagttgagacttaattaggagtgatctgttctgtgtatgctttccccaagtgctagggctagaatctttactttaatttgttgagaactggcgatgtcatctgtacatgattcaaacaaatatgttatctggtaaacaattatttgagtcccttagttttaacaccgatacatcctgtgtttgtatatcttaacaatggatgcattattgtagattttaacaatgttcctctgtattatgtttgcagcgcaaggattttcatatcattatggtacacaggtaagtacctttttggactgtaatattaagctttgttctaataatttcttgctgagcatctagaataaagaccctggtatgagtgagttgtctagcagttatacaaatcattgagaagcccatagttggtcgataccattctaaggctgtgttcgttggggtgggttgggaacaaatctcctgtgcacgaaaaacggagtggtccattagcacatgattaattaagtattagctatttttttaaacaaatggatcaatatgattttttaaacaactttcgtataaaagcttttttaaaaaaaacacaccgttgagcagtttaaaaagcgtgcgcgcggaggaggaacaggggttgggaaccctttgaaacgaactcagcctaaaggtttcttcattgacaagctcgagtgccatagccgatctagatcaacttaggcgcagtaatttgaagcacttgcaaataaccatcaccttgagttgcaaaaaatacacttccttccaataagggaaacctataaggttatatgccgttctatccccttgtagcactattttggatagaggttcttagtgttgcgaggagctttaaattttcattggtttcagatggttgatagttcttaaaaggtattgtgatcgatataatggaagggcaatatgaagggtatacattgtttttgtcatttatggctagatgatccaatttggtaatgtatacatttcttatcaattttgcaacgttacataaacatgaattttgtaggttaagcgtgtggagattgagtggtctctttgaatgtggggctatattaaagtttttgttataatttacacttaatgattacttaacattattttattcaatgtaacttaaaatggatgcatactttttgctccgtaccaaggcacgggcactcaactagtatcatattcaaatatcaatcattaattgtggtcatccaacccaacggccatgaactgaacacaaacatccttgagcgcgtcgcagtagtgctgtgctggtcagccatggcgagcgtcgccgcgacggtcttggcgtcgaggctcctggagaggatgagctcgcagatcaccctgagcctgtccatggcgtaccggtcggccgcctccagcagctgccgcaccatctccttgtactcgccttccccgaggtcgccggggagcgccagcgtgtcgctgtagacgaagcggaggagcgcgtcgaacacctccggctccatgtcgtcgacggcgatccgcggcgcgcggtgctccctcatcgacccgtacagcgatgccatgaacaccggcgagcgcatggcgagcacgatccggtgggcggcgaagggttgccccctgacgtcgaacgtgacgtccgcgcccacgccgtccgcccgctccagcagctcgccgaggtgcctcgacaggtccggcgccggcacgccggcgaggggggacgccg

SEQ ID NO: 25085 - DNA, 5732 bp, Oryza sativa
  unsure (1)..(5732): unsure at all n locations
nnnnnnnnnnnnnnnnnnnnnnnnnnnnnnnnnnnnnnnnnnnnnnnnnnnnnnnctgcgccgcccggaacaccgagcggggcagcccggtggcgcggtcgatcagccggaggtcgaaccgcgccgccgccttgcccctgttggtcatcatcttgacgaacaccgacacgaactcccggtgcgccggcccgaacccgccggggtagacgcggacggaccacctgtagccgcaagcggcgaaggcggaggaccggacgaactcgccggcggcgaggcacctcttgaggctgtacccgacgatctcgaactggtgcgtggcgcgcgccgtccgcgtcgcgcacgtcgacctcgtgatggtgctctccgagatggggcgagacgatgccatctctgaatctgatcgagcttgctgagagtgaccgatcgagctgatgaccatggaggaatttatatactagtagcaagtttggaatctcaagatgtgaagattttttgaatttttttaaaattgaagaacaagaggggtcgagagaatttaactgtatttgtcagacatcgaagccgaagcgtccattcttttctctcttttttttccctctctttcttctagtttggccatcatttttacacgacattgaggtgcacgaagagtctatagattgtgcggtgcaattcatcaaggaaaaaaaaatactactgcccataatttttacaagtcagctacaaaaacaaagcagactttgcaagcggtaattgccaaacttatattgattagtattactcaatagccacatttcaaagggaaaaaaaaccaagacagtaaaattcatcttaggtagttctgtaatcggccaaattcatcttaagtaagattaacacctgcatgtagtattaaatataggctaaaaaaatacttcctccgtttcataatgtaagtcattctagcatttactacattcatattgatattaatgaatctagatagatatatatgttagattcattaaaattaatatgaatgtgggaaatgctagaatgccttacattgtgaaatggagggggtaactaattacacaaattatgactaatttgtgagatgaattttttaagcctaattgctctatgatttgacaatgtggtacgcgacagtaaaaatttgctaatgacggattaattaggattaataaatttgtttgttttttattagtgcccaaacaccctatgcaacaccctaaataatactcgatgaccgatgtgacacgctcaaaactttaacaccaccccccccccccgcgcgatctaaacaccctctaagcaaacaatgtatactctactaaatagaaatatactagcatggtgtactaaagcaaaaaaaaaaaacacattaagcattgcctattagtaactcaccattgaaagtggtggataaaaaagtccttgaccaataaaaacaatattttggttgtcctaataacgctatatcgtaaataagaaattctactactttctacatatttacaatttctgaatcatatatcaaccacattgtctgctgtattattttttttgcttagcttaatctttgttgctgtcagaatgtgggccccctcctcgtatctgctgcaacacgtgtcatagtacttgttccaaacctctcgccggagtgaaggggagaggcgcccatggctgacgcttcccgccacgaagtagtagttgtccggcgacgccatgaactcggcgcaccgccgcctcagcgcgtcgaagccgtgccgtcggccatggccagcgtgtccgccgccgtccccgcgtcgaggctcctgcacatggcgcgctcgcagatcgcccccagcctcgccatgccgtaccgccccgccgcgacgaggaggcgccccagcagcgccgtgtggccggcgccgtcgaggccgctcgccacggggagcgtgtcggtgtaggcgaagtggaggagcgctccgaatgccgccgccgccgccggcgtgtcgtcgtcgtcgtcgtcgatggtgatggttgccgcctgcgacgtcgtgttggtgagcaggccgggagcacgggcggcgagcacggagacatgggcggggaaggtctcaccggcgatcttgaaggtgacgtcggccggctcgtcgtcggcggggtactggcggaacggctcgccggagggcggcgtgtcgtggtggaacgtgaggcggtcgcggcagacgtcgacggcgcactctatcttgaggcagtcgcctgcgacgtatggcgagccgtctaggaagctcctggcggtgagctctccggtgccccaggtggacaggtcctcgctgccggagtcgaacaagatcggatccttctccccgaagaaggtgaccatctcgccggcggcctggtcgagcagccggaattcgacgtgcgcccacgccgtggcgtccttggtgaccagcacgacgaacacggccacgtcgtcggtcacctcgtcggcgtcgccctccgggtggtaccggatggcccactcgaggccggcgacggtgaacgtcggcgagacgatgcagccgccgccgccgcagtgctgcctcctcaggccgctgaagccgtggacgtccaagacgtacgtgccgctggccggtgacatggacgatgacggcgccgtctccattgttaccaattcaatctacgtgtggtttgtagatgtggttatatataaagagatttggtccattcgacacggagggctccatgtatcttgcaacagattaaccgaacaagttcgatcatggaattggataagaaaaagtggtttgtagatgtggctatatatatggagatttggtccattcgacactgaggactcctaagtatttttcaatagattaatcaaacaagttcgatcagatcgatattcagatggatctggataagaatttgacgggaaagcaaagtgtgtttgtcacattttctcgtaaaaaagtggtttgtagatgtggctatatatggagagttttggtccattcagcatggaggactccaagtatttttcaacagattaatcgaacaagtttaatcagatcgatattcagatggaattggataagaatttgatgggaaagcaaagtgtgtgtgtcacattcgacatggaggactccaagtattttgcaacagattaatcaaaaaagttcgatcagatcgatattcagatggaattggataagaatttgacgggaaagcaaagtgtgtgtgtgtgtcacattttctcataaaaaagtggtttgtagatgcggctatatatatggagatttggtccattcgacacggaggactccaagtattttgcaatagattaatcaaacaagttcgatcagatcgatattcatatggaattggataataattcgatggaaaaccaaaatgtgtgtgtgtgtgtgtctcactctggtagtgctaaagacaaactaaatgtttgagcacattttttgagacacattttttttaaaaaaaaatgtttgaggcacattaccaaatttatttagagtttttatagcgaaaattaataaaactactacagtttgggaggaatatgttggtgatagtgtgtttggtttgctacattgccgaattttaataatgacaaaatttagcaaggttaaaaatagtatcaaagtgaacacacaagatatcaaaacacgagtagcaactcatgggcaatttaagataaaaaggagtgatggggcaaatttctagcataaaaacttaagagagttggtaagagagtaaggtttaaaaaacaactcgatctaaaggtaaaaccatttgcatgatccagatagccacattacattaaggtgcaaccacgcgtgcaccgtatcagtcatcacattgttgagagaacattcgtcagatcatcaaatgtaccaaaacaaacataaccaaaaaggaaatctccagacatcgcgcacatatatcttctgaatcaagaagatgttaattaattcctgcgaacacggctcctcctctcccacacttcaaacgccagagagggaaatgctctcttcagctgctggtacccttgacttgcagccacggcatccattctctcagatgggaccatgaactccatgcaagcttccttgagcttcttgagatctagcaagtcagctagacccagtatcgcagatacatgctccgtgtcgaggttcgtagctagaaatctctcgcacatgatcctgagcctctccaatccataccggtcaccggctttaagcaaatgcatcatcaaatgcatcttctcaccattgccaagatcatccattcttggaacacaatcggtgtagatgaaatagaggaaagcctcgaagacagatggctgcatgtcttggatggttatctcctgcatttgtgtctccttcttctccttcatcggtccacagagctgagcatgaaatactggagacctcgcagctagcaccgccctgtgggcacggaatgtgtcttctccaactctgaatgtcacatctgctcctacaccgtccttcaacatcttggcgaaatccgacgatatctccataggaggcacctcgatctcgcgcaatgccgaactagtttcagcgtcacacaatgccctggttttagacacttttggctcatagatgacagtaacattgcattcgatcacgatgcagtcattgacgatgaaccctggagtgctctcaatatcgctcctcttcatgcacttgagagaccccaaggtagactcctgaaagcttgaagatctgaacggggtaggcacatcggtcttggtgaacagctgacgaggttgcccgggttgcagctggttgatcagattcacgtcgacgagtgcccatggctcgccgttcttgctgatcagctcgaggtagacgccgatgtagcccttgctgtcgtcgtcgatgccgtcagggtagtaaagcaacgcccaatcgaatcatcttacgttgaagacgccggaccggatggagtcgtcttcggcttcggtgttcatcatgctgtaactgaagatctcgaacctgtggatgccttttgccgtctcagttgtgcagcttgatatgctcctcgacgccattgctgttgcttaattggtgtccaatgatgatcgatgaccctgcagttaatatatagtgcagattaacaaatagcatattttttttagataatatagaaacactaagaaagtactcagggattttttggtggatgtgacacatcctctttagaatgtgtcttagaatgtgtcacatccacccaaaagcacatatattatgggacggaggacattttttatatatattttatctttgtagtagtagtatagattaattggaaagcttatgcgtcttgggaattaatttggaatcagtcaaacatgtaaaggtactatatggcaagaagagtaagaaatcaggtgcagattttttcttgcgattataagaatttatctcttgctaaaacagccttacaaactcctaattaggcacaatttccttttagcattcgtagatcaatcattcacaaccaatcttgtccatgcaaaacatcatttggaagtgccaacctattgttcgttggtgagaaaggtaggagtttcaacaaattcaattttgaaaacttttgcataaacataatttacatacaattatttactttcaaannnnnnnnnnnnnnnnnnnnnnnnnnnnnnnnnnnnnnnnnnnnnnnnnnnnnnn

SEQ ID NO: 25086 - DNA, 2717 bp, Oryza sativa
  unsure (1)..(2717): unsure at all n locations
nnnnnnnnnnnnnnnnnnnnnnnnnnnnnnnnnnnnnnnnnnnnntgacaggtgggtcccagcggtttttgctgtgtgtatcgccacgtgtgtgccacgtaggcttaaaaccgctttgaatcaagttagggttataatttatccggttttaagagtttggggtgtcaaatgtccggtattgtagtttagggggtaaatcgtactaccgcaattgttcagggggagggataattcgtacttttttcttatttttttaacgactcgcataagacggtgcgaaattttattgatagagcagaagaaaaattataagattaaaaccatgggatgtaaaggaaaagattacagctcctatttatgggccatctaacttaagaatgagctagctagcggagattgattcacggatcgccacccaaaatcctgacaaatcgaatcaggatataacaaagcaggcaagaagattgtttttcgtctagatttacactgctagcagaaagaaagtaatcaatcaacaaatcatctatcggcagcaggcgtgtggagcaacatccagcgatccttcgagtccgggaaggcacacgccgagggcgaggtgaattatatatcatcgttttgattgattactgcactttttttttattgttgttgagctagtgatggtggtggtgtgaggtttgtggatgcgcagtaccaggcgcgacgtgcggtggaggcggtgacggacgccgccggcgccatccacattccattcaaaattttcactgttatacctctcaaccacctttctatcatcaaccataaattattttataaagtttatagtaatttgttcttaaccataaattattttataagggtattatagtcatttgttttaaactttaggatatgccaaacaaccttaaaaaatactccctccatccacaatagttatacatattacttttaacaccaagaccaaggagaaattaaatcacctcggatgttgtaaaatcaaggagtgaatacaagcatgcaaccaatgagtatttagatgactccttgggttctaataaaacatttaatttatctcttcatttaagtcttgaatgcataaagactacaaataggaacaacttatttgaaaaaaatcaaatgtgaaataggtgtaacttttgtggatggagggagtaaataatttgagacggagatattacactgcaatacggcccattggtgactcgaatttcttggcagtgacagcctagggccgtgggccgtatgcaagtgctagttgtaaccatcaatcagggaagtgtattagagcaagtatcatagtaggctgcaagtcacttataaatatatgcggaaaaaaataagtcaaatataaacacatgcggaaaaaaaataaaagatgagaggactacagatttgtagcatggactttaatatgttgtgtcaatggcagatctagcactaaaatttagctatggtggatcatcacaccagaactaactgcatggtattttaaaaatgaagcaacattttattatacacaaactataatatgtcagcacttattagaatatatgccattaaggatgattataatcctaaatttgtcatgcagtttttacaactgaagccttataaattcgtcgtataacttctacaactaaactacatttccacgagtgtttctctgttttgttttctaggtgtgtttattcataataagtagacattcattgaagttacacatatattctttaacattcaatttttaccgattaacattttgttgttagctagatttgttcattcatttgtgcagacacaaggcagtcccactataggtctttatctcctgttaattaaacgaataagcttgtaccaaatgaaatacaactaactaatcacataattagcatctgaaatcaaggctgagatggccatatgctcgaatactctacctactttgggcatggcataggtatgactggtgccatcccttgccacgagagaacgccgttgtgttgtgtgtgtatgaaagatgtaatcatatattataatagtgtaatatacacttataagtaactatattttatggataagctattagattgactatatataatttggagctaataggtgactattctaaacttctctaatcttttctcgtgagaatgtagactggtgagcaggtggcgcaagcggcacagaacgcggcgaccgccaccaagggatcccctccaggcaggcatccatccgtatgaaaatctgaatatatcattcgactgagcagtgaaggtgaagcattgcctggctgaagctgcattttacgcgccttcgttctctgtttcatgtttctttcgactaacctggttgtaacaaacatatgcatttgtttgctcgaagattccgaaatgttgtcacgctgaacaacattccacatccgtgataacagtttatcgcatgacttgcactgtaatttttagcttccgccaaactgtatttcttggggtacattttactccaagtcagttttagctgataactgtatttcacatgctagatgtagttacatcctagctaatatactttcaaatttagtttttgctaatgaacgcaacacttcccgaagcaactttgttagtaaaattacatttaagaaattagtaaaattggtccagttaaactggaaattgaggatggtagtcaggttttacata

SEQ ID NO: 25087 - DNA, 3984 bp, Oryza sativa
ccagctctagataaggtggtgccggagttggagttgtgccaaacatgccctaaaattagttgaatggcagcagaaaacaagcggagacaccatggaacaaaataaaatacaccgctaacatggacacttgcagacatcaacgaacatggtatgaaacaaaaatacgagaggttcaactgactgatatttcagatgtcaagttttcaagcaccgtaacaaataaaatcagatcagtacatcatattataggagagatggcacaatccaggcaaaagttcttaaattctagtttcatagctgctttcatagcaaaacggatctagttggccacggcagctctcttccttggggtaccctcagtacctgaatcgatagaacaaaaggaacataatgaatccaaacaactttgctatttttaacgcaattaacatttcccatgatatttaaaacatcagaaaagtttcagacaccttctctgaagttgctcttgaacctcctaggcacatgtcgcatgtacctcatccttccggttcctgtggtcttgcgcctaatggccttcacgctccagttgtctgaaatgacatcgcagaaattaaaactaagcaaatccaaaaagacaaaagaaattcaaccacagaatctaactagagatttagaggctaaccacaaacaatacaactcaaactaagtatgttttcatttaatgtgtatttggtattaaatgaacgatgcaaggaaacatatatgcaatgatacgaatttaaatggttacattacaaaccaaacaactcaaccaagtactggctaccatacattaaacaaggcagcagcaggagcaagttgacataatggtgaacagaatgacaaatagaattgccatatgtttgaactgaaggttgaaaaagagcaaatataataaaattgcctgatctcagaaaagaaaaagaaaacagaataaataaaatataaggttagaggatatgtcgaaagaaaacataagaaagggaaaattgagtacttatagaaaaaactatgtgcattgggtacatcagagacttaaatacttaggaatcacaggagcatatctcccatcatattgttgcagtttttctctcatcacttgagcctgcctcatgacagaagcaggcaacatggaaatacataaacacagtgaaggtacaaaacttcaaagtgttacaaatttccaaaagtctaaataaccactgcacaaatcatttaatcaaatgtgatagcctgaataaaatataagctcagaaaatgaaaacatcttctcattgatgccatggcatctctgaagtctgacatgcgaaagttttcatgattcctcatagcattttttttgtaagacagcaaaatcatttgggaaatcaaatgcaaagaaaaaacatagtatttgtgatcaattacgacatatgagatatatcagtgcttgaattttgtacgttaatactgaccgttttcaagagcctttcaaaaggaaaatatgtttgaaggatcatcagagacttaaatacataggaatcacaggagctaagctcccatcatattgttgcagttaaaacctcatcacctgaccctcataaacagaattaagttttcatacgaaaatggtcatccttatgttttccaagcaagaattttagcttataatcatttgtgaaaaaaaacatgtgtacaaacaacacattaaattttgttcagttaagatcaacgcagccgagcaggtaaatcacttgtcaggaccacagatcaaaagaggatggataatgcccaatacatacaataaaaataaaaatgagaccaaagttttcttcatttccatcaaaatgccggaaatgccacgctctacaaagagggttcaggtaggagaacgcatctcagcttgagaagccccgatttctacccattaattggctcatctaggcgcagtataatcatcatcaaatctacatggcaacccaaaagcaaatacaagatctagtggggaaaccgaatcatgaggaggaggcttacacttgcggatgcgggcggcggggtaaccgcaggaggagcaggtgctcttctggaggtggaagctgcggcggccgcagcggacgcagagcgtgtgcgtcttgttccggcgcttgccgaagctgcccgtacccttaccctgcgagccacaacaagatcaccacgttagagctatggagaagccatgaggaggccgcggcggcggcggcggctgcgaggtttaccattgcttgatctgctcctctcggctagggttggagaatggggcggctgcggcggcggcggtggaggcgtgcgccgtggcgtaaaaccctagctatttatagggagcaagggagcagcaatagtgggcttccatgggccgttcagaacaaacgcaatcgattgggccgcacgtaagtccaaatcgtaccgcgcgtaatagaaatatgtttactttacatccctcatgtttgacgttgagtttgaatctcttcccttaaccacagcaccagatataatgtgtccctcagtttgtaataccttatctccttttctgtttcttttaacgtgaacatgtaaattgaaagatatgttatatccggtattacggttcaataatgtattattccaatattaagaattttcggttaatcttacagaccttgcgattgttgagtcgtcgccacggcgacggtcggctattaaaatatacgagcaactcgagcttgtcagagttacggataaggtataccctctatccttagatatacgttgtatactgatacggtatacccgcgcgtatacggatattttctgcgtacgttaaggaaatctatcacgtgatagaaacggagttcacagatggaaggagtcctactcggacagaactgggtcgttgccatatcgtgaggggtccgatatctccgagttatacttggagaccaactgatccgcgatataaaagggaccccctgggcaggactgagggcatcaaatctcaccgccaacacatctaccacagcctacgaagccgaagcctacaggagccaagtcgccgggtgatctagtcgaaccaactcgattacggtctcgtcggtatcatcgagttccattattccctttgtaatttgtgatttccatcatataatcccataccaactggattagggctattacctatcaaggggcctaaaccagtataatcttgtctttcatttgcttgatgtcgtattacgtagatcctcgttccaacataccccaatactctctatatccggtctacgggtatcccccgtcgacagagctgcagtgtcggattattggacactttatgccggaaacacgaacaatgatctaaggtagggggcggctaaaataaccgagacgcctacaaatcgggcacccattttttttcaaaaatcatgcacggctccaccaagtagatcggaattatttcactaagtagatagaaaatgtttaaatcgtttaaaaagctgaaatacaaccaaatcacctcacgaaatattttgctacaacatatgaaacaacggtttttgaagctgtttcaccgtatataaaacacaatgtttcagcaaatagcgaaaggatgtttcaattcaccgcaacacttgatctatacataatgaaacaacatgagtatactttctgaaacattactggtggaacaaaaaatgaaacggattcacttaatatagcgtttccgtgatatgtggggtgatttgttgcaacggcacatgtggtggggcgcgtggtggggacgacgcgggggcgcgggagcgcgcacaggaggactgttgcccgattttttcggcgtggaggcgcggtgtaggcacgggcgcccgatgcatgcgcgcccgcatcgggcaccccgatttaaagaatttttggttaatcttagggaccatgtgattgttgagtcgtcgccaccatgacggccggctattaaaaggt

SEQ ID NO: 25088 - DNA, 1017 bp, Oryza sativa
gtaagggaattgctattatgaagatcaacatagtcagaaacttttgggatatccatactgtccatgcatgacaaagtacgaattcaattttggtggacctgcctatttttttgatctgtctatattcctcgaggtagtttatctacattttctacatctgattcttcctccggtcctcccttaaaaaaatgttgatatttgctcagtttgcctcacatcaaatatgttatttcaaaatgcggtttctccatggccctttgtacatgcactaatgaattatatgaaattacctttattcttttgcagaactagacaagctattagagaatgcacccttcccggtcataatgcaacaagccacaaggatttgttctattcgcaagagagttttagctctgaacatgctcctgcgctccatacaaagacgtatagataacattgatagaattgtttctactggtgtaacaagtggtattgctcttctacgatgaataatgtattggtctgaatctttctgtcaacactttgatgagtcccttatgattaacatcttgcattttgttcgcagatcattcttctcatgtacagttgcacagacagaattgaagttggattgaggtacagcatatagtccccagatgttggccttaataaaatatgctgacaacagattagtcctgatgaatcgaatagagatgcagagttgtgattttccttatttgctagtataatctagtgctaaaaactcgaacaattttatatctgaaatgttataagcctcaccaagtatcacataagaaatcttctctaccttataattgcatcttttattgacttgcatgctgtatatgacacccctgctatgaattacagggtttagaagatagtttccactgttaccccgtgtacacccccttctatctgggagagttgccacctgaagttctactgtaagcaacatttataatacgaagtcgaaactaaaagtgagagtaacatccgcagtttgtcctccaa

SEQ ID NO: 25089 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnctagctacggggaggctactcgtgctactacccgtgtctaaggggaggagatggagcgaggaggaagaacggagagaggcactaccgtgcgggtcggggtgctgtgacgagaggccgacggcgcgggagtaatctctccggcctcgggccggggaagaagaaagagagggcgcggccgaagtccccttccacgtccttgctcgtgccggctcctccgacacgcgcaacgacgaacggcgacggcgaaacagaggggcggcaatggcgcggaggtgaatgggagaggaaaggaaaaagggggggagctcgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaagggggcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25090 - DNA, 527 bp, Oryza sativa
  unsure (1)..(527): unsure at all n locations
nnnnnnnnnnnnnnnnnnnnnnnnnnnnnnnnnnnnnnnnnnnnnnnnnnntttgacatcaacgccacctcatgtgcgacctcggcctccgttggttgcacccctgctccctccaatgcatctgtgatctccttgtccttatgagccagcactatgagagaacctgggtgcaactctttgcccccagcatcctcaggacgagcaccatccccgagaaacaagaaggtctggtccgaacgctggatgcggaagccgtcgaagccggcaagcgtcatgtcggcacgcagcgcagctccacgcttccaaatgcggtaagtgtcggagggggcgatgcggccgatgaagggtatgacggaggactcgaagtggaaggagatctccatgtagaagtctcggatgcggttgatggaggcgaggacgcgcgggaggcggcggcaccacttggcccaggcgaggggctggtaatggcgcgcgatgatggtggcgatggcgtcctcccgcgtgcagacggcctccttgagcgcgga

SEQ ID NO: 25091 - DNA, 742 bp, Oryza sativa
  unsure (1)..(742): unsure at all n locations
nnnnnnnnnnnnnnnnnnnnnnnnnnnnnnnnnnnnnnnnnnnnnatgtgctaaaaagtcaacggtgtcaaacatttcttatcataggagtattatattttgggatggagatagtacatactccacaatgcatgttgcttggagtaggtcccatctatctctctccgctcccttttatctctccctctcccctctcacacattccgcaccactctctctcctggacggacgaagcaaagcggcggcgacaccgagctccacgcctccacctctcctcgtcggggctgaaggcggcgacgtcgccgcccgagcgccggtggagtagcggcggcaccgagctccacgcctccatctctcctcatcggggccggaggcggcaatgcagtggcgcggtccaagcttagaccgcaccgggcagagctccccgtatggcgcaccgtccggcctccttcctcggcggcaggcatggatcggggggcggcgcggccagcgcagatccgggaggacgacggcatcgccatcggcatcggcgcttctcccctccctcccccttcttcacctcttctcttgtgggcctagaagctgcgattctaacgaagaacgagccaatacctcccctttctccacctcttctcttgtgggcccaaaagcccccgtacttgcgaggctccgagctatgccctaagtgaaggggaatgacacctatgtgcaatgtgaatggccttaacctatgtactttgct

SEQ ID NO: 25092 - DNA, 603 bp, Oryza sativa
ggtacccgatgggtttgtgttccagcgaaacagaaataccaaccttaacaaaaattgacagggtgttttgctcacatgagtgggaagaaaggttccaaaattgcttgctttcagctatctctacgatggtctcagatcattgtcttctgtggaggaggtcaacgcacgagaggacgggggcgtagtagctccagtgggcattcaaccatgtggagtggccgacgagggggagactgtcggtgccattgtggatgaaatggagagggaggattctgacaaccagcgtgtagaggaaggtgattcgtcacatgatgagaccgatattaatccaccagaatgggctagtgaggatttttctgggctgatcgtctctgaagaggatagtgtgagatgggagtacaaagaaaatgaggttattcaaggagcgatttatagtagagcacaagatatgaaggaggcggtaaaacattttgcagtgtcacttcatagagagttttgggttgccaagtcgaaccggtcgcaatatgaaattcggtgtgtaaaggaaaaagatggttggccctggagagtgcacacgtataaagggaaatggaaagattattg

SEQ ID NO: 25093 - DNA, 610 bp, Oryza sativa
  unsure (1)..(610): unsure at all n locations
nnnnnnnnnnnnnnnnnnnnnnnnnnnnnnnnnnnnnnnnnnnnntccatactgcaagtaattagcatgcgtatgcatgcaatggatatagctacagtagcagtacaatctaggggcatgtcttgctgaggcgtctacaaagccatcgatgtatggtgatgatgctgtcagatacacgatggatcacacaaagctctctcagctgcttctcttcacgggcagtagataagaagcagccacccctgctccgtgcctttgcatacacatggtcatctcccatttcacctgcaagcaagcaagcaaagcaagaaacccaaacttttggtccagactccagagaagccaagtagccaacccatgtgtgaatcctggaaagaatagaacagctgcctgcttgcattgtctccacggtacaagagctagctgagctcacacacgctgagagagtgagagtgagaggcagctagctagagagagcgatatttcagctaagctctcgtctcgtcttctggcagatgcccatgggagttttggttagtggtggcttgtgagatcggggagatcgaaggctttactgcaagctgattcttgcatggcaagagctcgatgg

SEQ ID NO: 25094 - DNA, 809 bp, Oryza sativa
  unsure (1)..(809): unsure at all n locations
ccgtcatggcgcctagcgggaaaaattatctcttaaaaaccctaattgtgaaatttgtttctttgcttgttgtctagtgtccgtgccatctcagatctcaaatccccgatctatcgtcaagttcaaatccgaatccaaatctttccaaatcaaattcctccgcaaaagtctattttgcctcccccggggtcgatgggccgaatttctctcggcccatcttcccctctccctcggccctctcccctcccccagcgcgctccctcttccccttttcctccggtccgttccgccccgcacgcgcgcgcggcggggcgcgtgtgcgcgagcgccgcgccgagcgccccttcccctcgctctctttctcctctccctggcgagctccccgcttgcgaagacagcccccgcgcgccgtcgttcgcgcgcgcgcgcccgcgtggttccccgcccgagtcgcgtcgtctgcgtcgtccgcgtcacccggccccgctgctctgccgcgcctgcaaccgctcggccccgcgagccattgcgcgtgcccagccgcgccgcccgttgtttcccgcgcatgcgtgccgagtggccgacctcctggtcgccgccgccgccgtcaccctctgccgcgccagcccgcgcctgtcgcccgtgtcgtcgcgccgctccaaaccgccccgccgtcatcgccgtcgtcatcgcctcggtcccgccactcccgcgctagcctacaagggacggaggcagagcctccctcctccctnnnnnnnnnnnnnnnnnnnnnnnnnnnnnnnnnnnnnnnnnnnnnnnnnnnnnnn

SEQ ID NO: 25095 - DNA, 4978 bp, Oryza sativa
  unsure (1)..(4978): unsure at all n locations
agnnnnnnnnnnnnnnnnnnnnnnnnnnnnnnnnnnnnnnnnnnntgccatcctataaaccggagctccccccctttttcttttcctctcccattcacctccgcgccagggccgcccctctgtttcgccgtggccgttcgtcgttgcgcgtgtcggaggagccggcacgagcaaggacgtggaaggggacttcggccgcgccctctccttcctcttccccggcccgaggccggagagattactcccgcgccgtcggcctctcgtcacagcaccccgacccgcacggtagtgcctctctccgttcttcctcctcgctccatctcctccccttagacacgggtagtagcacgagtagcctccccgtagctagccggcgccgccccgaccgttgccgtcgctcgccgtgtactcgccgccgttgccgcccgagctccgtagcacccgctcgtcgccggcctcgctcggcgtagctccgcccaatccgacgctagcatcggatttccgtggccgcgtagatgctctcaccgccgggaatcggcccttcgtgacctcgtcgccgtttccctcttccctccccgccgttgccgccgccgcgattcgccgccgtcaagcttcctccggcgaatccgagccgttggctcgtttcccctcgtctcgtacaaccacccggtgtgctcgctttcgcctgtatcgccgtggttcgctccgccgctcgccgctatcgtccgtcgtccgttccggccggtgtcgtcgtctacctcccgccggcccgcgtggcagccacgtaggcgccacgtcggtgccagctcagccgaggtcgggacgggccgaccccggtcagcccctcccgtgagcgcgttccaccgcgagccgtgaggctgcgcgtgggcccgcgcgcatgcaccgcgttcctcccccgcccgcgcgcgtacgccgcgtgctcgctccgcacagtgagccgtgtcaccgacaagcgggtcccacccgggaccgcgcgcggtgagcccggtccaccggctctctctctcctccctcccgcgcacgcgcgcgtcttgggccgccttgggccggtcggcccatttagctcggccggtccgctccatttcccttgggccgcgccctagccgcccgagaaaagtctattttccctccctcttttcttttcttttcttttcttttccaaaaaggatttaattaaatccttttcctttagacaaaaatccaataatcttagaaattcaatatcttcccaaccgtaaatccgtttgactccgttcaacttccaaaattcctcaaatctcgagatctatctaatggcacgcttagaggtcatcaatagggctttattttttttttgccgtttgttgagttgccccgcttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatctttcatttgttaattgttatgtcatgtccccttgtaaccatctagttgcgtctcgatattcgtgcaccctgtgcgggtatcgacggacgccttcaaacttaaaaatctgattaacaacttgggtaaaactagggttttacaaaagacttggaaaacccgacacctgggtcggtgcttgcgaactaaatgaatttccaaaaccacggaccggggaacgtactgggagtacggtttcccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggccgatccccacgggctgggtgatccgggttagtaatgtcgtgtgggtaaagtgtaccccctctgcagaggttaacaaactgttcgaacagccgtgcccacggtcatgggcggatgtgaagtgattcctagcgtagttttgtttgactactgcttgtgaaattgctgttgtggaaaggggttcgatgtttgaaaaatctgcagctgatgggatcagctaggcccgggttggccgtttgaaagttgttggcccgggtggccctttgaaaagctgttggccgggtgccaaccttgtttcaattctaaagactgatacattgcacatactccgaccggacgagacgcactgtctcacccgtgtcgtttgagaagcactcacttagttgtttttagaaaagagttcaaataaaatcaattgcaaaaacaacagcctttctttgaagcctgtattaaacacttatttcccatagcttgctgagtactcccgtactcacccttgctttatataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacttgtgttgctgtgataatccgtcttcctgtgataccagcactgttttctgggactggtatcgattaacaggttaatttggagcgtcacgggctagttccggtcggtactagttcggggcgtgacaatctagtcgttatcaacaagttcatctgttctctttgtactctatggttttctatatcaatcttatataaactggattagggctattaccttacgagggggttgaaccagtataatcctggtctcttttctgttttgatgacgtatcgtgtagaatctcgtaccaacgtactccaatactccatttgtccggtctatgggtatccccggttgacaaatttatcaaaagaaatttatgccttttgtattatatgttctttcaatattattttacatagcaacaattcacgactcagaattgcagtcatttaaaacttaaaattttctagtgcaaatcatacggcatacattatgtttatttgggatattaaaaaaacaaaaaaaaagatttatgagactggcacgggacgaagatgtaatccattttcattatttaaaaaaacaaaaaacagattttttttaaaattaaatggtctcaaccattggttatatccatgcatgcacgcatatatatacatgcatattttactaagggtaattattactttccttgttagataaatgcatttgtggaaggagaaaaaatatttttaattggaaaataaatcacaaaacaatcatcggctaggattttattatgttggagcacgttaaaaagagtcaattttcttttacgaactagaagattatccttgcagagttctcgggaaacctttactactagggtctgggggtaaaggaggggacgttgtgctctctatcataggcagtgttccgctgcatattgcagctgctgcaacgcagccagcatagctgctgcgatgacacaaactactgtgctgcgaggtggttgtgccacagctgcagtagttgggcgaagaataccagtgacattccgaagacaagtcagctctatcttgcccaatgcagtggttcacctctctgcccgaattagaagtttatctgggacaacaaagcacctctcaaggttcagtctttgcctggcttcttgctaaagatcggcttccaacgaaaaagagccttcataagaaaaacatcgtgtctgcccccaactgtgacctctgcaatttggctgaggaaacggtttcgcacatgtgcttccactgcccccttgctgatgccttctggaataaccttcgcatttatatcaacatctcgttgacgagcgagctggcgcatcttcctctacctcctcaaatccccagcaaacactttcgggtgtaatacctgctatgcttctggtgtctatggaatcatcgttatggggtggtctttaggcataaggaagcttccctatgttatgtatatgctatgtgtgtttcagaggcctctctctgggctgagcggtttaaattagatgatagccatgtaatttcatcctggaaggtcctcttctcttccacccttcactctcttaatatgtaataagataaactgaactatttttcccctcttttctgctttaatgaattcaggtggggaagctctcccccctgagagcaggtacaatagcaggctataagccagctacaaacatattttaagaagataaatgaggagagagaagagcaacgggctatagatttgtagtcagctgtagcacggactccaagacgcagtgtgtgtgtgacaggtgggaccatgtattaatagtgtagtatgtaactattgtatgaatgagctattagattggctacagatgaattggagctagtagttggctatactattaaacttgctctgatgaattttcaaaaaaacaaacagctgcagtagtgcagccgcacatgctcatggtttcaacaaggaaaggtttttatcagagtttatgattgctctcttaggggtttgaaaacaactttatcattgcttgaactaagagagtgatgcaaagagagatagatagcaannnnnnnnnnnnnnnnnnnnnnnnnnnnnnnnnnnnnnnnnnnnnnnnnnnnnnnnnn

SEQ ID NO: 25096 - DNA, 8579 bp, Oryza sativa
ccttgctctgatgaattttcaaaaaaacaaacagctgcagtagtgcagccccacatgctcatggtttcaacaaggaaaggtttttatcagagtttatgattgctctcttaggggtttgaaaacaactttatcattgcttgaactaagagagtgatgcaaagagagatagatagcaacatcttaactggcgcaattaaaaataaattattgaacggattgttgctacaaattatctacttgattatagtatagattaaatattttgataaatgaacttaacaaataacttaaaacaagcgatccaagaatgcaacaaaaatatttttaaaaaatgtgaagcaaataatccattttaatattctgacaaaattctagaaagaaaagaagaggggtgataaaaatgaggagcaaattatctgacccgatccactccaaatccgtcaaaaacgaggatatggtatggtcttacataatccggcggatgtggatagtacactgcggattttgatgtgaatatggtatctctaaaatccagcagacgcagattatccgacatttctatcgaattatccgataggccgtttgtcggacaattcgaaattgtcaatccacaactccattttgtttgttgcatactgcaagagatggcacacatagactccttagagctcatctcacacatgcttaactgtttttttatattatagatatacatatattcatattatttagcacttaagcatataagttattcggatggatgcttcattttaattatattgttgtccgttgtatcgctaacttgatgttatattgattgcatatacatgttataactgacaatttcaatatattttcaaaccgaatccacaccaataccatatcatttacgacgtccaaaacaatctgctctgcattcacttcgaatcctcttaatgttgaatagtcccacattggttatggaagggtaaaggacctaagatataagtgggggagcccctcacctcaatggctagcttttgggatgggaaagaccctttacgatcctacaattggtgtcagagccaggctaggttaacatctctggtccgatggacacagtgtgtgaaggcctgatggactgtgcgtgcctgcggggcccgtatacctgatggaccgtgggccggtggggcccggatacggtgaaggggctgagggacaccaatgtgtgaagggggagaagggggagattggggatgtggaagggcaaaggacctaagatataagtggggaagcccctcaccttaatggcgatataagtggagaaaccaatcaccttaatggctagcttttgagggacaccaatgtgtgaagggggagaaagaggagattggggatgtggaaggacaaatgacctaagatataagtggaggagcccctcaccttaatgactagcttttgagatgggaaagaccttttacgatcctacacttaaaacatatgggttgtgatatggtattatcactatccattcgaatccgttttgtttttattcctataaagaaaccacaggggaagagtgtgtaacacaggaactgcgtaagataagatagagcttgtagcaagactacaaaggccttacgctgacacgtatttagctgaaaactatctaagctaaccttcaagtttcaaccacgaaacagtcagagcattccaagtcgctgcagcccttggatttgcacacaaacccatcgggccctggtggatttcagtaaaagctggaccattgtttcccttaattatgcttatgcgtgttggatttcagtaaaagctagacgcttcacagcgtcactacctcactcatttagctccttccccacttgaatccatgcgctacacttcacttctggttgcgtcatgttcgacacgatcgatatcgatcgagttgaggcgcgatgctggccatgcgttctcacggacgaggtccacgcagagatgatgaccatgcatatgccacgtagtcacttggctcccttaaaacgttgaaatttcagatgtttttcgtaaaatcactatgttcctgtagtaattaacaagtagcagcctagcagggagattaagctgtagcagagcaatctcaattctcatttctctaactagaatggtttccctaatattgaataatatgtccacaacgaataaaagattacgtgagaatatatgtactcctttaaaagactctaatggtgatggcagtaaatttgctacccaactgttcatattgtttttgcagtttttacaaattgtcccctgatatttattaatattgtgaaatgatccactatttagttcaaacaaatggataacatataatcaaatgagcaaacaagtgatattaagatatttgataaaaaaaatattttgctatggcatattatgattcttctgttaatagcaaaatatgggtattttgctagtaagcatgaaatgaggaaagagaagaaaaggacatatttatacacactatataagcgagaaatgcgtagttttaaaaaagcatatcaaaatagtaatgtttgtattagcggagtattaatgtgacgtggatgattaaaaaatattttactaatagtatgcaactatttaacatataaataacgatagaacgttctcttgaaagtttaaaaacaactctcgtcattagatgaaagatctttcttatttgactttacatgaagagagccgacagttcacaaacgcactaccacatacgtattgggacatcccataaaaaatcaacctagtactgaatatgacatatcctactactataaatctgaatatatctctatctagatttattatattagaatgtgtcacatccagtcctatatgcctttttttgggatggaggttgttcgcattggggaaacctgtttacacgtacaggtacgcgcaaattaaacaacatgatgcgcagtactccctccgtccaaaaatataagcatttttagcatagtgacaagtcaaatatttttaactttaatcattaatagaaaaaaataaaaaagataaattgattttactagatttatcattaaataaactatcataacatgtaatattttttatttaaaacatcatacttttatagatattgttagtgaaagtagcatatcagaaaccatgtcaagatttaaaaatatttatattttgggatggagtgagtagtatttagcaggacaagttcaggtgggaaggaagtcaattaaaggaccgaggtacaacgtgcaccagagcggcctcccaattccgaaacaaccgagccagcagtaaaatcagtgaacttcggtgatgtcgaccgtcgacgaagcgcgcgctcgcgttcagaccaatgtcaacctcgtcaatgaagctggcttaatatatgacaattaatttttttttcttaatcttcaactaacagtattatttatttatttatttactcagctaaataatgccatcaaaagtactttaagcatttgtctatttgcaacaatatttttatataagtcaaatgaattaaaaaggacaaccgaggtagtatgtcgtcataagcagcactatcatctactcctaactggagtatttatatgggtatgacagccggcaacattagcaagtagagcaacgaggctagagtttagctaccatgttagaaatggctaccactaccctgtgcctgcagggtgcggccctcgtcgtcttgatcgtctgcctggcgccggtggcaccagcgtgggctcagcagccggcgggctgccccgacaagtgcgggaacaccagcatcccctacccattcggcattggctcccgctgtgcccgcgacttcaacttccggctcgtttgcaaccacgcctactcgccttcgcgccttttcgtgtctgaagtcgagctggttagcctgtccctcgacggcgaggcccgggccctcatcaacgccagaaactattgcagcgacggcacaacctacatcagttacaatgctttgaggagggacagccagggccagctgccgttgtctgatgtgtctttcggccgtagcaccgcctaccggttctccgcggcgaggaacaggttcgtcgtgctcggttgccccgtcttcggttacctggttgacgccgaggagtactatgtcagcggctgcatatccatgtgccgcaagtcgcaagccggtaatgatcacctggtatggctgccagaacaccatacctcggcctctcaacttctacaagccttacatcctcagcttgaataagtcggcagaggagaaccgcgtggaacccatctaccatcgcctcaactcgacggcatgcaattacatgttcctggtggaggacaagtggatcgacaccacgtacagctatcgcgcctacttcaaccgaaccgacgacttcgacgtgcccgtcgtgctcgactgggcgattcggaacgtccgcaactgcagggtcgccaagcgcaacgccaccaagtacgcgtgccggagcgagtggagcgagtgcttcgacgccagcgacggcgtcggataccggtgcaggtgctccaatggctaccagggtaacccctacctcgacagcggatgcacaggtaatcattttaacccaatcaactgttacttgtctctatggctcccatcgtttggttattcacggaataaaccaaacggcatatttgtaaacgaaaaataatttgtaaataaaacttttatgtccgtgtttttaacactttaaaagcaaagactgaaaaataaacttcgacgaaaaaacctcaaaatcaactttaaatttaaggttataaattcaaattttaactaacaatcataaacataagtgaaaagatgggactgtatattttcttggatatataatgctgcagtctgatcagtttgatgatttttctgggcaaacggaagacatcgacgagtgccaagacaaagagaaatacggatgctacggagactgcacaaatacgataggagggtatacttgcttatgccctcgggggactattggaaatgtccacgagaagaatgtttgccgccctaaggacaagttcacgtttgctctcaaggctgttacaggtaattaatgatcgaactaacccatcatgtatgcaattatcttaactttcaatggttttagtctgcaatttcttcctaaaattagcctatgtatatgcaacgttatgattaggggttggcctcggcgtgttcatgtcggtgttcatggcattctggctccgccttaggcttcagaagaggaaactcatcagaacgaggcaaaagttctttgagcaaaacggtggaatctttctgcaacagcagatgcgttcctatggtggcgctggcggtggagtgggtgggttcaagattttctccacggaagaactcaagaatgcgaccaacaacttcgcagttgatcgcattcttggtcatggagggcatggcattgtttacaaaggcgtcctggaggacaacacggtggtggccatcaagaagtcaaagatgatggaggaggcccaaaccaaggagtttgcaagagaaatgttcatcctctcccagatcaaccatcgaaacgtcgtcaagctgcttggatgttgccttgaagttgaagtgcctatgttggtctatgaatttgtctcaaacggtaccttctaccactacatccatggcaaagaccccgaagttgacatagcacttgatacccgtcttcggatagcggcagagtctgccgaggcgctctcctacatgcattcgtcggcttcaccaccaatcctccatggtgatgtcaagacagcaaacatcctgcttgatgataagttcaacgccaaagtttcagattttggagcatcaaaactagcaccaactgatgaggctgagattgcaacattggtgcaaggaacttgtggatacttggaccccgaatacctaatgacatgccagctgaccgataagagtgacgtatatagttttggtgttgtcgtgctggagcttctaacaagaaagaaggcattataccttgacggaccagaggaagacaggtgcctggtgtcatgtttcaccacagctgtgaaggttggtcgtcatcaagagcttctggacagccaagtaaggaatgagctgagtgacgaaatgctccaagagattacatacctcctaatgagatgcctaagcatgattggggaagaacgaccggcgatgaaagaggtagctgagaggctggaatcgctgagaagatatcagcagcacccttgggctaaagctgaaggcaatgaggaggagattcagagcttgctcggcatggaacaaaataatgcaaattaccaactcaggcaacaagatgtcctgggtctggaagaaggcaatgcatatacatttagcttatagatcatgctgatcgtgtcaatctttggtaaatcaatctgttctgatacaaaatctttaaaattcttttccgtgtaacatgaatggaaacactcatatggattgcaatgaaataaccaccaaggaatttatgtggctgtaataaaaaaaaagaaactgcatagactatatagaccaatgatttgtaactgtgagtattaaatggttcttgtttgttcttctgttaaaagaaagggtgaaaacaacatcatgtaaagacaacatgtgatcattaaatagaagcatttaagtaagaacataagagatttgcataccatctctatgtaattttatataccttttggagttttagttggatagaggtttttttttaaggggaaggagggagctctgccaatttcaattaagtagggggaaaaacaaagttttacaacatacaacctccatccctggagagcgtggagggcaggcacataagtttaaggtaatgcaaagcaactaataacaagacgcgcagaaaaatcatctaagttatttgggcttcatcaaactccttgcacatatctatgatggaatcaactacctgaagcacggaattgtatatcccattaaagattattccattcgtttgtaaccaaataccccgagccgtgtggatgaaaaggccatcgaagttgcgtaccatttctttcctgcaagcttcccacgaacctagcatgtctccagtgaagagggatggtgaaggcgtgtggaggcccaatttcctccatatggagctccatacttgtcttgtgaatgaataatctatgaggaggtggtgggtagtctctggttctataccataaaaggggcaaatctcactgttatcccattcccgaatctgaaagttgtctgcagtaaggattttttcaatggatcatgagccatccgaagaatttgctaccttgtaatagcaaattcaagcttcccctgctaagtgaatacatatcaggtcatcatggctcagctttccgtgctgagccatttatagcgtgtgcccatttcaatccaaccaaagcaaacccaaatacaaaaccaatccatttaacccattccaatccagtccattagcaggcttacccctagctatcgtcgtgtatggtcaggagaccatcacactctaagagttggtccgtccaatgaaatgaaggaaggcaatcatccatgagaggaaaatttgttaattaaagagtgggtgtgggtgagctccgatttgactggcacagtaccaatgcacttcactaatcaagcaagtaagaaaagattcatgatgctagccctagcccacactgcgatgtgcgggtgagaccgactgaagcacacggacaggagtagagaagacgaccagtagagactagagtgaagaaagattagtagagctaaccataatttggcaacgcactcaccctgaggcctgacggaggcagaggcgcagagcgtgggaaacccggcggagggcgtcccaggaagtcaacacctccggcggcggtatagatatcctccgcgtgcggtgcggatctgatcgcccccgacgacggcggtggcggcggcgacggcggagggaggggttccggccgccggctcgctgctgtcgtggttgagagagatgacaaaggtttcaaggctaacacgtttagcccatttttaggcccctttacagtgacaaactagttgggccgaaatggaatttgcactaggttgatatggtgggcctaaactgggctctcgctaacgcgcgagccgaattaggcctgagcacgagattcctgcgaatgcgtggtgggttgggctggaataggtctaggacggcaaatgtgcacggtggcctcccttgtcctgggctctaatgaatctgggccgtcttttctcataagtcccacatggaattttcgaatttttttcgtttttagatttttttttaatatttacagaaataatctatcgaccaaaaaaattgcagaaatagccctgccgccctaatggtgggcggcaagctgacgtggcagacggtgggtcgaccgcgccgtctgccgccgtcggccaaaattgcgattaggcccttgccgcccgtacagagggcggcaaggggctaattgcaattttggccgcccataaagagcttgcggccgtacttttt

SEQ ID NO: 25097 - DNA, 7565 bp, Oryza sativa
cccagatgaaaaagtacggccaaaagatttttctatgttatgttaataataaataaagaagtatttattggtaaaacttgttaatattgttataaaaatgtattgagttgcgcaatttcatatgttaagtgaggtattattttgtaccttattcgacgtattagtactcggataatttatataggcctatcgcagtctgggtcgtagaaacattatatggacttaaacaaggagaattatgttacatgaagaattatgttaaatttgaacatgatacaactatttgcattgcggttacatagatgatattagattcgaactaggagggaggtagtgcaatagttgaacacaacgacgatgtagtaatgggacagggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaatgaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaatgaagaacctgacaacgatcaccacacctgcatcttggacgggcttcccatggagggagtgccgtagttagcacccgccagtcgctctgttgttcacgacattgtcgtttataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatacgcagataataaaatacctcacggtcatagttagggcacctaaaaaagcgccttcctcgaatatcaggattcctcgaagccattagttggcatcgatcaccgcataggcagagaggacgctgacaccaaggtggtagtaggtatacacaaggatcgctacgccagtttagatcctcaacacctcggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagatacatgcatgatcggcgccgacagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcggtgatgtcgaagaggaaggtggaaggcaacaagtggtccgacgaggtcccagcatggtccagtggtggaccctgactcgacgtgccgactgcctgtgacgaagtcccggtgtactgccagaactgcgctgagtgcgaggtcgacacagctgcctgagacgctgaccctacagcctgggagaagtgggcggcctgcgtcatagcgaactgggcgaaacctacacatcgacaacgggacccttgtaagctaagacataaaatgtatgtaaattgattgtcgaagtaatgttgtttttttaagtacctgtgggggcacaacataaggcctagctgaggaaggcggggtgctgaacggtgcacgaaaccctgaagcaatcggcaagtgaaacggctcacttatatgtgcgaggcatgtacagaaatagtaataaaaatacttacctccgtgcagagggggggtcggcctaggaacgtgcgcagctggacggggaccagttggtacgggtggccgctgtacagctgcgtctgcccgagcaacgtcgtctgcacgacaggtgagaactcggagaatcgagcgcatcgactccaccatccgcgtgtacgtcgtcaggtgctcctctacgggtaccggaatccccgcgcctaaacgttggatcgtcattgaaccatcaacgacgacccggttgatgtcgtcgacctgcatggttaatttgttcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgatggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccatgaccgccacagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtctggtgttgcggtggtgtgccaacggctcgagcgggaggtgcggtgcacgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctaggagggacctgtccaccgtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacattgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtactgtaaaacaaaagataacttgcaaaattatgaaatagtaataaaatcatgagattaattatgtacaacaagagtacaggctatttaaatatagcaaacgttactaatggtacataatgatgacgtgcaatttaacatatatgtagagttcaataatataacataacattacgtgtcgaagtctgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagctagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccacgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactacctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttcgttcatgcagaatccactgagaaaatttctgaatctccaatccagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaaaaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctatcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaagcttcgtaagttccaaatctcatctctattattttctgtttggccctccaggccttggcatagctaatagtatacttgtatgtctcttcaatgtgtcagattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgtgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcaccatcatccatgttcgtctgcacacctggatccttcgggtgaacaaacggaaccaaagctagaggccacccacattgcaatgcattttccaaataccatctccacactcgagagttttgaactggcattagttccaataaaaaccctcagttgcccgacttactataacattgattgttatgtcacttgtttgtgcatcaactctcaagcccctcattaaccatcttttatagaaggtacacctctttcagccggtctatcaattcccctttctgatacaataaaatctgacag

SEQ ID NO: 25098 - DNA, 6156 bp, Oryza sativa
  unsure (1)..(6156): unsure at all n locations
aattggcaaatagcagtgcagttgactggtcagagcatgtaggagtcagcagtcagcaccctgcttttccgcatcattcgagtaaatcaattaaatagctttgtcgagtgcaggctgcttctttacaatacttatgtaagattagcctagagctaatgttaaaaggtaatatttagtcatgaattggtaggctaaacattagcctagaatcgtatgtttggatctatgggcaaggctaaaaggtggagagagagtaaaaagagaggagagagaaggagagagagagctgtttttttatggtccccacacaaaattagccccattaacatatttggagagactaatgttttgaggggggctaattcatattagcccaaaattagcctacctgtttagattcttgtgggctaatttgaggctaaaaggtgagggctaaacattagcccatgaaatcaaacctggccttaattactcggccatcagctcttgtataattaaccgcataaacgtacgtactccgtagcatatatacaggccggtcgtactacattagtttagagtagctttgtaacgaggagcaaagagaaaaccggcaacacagcaggaagtaagaaatcaacagaaatagccgagggacaattgatcagtgatcaagggcgaatccagcctccaaaaatcattactgttggttgcccttaaattttacaagacgacacttaggcgtcattttagattctactccctccatttcatattataacttgctagtattgcttacatatatatgtgtgtgttttaatgaatttagacatatatatttagcttcattaacatatatatgaacgtgggtaatgctaaaaagtcttattataatatgaaacggaggaagtagaataaaatcattgtttgccaggttatctttctgaacgctgtatatacgatggtatccactactaaatcactactcccttcatatcaaaatattccaacctaagataagatataatataatctagcacaacgagaatctagataaaccaatgttagattcattgtacttgtactagattattacattccatcccatgttgttttgttttgggatggaaggaatagaccactgcaaatccgtttccatttacgttcgcaaaaaaaaaaatacgtttccatttctgaacaaatgaatcccgcggggactgtcctccactgaagaaaaggattggcaaatgggcaaggcaattgactggaccaacagtgcaagtggaacacatgctcggattcgtgcttttctgacccacccagcattacaagtggaacagcttagctccttccttgtcgtacgacgcaacagtccggttcggaggacgtgtcgagtcgtcgaccgccgaagcgaccaacctagctcgtcaacgagcatatgcaaatgcatcttcctttacaattctccaactaaattaaagaacgaagtgcacgtgccatatactcatgtcatgtcaatacgatctatttatgcatgctgaaaccagcgtcatagtaacgagaagcaatgcagagttcagaaatgggggtgttttccagcttaggcgtcgtagtgttgctgttactgttagtcgtcgccctggcgccggtgagaccagcgtcgggtcagccattgccgggctgccccgacaggtgcggcaacatcagcgttccctaccccttcggcatcggcgcccgctgcgcccgcgacttcggctacgagctcttctgcaaccacagctacttccctccgcgcctcaccttcttccctccactccccacgcctacatcgatcttggccgggcgccggctgaatctggccagcctgtccatcgccgacggcgaggccgtagctctcgtcaacgtgttccgccagtgctacagcagcaacgagagctacgtcagcgacaactcccgtaactacacggtgtacctgtccctccttggcagcaacacctaccgcgtatccgccgcgaggaaccgcttcgtcgcgctcggctgccccaacctcggctacctcagcgacgacgcgggctactacatcaccggctgcacgtccgtctgccgaccgtcgcagtggaactccgtgtcgccggcggcgtgcaccggcgttgggtgctgccagagcaggataccacccaatgtcacctactacgaggcgtccgttcaaggcttccaggaagcccaggggagaatttttcgcgagaacacgaatttttggcggtacgcgttcgtggtggaagacaagtgggtcgacaccacctaccgggacagcgccgacttcaaccggaccgacgactttgccgtccccgttgggcttgactgggccatccggaaagtcgccaactgcgacatcgccaagcgcaacaggacggactacgggtgcaggagcaccaacagcgattgcgtcgactccaccaatggtgtcggataccgttgaagtgctncaatggctacgacggcaacccctaccttgacggtggatgcacaggtatacaatactagacaccttaatacaatgcagatattggttatcaagttaacattgaggattgttcatttgctcgccattcttatattctctggcctcaaataaataacaatcattctgacaagaagtgatgagtttgtttttcctcttccaagatattgacgagtgccaacacttagacaagtacccatgccacggagtctgcacaaatctgctgggaggctataagtgtgattgccctcatggattcagcggagatgccataaaaaatgattgccgtccaaacgacaagttcacattagcactgaaaatagtcacaggtaattttgagacactaaggaggtgtttggttcatggccacaccacacttttgactgccacagtgtgttaggtatatgtttgtttcactgccacagttgtgacttgccacattttttcaataccatgtcctacatgtcatagacttaattttttttgccaactttaacacattttgtggctagcaatttgtccaccacacttttgtggctgctacaacttacctaatgttagttgtggcaaagtgtggccagcaaccaaacacaccctaatgcacctttctctctattgattctccgatttctgatgagtgacattgcaatgccatcttcaggggtcagcgttggtgtgttcttgtcggtgttcatgtgcttttggttgtacttggggctccagaagaggaagctcatcagaacaaagcaaagattcttcgagcagaacggtggagtgatcctccagcagcagatgcactctggtggaggcactggtgggttcaaaatattttccacggaagagctcaagaaggccaccaacaacttcgccgctgaccgtgttctcggccgcggcggtcacggtgttgtctacaagggtgtcctggaggacaacatggtggtggccatcaagaagtccaagatgatggaggaggctcaaaccaaggaatttgctagagaaatgtttattctctcccagatcaatcacaggaatgtcgtcaagctgctcggttgctgcctcgaggtagaagtgcccatgttagtctatgaatttgtctcaaacggcaccctctaccactacatccatggcaaggaacccacaactgacatagcacttgataaccgtcttcggatagccgcaaagtccgccgaggcgctcgcctacatgcattcatcagcttctccaccaatcctccatggagatgtcaagacggctaacatcctacttgatgacaagctcaacgccaaagttgcagattttggagcatccaaactagcaccaactgatgaggctgcaattgccacgttggtgcagggaacttgtgggtacttggaccctgagtacctaatgacatgccagttaaccgataagagcgatgtctacagttttggtgttgtcgtgctggagcttctaaccaggaagaaggcattgtacctagacgggccagaggaagacatgagcttggtgtcacgcttcaccacagcagtgaaggctggtcgtcatcgagagcttatggacagccaagtgaggaaagagatgaacgacgaaatggcaacagagattgcagacctcctcatgcgatgcctaagcatgaacggtgaagaacgaccaacgatgaaagaggtagcagagaggttggagatgttgaggagataccagcagcacccttgggctgaagctaaaggtaatgctgaggagaatcaaagcttgcttggcattgaacatcaaaatccaaattaccaattcaggcagcatgatgttcttgatctggaagaaggaagtacatatacatttagcttgtagataatgttgtttgcgttaatcttttataaatcaatgaattcacatacaaattcttttctatgtaatatgaaaacacatccatggggtgcaaccaaagaacgaccaagaaatttatgtgttctgtaatataaaagcaagaaattgcatagacgatagagaagaatggtatgtcactatgagtattgaaaggttcatgtccgttcttctcttaaaagaaaaggtgaaaacaacatgatgtatagacaactcatgatcattaaatagaaacatttaaataagaagataaggacttgccacaaaatcaaagatatatatactgtaaagcgagttacattggattgtcatggggaaatttctccccaaataccgccgtgtatgggtcaggaccatcacactcctagagttggtcgtccaatgaagggaggcgatcgtccctgacaggatttttttttcttctacacagagtaggtcatctctgcatgcctgatttgacaagaaccataccaaattagtagagttattcgtaattttgcgacgcgctcaccagaccagatggagtcggcggcggagtaggaacagcctgcggatggcgtagcggacagctccctcccagctcccagaggatggaaggaacggaggacttctggtagacaccatgtatggcggctgtggcggagacaatgacagtctgcgcctccgacgacgccggcggaggcacgggaggaagggttccagccgccggccgctgacctgcttgagacagagagagagagagagagagagagagagagagtgggtggggaggatgatacgtgaagggctgaaggccctcgagacacattgagccttgttggaaggccattagagaggagaaggcctagtattgggcccttttgtttaggctctttgcgatgagcgaactgggccgaaactgtacgagatggaataagtctactgtctggtggactagacaagctacctactcccttttcacttggtgtaatacacatcccggatcaataaatataaatataaatatagtagggtcatttttcacattgaagatctaaatctgaatagggggatgctttacaacggaatcccgttcgagcgggatgataccggttaggtatcaggacatgatacctattagatatcatgcgatttctaccacgtatcaaatgatacttgcaaggtattagacgattcctatcaggtatcatgtgattatacttacgaggtatcatgtgatacttggtattgacttattctcgttgataccagatcgataccgactgatatcaggtgattctactgggtatcaggagccaggcaccaaggcatcatcgtcggtggccgtgtcctccgcgtttgagcaagtcctttaccgtcactccccacgctggagctcggcggcggcggcctcacgtcccatgccggagatcgacatcctccgccatccatgttccacgccggagctcatcgccggcggccgcgtcctccgctgcctcgccctacgccgggctcgtcgctagcgcgaccacgacatcctccgccatccatgttccacgccggagctcatccccggtgcagccacgacatcctccgctatccatgttccactgttaacagtgaaatttggtaatcggcaaagacgtcatcggctgagaatcattatcngctgcagcatctcggaatcagccgataggaagtatcaagtcgccaatagtcggatttctgctatattcngtttaggaaataaattctactaaaggnnnnnnnnnnnnnnnnnnnnnnnnnnnnnnnnnnnnnnc

SEQ ID NO: 25099 - DNA, 851 bp, Oryza sativa
cccatccttatctctttttcttctccttccttatctccatcctctccatccttctccttccatcctctccccttgctcttctgtcaccccctctccttctcccctccccctcttcctcttgcagaggcagccgacggcggcgggatggaggccgggcgcaggctggcggcggccggccggcggcggcgggatgggggacggccggccggcggtggcgggatggcggcggccggccggcggcgtcgggatggcggccgggcgcgggccagcgggatggaggacgcccggcggtggcccggcgcaggccggcgggatggaggccggtcgccggcggcctcgccctcccctccttcagatccggccggaggggaagcggcgggatggaggacggccggcggcggcccggcgcgggccggcgggatggaggccggtcggcggcgggctcgcccttcccttccccagatccgggcggaggggaagcggcgagatgggtggccggccggtgagtcgattttttttttatttttttttaaccgccgtttggatgttttgatctgtgaatgaatctatgaatcgatattgtgaatgaatctgtgatgttgtgaatgagtatgtgactcgatgttgcaatgaacctgtgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatacataccactcgattcgggagaaaataaaaaagaaaaaaggaccagctaatggactgccgctaccctctctttagtcccg

SEQ ID NO: 25100 - DNA, 2312 bp, Oryza sativa
  unsure (1)..(2312): unsure at all n locations
nnnnnnnnnnnnnnnnnnnnnnnnnnnnnnnnnnnnnnnnnnnnnnnnnnnnnnnatactagagtttctaagatgtagtataaccaagagcccaacatgacatatctaattagaatccattgtatccatatataatctaggtaattatttgtctggtctaatccgtgcatggtataggacacatgcaaatagatgcaaccaatcttagacacatagctaggctactaggctctgccataacaagtaccctacataactagggtacgggactactagtagctattacagggatttggtatgcacaacaagctagtagtacctccggttttatttactagctaggctagtatcaaaagcaggacttaagcatgctgagtactagctagctgtcaggaacaaaactatacactgatacacacagcaaatgtgcgtgatgataatcctagcagcacgcgacatactcgggagaagccggcacgtggggccgcggcatggaggataagtggtataccgttcaacggtataccgttgtgtagtctttctctaaaatacggatggagtatgttcgagggaatttgacgatatttaaaatttatcatggtttatctcggtgatacgagagaaaaacatcaaacaaccgatgctaccgcctacggtcttgcgaataaaaaggtaaaataccgatggtgcacaaaatacatataactacgtaaaaagagaaaactagcataaatctgcaacattttatgacataattaatctggaacgtaaaaaacaagagaccgtaaaatatatattttatattaagatgtttcgtttacttagagcacaaagcagaatccgctgtgctcaagtatcaaaactggagtacttagtggactaaaaaccaaccaaagaattccgtctgccgttgaaagttgaaactaaactacgatttgggcgcgtgttagctgcacgactcgcggctttcgaaaccgaacggcacggcacggtcggagataacagaaacccacctggttatctgttaccgtgttctgaaatctgaactactacccaatgtttgagactagctcggtgaggttcgcaacatcaacctttttgacggctatcggctcgtgtcggctggatgcttcggcttgcgtcacccggtgggcgcgccgccagccgatcgaacgggaaggtgaggtgcaattccaacttctcctccgcctcccgtgggctgggctacctgttccatcgccatatacacagtccccaccgacacatgtccatggctttgctagtggtataatttcactttgattctctaaactggttgtcggatccggttcgtatccctaaactataacatcggatattttgactcctcctcaattattaaaatcagaacaatttgactccctcgactgttttgaagagacggttttgctgacgtgatagtgttgacctggtttcgtcctacgtgatattgacgtgatgcttatgtgatattagaattaaaaaaatatgtgaaacccgtttatcattaataaaagaaatattatgggattcacatgtcatcctctctttatccttcccttcttcctcatgtctctctctttctctcccctttctctaccccttcgtccgtctatgggaagagctaaagcggtggcaacagaagtgcaagggattccagggcggcaatggtaccgcagtcaggcgtagggacgaaggcggtggactacgaggtggagcagcgggatggtggtcgcgtggtgaagaggaaggaggccggcctcacgagagggagccatggaggagtgccggtcgcaacatcaagtgttgggtgagtgctagtgtcgatcgcaataccaccaccgccgagatccggctcttgcccaccatcgtcctataatattccttctgtgaatgacaaatgagtcctacattttaaaaaaaattaacaccacgtcggacgaagaccaggtcaacaccgccacgtagttaccacgttagcgaaaccgtccttcaaaacaattgcaggagttaaattgtgtcggttttaatagttaggggttgagatatccggtattgtgatttagagataagaatcagattcggctattagttaagagagtcaaagtgattttattcctttgctagttgctgatactacttgcgggctgcggcacatagacagatcacttaacaccaaccaggcaggccagtctccaagagtccaagcccatagccttaggccgaggccaggatgattctaatgggccttgtgccacacatgggcttcacagggcccgaattcacacattgcc

SEQ ID NO: 25101 - DNA, 1479 bp, Oryza sativa
aaaaaaattaacaccacgtcggacgaagacaaggtcaacaccgccacgtagttaccacgttagcgaaaccgtccttcaaaacaattgcaggagttaaattgtgtcggttttaatagttaggggttgagatatccggtattgtgatttagagataagaatcagattcggctattagttaagagagtcaaagtgattttattcctttgctagttgctgatactacttgcgggctgcggcacatagacagatcacttaacaccaaccaggcaggccagtctccaagagtccaagcccatagccttaggccgaggccaggatgattctaatgggccttgtgccacacatgggcttcacagggcccgaattcacacattgccttcttcttcctcttcttttaataatcgtattaattcacatacgtgctcagtcaaccggaacggggtcatttaacttaactgatgtgaattgagccattaacatgtggaccgtagtaaagtgagctcactggacagtaactcaactgcatgtgtagttatgggtgatctgtttcccagtcaacccatatgctcccccatgcactggcacataccccgtccagagattaatctgggcaaatgcttgttaagattcatgatcagatgttgaggttaagtccagaaatagtagaatactcatgcatgatccccacaaagaaaggagggagggagaagaacatgcatgtggtactagtcaactgtagatatatctgtaacggcatgaagctgcacatgagaagcagttatagttcgcactatttagagacctatagcttcggtggacatgccaacggcaacggtagaatcgggcactatcgatcggacagacgactctaactaatcctgtaccgtaatgagtgctactgaagattttagaatcatccactccaggcgagacatgcttgcagtttcagacatccaagcagagacaccatatgctcagctcaatgcggcgagcgttccaggtgatgatcatgatctacaaacaggcctcgcagcgacaatcatacagacccaggatgtgaacagaagataaaacagctcaaaagcaagcaggcttttctccttcaggccgggctaatcaatgcaatgcagcagcacggcgtctgcacacgcaatgcacaactctcgcgcagtcgcagaacgatctgaaatctgaatagagagcagaaacaacaacggagatcgatcgatcaatcgatcaccgatcaggtgaaggcgtgcataatttcagagattttgcaggagcaatccatctccaatatgttcggtcattcaccgacgctttcaaaggaagcgagtgatcgatgagctgctgctgctgctcaactgcaggggaagctggcagacaaggcagatggggaagtctcccaaccgcgagaactttatgtcgcccatgcttgttggcagctgatctctctgatgagcttgctctcacacccat

SEQ ID NO: 25102 - DNA, 10336 bp, Oryza sativa
gaatccatccatccatctgcaccttgatagtatttgctttggtcaactgaccaacaatgaacatactgaaacctttgtgatgccattgttaaaaagaattaacaaatagaagtaacaccttaagacatcgttaatgaactcatccaataggctaatataatatccattatgtccagaaagactatgtacatctaagcacaccaagaactctagtcgcatatcatgaaggccaaaaccaaaactctaaacaaaagagagagagagaaaaagaatattataggtaaatactagagacaataacgaatccaactgacatattaacgcatattgacggactagacagagaaaattgccaaactcttttttagttttttaacccatcggcggcgaggttaagatactggcatgctgctcaggaaactgttggtttcaccgccaccggcttggctgggtcagtgccgagcacggtggccgccgccggcacgccgctgacagccgaagcatactgggggaggacgctggtgtagtagatggcgtggccattgctgtcatacgccacctgcggcgcgtaggcctgagcattcgacgcggcggcgggggaagggccattgccgctcgcattggcattgccattgtgctgcgcgacggcgtagacggcggggaaggaggtggcgccggggccagcggcggtggtgaagtagccatgcggcggcgcggggatgaagaagacgggggcatggtcagcgccagagccaggggcaacagatgtataccttcccggcaccggtaggaaggccgtcggcggtggagcggatgatggaggcggagcagcgggcttctcctggtacttgggcaagtagtactccggcgtggccgttggcggcgttggggtgacggtggcgggagggtaggcgcgggtgagggagtcgtcgctgccatttctcggtagggccgccggcggcggcgcggcggtagcgggagcaggtggtggtggtggttgctgcgcggcggtgtcggcgaactgtagcttctcgagcccctggatctggcgctggaactcgccgggagagacaccggggagacaacgacgtggtcgcttacgggttggtggtgtggcggtcgtcgttcttggcggggatctcgacggggacgttgtccttcaccgtcggcgggtcacgggcggggtccttcaccttcaccgcgggcggcgggacgaagccgttgtcgaggccgaacaggtagtcggggcccgtcggcgctggcaacaccggcggcggctgcggcatcggcacaaccgctggtggtggcgactgcacggagaccgactcctgcttcggctgcggtggcgacggtggcggcggctgatggacggagttgagcgcgtcgacgaaccactggcgttgctcctgcttgggctcgaggaggccggacggctgcggcgggggcggtggcgtgggcgactggacggggaagaggaaaaccctgagcctgggcgtggaaccgccgcgggacgagccgccgccagatcccggcgcggggcggagcaggtggaggcggtcgtactcgaggacgaggtgctccagatcctcgtcgttggtgacggagacgagcgcgtcgaggtcctcgccggggagctggtacttgacgcagaagtcccccggagaacccgcgaggccggccaaccgcgcggcgaagtcggcgaagcggaggggcctctcgagcgacaggatcttcgtctcgccgttgacgtacgagagctggtggtcgtgcggccgcggctggatgcgccccccgtagctcaccatcaaccgcaccttcgccggcggcgccggtggcgggggcgccgcctgcgccgccgccgcctccgagccctcgtggtgcgcgtcgtcggtggccgcggcggagtgcggggacgagtcgccggagtcggccatggcggcggcggcggcgcgcgttagggttggggatgatatgatgggggagagcggggtgaggggagagggaggctgttataaggtaggtaggggtgggatgaacgggttttggtgcgattaagggtggtgattagcgatcttaattctgtgtttagtctctaaagaggggaggggattattgactgcggattttggcgggggtttggcatcgggagatgtgtggggacagttgggattgaggtgtctactgtggatatgtgtgcctgctgtggcgggcccggctttttccatttctttcttttttattatcctgcttcttttcgcgtgatctttttctcacctggagatacatgcacgataggatactttgcaaattctaatagtttggttttagtattactgattggattagcatccagcaatgttgaatcagaaatgtgacgccgttggacagatcgaaatgcacctggcgaattttttcgaattggaaaaaacggcagcatttaaattttctgttcgccgatgcctggtctattgtggaggggctttttttagctgctgtgcggagcgtcagggcgtgccgtgatggcgacaagcggacggaccgatcgaaggaagcattgggtgcgtctggttgcgctttacgacggcccaaactgcctcgccgtcgccggtgtcgccggtgccagcccgcacctgagaattcaccccattttacaagtttggaagaaggaaagcgggcgcaagtttcgatgcgtgggcgcgcacccacagtttccacttccaaccgacagggtgcactcgggcgcccgggtgtgtgcatgcgtcgcacgatcgcccaaggccccaaaggccaagaggggtggtgtgctggggccgacgtacgtccatgtgtcgcgggggtgctgccgctgacgacgcgcagtcgcaggcgcagggccatgtggatgtgtgggcgccgtcggagttaattttggcagcgtgttaggcagagaggccgcggcagccaccacaaaaccggtcgcttctcctggtcaaaacctccgcatctcaccgcagccgcacccacgggcgccaccacaccgctgcacctgcactgcccatgcgccccgcttcgcatacagaaacaactcgttccactgaaattctgacgcatggatcaataattttagtagaagtactgccctttcctggtgaaccggatttgtttccccaaaattatcctgccatgacaaatttgttcgacatcgatggtcacatttccacaggtactacttatggtgatgaatatgtgtacgttgtatttgaggttagatatttgccaggtagtatacgtgataggaggaagaaaaaaaaaacaaaatgataccaggagtacttatttgcactactattaaaatgaggatctgacattacggatacagccaaaccagccgtcaaacgagtgaccgcggaagatggcgagcacccgatgatccagctattgacctggccctcttttcggcgcgtcacagtttaacttagcatccctaaaaactgccacgatcacggatctagccagctgcttaatgacctgggagagtgattacactgagcagtgggtcccattaccaatagaggtccgtgggcccacgtctattttttctgtgcagatttccttcattctctttttcagcacacacgaaatcgattttatctatcacaatatcttttcttaccaaactcagcgcgtgtgatcttcttttctggctgctttgtttgaagagaagtgcacgattacagtgacgtcgttagtatcgatcccagatgaaagccggatactatattatcgccattagattagactatttgtttcacaacgcatgtggcaagccagttggtagttagcaggcatgttagccggatggattctggcaggaagttgtgtggatggagtatattagtagcactccttgcacaaaagatatactattagtagcaccaaattaacaatgctggttaatccatccgggcaatgtaataatgtacacctttgtgtttccaaccaactaatgcatgtgtgatcgagtagcagggcctgtgtttttttaagcatgcaaagaaggttaaagaaatcattagaaacctgacaatcaaggtgtctaatgggcaaccaagcaaagcaagcgagtgaatcctgcatcaccgttgcatagctggaaaggataactgatgatcctacatttttaataactgatagaaagtggcgtgccgtgggtgacggcggccatgattagctgtgcataattaccactttacaagattgctaatcagcgaaatcatgctgtttttttccttaaataaaactgcagaaaatttacgtgcgtacgtgcactttaaagcccaatcagttttttttttcggatttactcggctacagtttctgtccatgagaccaggggagaggcattgaccgagcgtcatctccttaatgggcccacgtggcagtcacagcgaaatatgggcccaccaggccggggagtggggagggtgacgcggcatgcatttgagctggtggcgtacgagcggcgcggcccacccaacacgttgctgcatcatctctccacacatatgcgttcacaggtgtagtaaagttgactcggtaaaattgactaagtaattcttactgtaacttttttttagaaaaaaaagataaatttaataactgttggttacttcgtgttagtgtagtattttcacgattgataatgatataagccgacaatattattaaggatttaagggcgtgtgaaaagaatagtggacggaatggccgaataggttctccgccaaagaggagatgctgctgatcgcaaagaagaggagtacacgtacgctttgcctcaatgagatttagagagcgatgtgcatataatgtgggtctcgattagggatggcaaccggggacccataacccacaacccgatgggtttttactctattaggagacaaatatgttccaaatattacacccatggatctcttatcgggctaaaacgtcacccatcggttgggccgggtcctggaacgttctccatccacccgaacccattaacccgtgggttaaaaatacccataggcctcagcccagaaaatacaagtagcccaatgcccaacaacaaatctaagcatctaagtctaagtgtctaaccctagaaataaaaacccatttcctctctctctcactgattcacttctcctccctccccggtactgtgctgctgtagggtggccgccgccacaaaccctacggcgcctctcgcccgcgccggggaacgcccacgccccccgcgccacccgcgctgtcgcacgcctgcgccgtacggccgcacgcccccaccgcgttagccgccgccgcacgccagcgccgcgctcgccgcacgcccgcacgccacccgcccaccaccgcgctcgctgccgtacgcccccaccacgcgccgcacacaatacaggcctgcgcagctgtgtgttctgcacgcagcatggcagcggtctccggctccggcaacgacgacggcaagtgatcttcttccctctttattaactgttgcagctatatctaatgggtatgggtacccgtcacccgtgcgggtgtgggtatgggtgaatttttcacctgtgagcgggtgtgggtattggagcgggcatatttcattttaatgggtgtgggtatggtgtcggtgaatccaatgggtacgcaccgttgccatcgctagtctcaaatctgtaaagaagattagagtaggaattaacgcgtatatgtatagtatcagcgttccaattagacagcaactcttaatatatttttaagcttcaaattctactaaacgcaacctatgtaggagtagcacatgcacctccagcttactttggttgcacacacatgcgaatcgccttcccgaagttaagttgagtgtgttattcaaaccagctgcaattatggtcagtctacgcagtctctagtctcacaggtcctctttctttaatatgaaacggatagaactgaattagagcaggtataatagcaggctgtaagccagctgcaaacatattttaaggagataatgagaaaatagaaggataatgggctacagatttgtagccagctgtagcacggactttaagacgtagtgtgcgtatgacaggtgggaccatttattaatagtatagtatgtaagtattgtatgaataaactattagattggctatagataaattgaagttagtagtgggctatactattgaacttgctcttagggtgtacgtgatttaaaagcaaacatctcgtcagactttcttgcctgcacacgatttagggattgtttagtttaagtcaaaattgaaagtttaattgaaattggaacgatgtgatgaaaaagttggaagtttatgtgtataaaaaagttctgatgtgatgtaaaagttagaagtttaaagaaaaaattaagaactaaaccaggcctcattccttctctctgtttgttttgttctggggctatgaagaaacagaagaaagtttcttgcggcgccacctcaacgaatatccttgttcgcccaaggcctggagttggactgaacaattctctggataacctcaacaagaccgattcgtttgtcatcatactacagtatcattaggatcagggttttcaatatctgaagatagcccttgacatgttcagctgattgcctgaaactgacaggtaattggtacttctagatgattttatttcagcttttgagccgggatatctacctggagaagattaccttaattaatttcttcaagtccgctaatgatatagtaggagtactatactagtatactggtactagatgatcaaaatggcaaccacctaaccgttaaaacataggagtagtaggaggagtagctacgtagcctgaaacctcggaagtgtagatggagacctcgcagctacacactactgaacaaacgaacggtccaaagccttttcacagagagcaacctccaaaccgggacaagcatctgctgccgtccatgcggcgccaagcaaagcccatcaccgtcgtgttggcaccatcccagccgtctgtccctctcagtctcacccatcatcatcatcatctcgcaagcgtcgtggacgcgaaagtgaagcttcatttgccgatgtactagcaaacttcagcctcagctacatcgtgggtacgctgcatctcctgctccatcggtcccaaaaacaagtatagttttacgcggttcatatctaacgtttaatcattcatcttattttaaaaatatttataattaatatttttatttttattaattgataaaatataaataatattttatgtgtgactatttttaaaattttttataaatttttaaataaaatggacgatcaaacgttaaatacggatactcatggctacatttattttacgacggaggttgtaccaattaacatgatctaaattgttcccatcaatcactatcacggccttaattaaaagagcaagttaattaaaccctctatttatggggctaccaaaaatatgatgatgggagcagatgcagagtactcggttaacttagctccgattgttaagctttaatcttcacatgcgtgcaagtaccagattgagctgttttgtgacttgtttagggtcgagagcctcgagtcccgagacacgtaggcaattaggcatgatgggtttaaccaagatacacatgggttagtgcaaatcaggattaaccaagtactctcacctgactagataaacatggaagctagtactacaagtcaccagccagagttaacaaacactgctctgggtcttgcgatccatgtgagctgaagtgtttgaagttccttccaaacgcattaacaaattctgccctgctttatcactgttataaccactcggcaatgtactgtaggagcagtagttagtggtacaggactatcggtaaactcgaattaggagtcgtggttgattgcattgacgagcgtaacacgagctggtgcagttggttggtacatctgcactcttcacccgtgtctgaatttctgctcgtctgctgtgctgtcgtcgtgctgcacagtctacaggaatagctagtggaccagtggagtaggaggatttacatttacaatctcgatatattgcctacgagaattgcgtgatgcatccacgaataggactagtttgctcgagatcgaggagggagacaaggaatgtgtgctattttactggacttcgtgtatcctgtttctttcaccctttgctgctactgcctactagtactagtagtagtactagtttgcttgtgccttgcaagttgcaacatgttgtacgtatgcagttactcgctcagtcccaacaaaaaaaaaaaaaaaaaaaaaaaaaacataggtttctgtgccaactatccgtcttatataaaatttttttataattagtattttcattgttgttagatgataaaatatgattaatactttatacgtgacttatcttttttaatttttttcatagttttttcaaataagacggacggtaaacgttggacacggatttccactgctgcacttattttgggatggaggtaggggctgtttggtttaatgcttcaacttgccacaccacactttagactgccacacctccttagccttgtgtttggttcattaccttaattatgccaagccacactttcttaccatcttacccacatgtcatagactcaatcttttgcctaactttaccacaaatgtggcttacaatttgtaggccacaaaaagtgtggcaagccacacttacctaacattgtctaaagtgagttatgacaatgttagttaagaaccaaacatgctggtagtacttcaagaatttatctggcaggcaacatatgctactggacgctgatatttggcaccggattcagcccatctaattttgagcccaaccagatcttatcatatctgtcaaagtttattcggcccaactatatatcattacgaggcccaccagtggcagtgctcccctccctattggaccggagtacaacaaagcccaattgaagagacggcccaatgaatgggctgcagaacaaggcccacgccgcaattgctccgtggaacatagggaaggaaagcctcgcaagcagcaggcgaagaatcgaattgcggcctgcggcaatttgtcatcaaaactcaaagacatatttcagctacttgtcaatttgtcatcgcatacaaagcatcgtcttcttgtcatcagcaacttgtttgcgtacgattatgagctatgctttggcctacttccatcagcaagtgtgcaatacgttgagctagcatccagtggtcactggttagttagcagtagttgtgtactgccagtatagtagtagctaacaggaaggcacattcagtgtgtcagtcgacgagtccatactaagtcataacctggttgtccgttagctgcaggccggacccgatgcgtggaccaaaagagtatcggaattcagacacgccacatgattttattgatcggtacacgctgcaagtatggctgggctggtccaagcccaaaattattaagagcaatgacccggtttcagttgcaggcagcaaatggaagagaatacttgtagtatccaggaaaatcttcctctcaaaaactttgaaatatattagggcattgtttagttccaaactttttctttaaactttcaactttttcatcacatcaaaactttactatacacataaacttccaacttttccatcacatcgttccaatttcaaccaaacttccaattttagcgtgaactcaacacaccctagtatttgctgcagaactgtagagaaggattattagagcatgtaactgatgatgagaatgctgaattattgatgcaccaactcttcatccgggactgattcaaagggatttagtcgatttttctccctcgattaaatggaagacactggtcttctactctgttatcatctgttcaggaaacaggactggagtagccacatttaccatctgtaattataaatttataatatgctcatttgacagaaatgacatatatatcatccaatgcaatggaacatgagcagagagtagtaatctagagtaaatgcccatctgtttgtacattatcttaccaaggatttttatcaaatcctacctgaacgaaagcaaagccgaaaagaaaaaccatactaaaatagaagagagatcagggaacaatcacctaaactgcaagctgagagaagcagcactgaagaacaggacacgacatggatctatctatcatcatctattggaatctggattcgggccactcggaacctcacgcttcctgt

SEQ ID NO: 25103 - DNA, 2244 bp, Oryza sativa
  unsure (1)..(2244): unsure at all n locations
nnnnnnnnnnnnnnnnnnnnnnnnnnnnnnnnnnnnnnnnnnnnnnnnnnnctactctgttatcatctgttcaggaaacaggactttagtagccacatttaccatctgtaattataaatttataatatgctcatttgacagaaatgacatatatatcatccaatgcaatggaacatgagcagagagtagtaatctagagtaaatgcccatctgtttgtacattatcttaccaaggatttttatcaaatcctacctgaacgaaagcaaagccgaaaagaaaaaccatactaaaatagaagagagatcagggaacaatacacctaaactgcaagctgagagaagcagcactgaagaacaggacacgacatggatctatctatcatcatctattggaatctggattcgggccactcggaacctcatgcttgctgtcgtcgatgccggccgagttccacctccgtggccggaacctcctcgtcctcgccgccggcagcagaaggcgccgtccaccggccgggaccgacgtcgccgccgctggcaacgacgacgacctcacctttgcttcttcttcttcttcccccggaggaggagccagcgacacgacgagcataacggcgcagagaaacgcacagaggccgagaagcggcagcgcagcagctggtcttcttccatctccaatccatcgagctcttgccatgcaagaatcagcttgcagtaaagccttcgatctccccgatctcacaagccaccactaaccaaaactcccatgggcatctgccagaagacgagacgagagcttagctgaaatatcgctctnnnnnnnnnnnnnnnnnnnnnnnnnnnnnnnnnnnnnnnnnctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcaggtgaaatgggagatgaccatgtgtatgcaaaggcacggagcaggggtggctgcttcttatctactgcccgtgaagagaagcagctgagagagctttgtgtgatccatcgtgtatctgacagcatcatcaccatacatcgatggctttgtagacgcctcagcaagacatgcccctagattgtactgctactgtagctatatccattgcatgcatacgcatgctaattacttgcagtatggagtacgtagtactatgactgtatgagcgtgaatcaacatctgcattgtactacgtactgcagatgtatgattgcactcgctaggtgtgtgagaaatttacaattgcttcgagtatttacttttgtcggtcgcgagctcgcaggaaaaagttgatcatggaggacggagcagcaaaaggacgcaaaggacgcgatggaaaagacgtaagacggcatcaactgagagctttgctcatcttggtaaggctgtaaagctccaatccaacaaaatatttgacgctcattgacagtgttgctgatctttcattaactaatccatctcccttttaattctcatcttatttgtatatctgtcaagaacaaaatgatgggggtgctacgatgttagctctgccattcaacgtttccacaggctaagctagcaagcatgataaaaaggagaagattgtgaaagcctgaaaggagtagtagcatgcatgcatgcagtgcagccaggccaagccaaacaagaatgcttttccatggactgacgacaaacacaagctgcatctacacaaattcatgtccaaccctgtagcagacaggcaatgttctgcagttgtctcgtcacctcctctgtagggactcgctacagtcaccacacggaccttgcacatgaactcaggcaaatatatcatcacatgaactgtaaaagattgatctactagatggacaaacacaaacacttcactgttcgccatgtagatgctgccggatcgatcgagaatttgatttgccgtttttctcttcgagaggggacgagtggggcgcgcatgctggatgaaaaggttacacgaacttcaaagcgggcatggttaattatcatgggctctagagagggcaagagctgactgaaactggactaatctccacctatcgtctaatcacaactcattctgtcgccggccatgaatgcctcgtgattcgggatatatgca

SEQ ID NO: 25104 - DNA, 4679 bp, Oryza sativa
  unsure (1)..(4679): unsure at all n locations
nnnnnnnnnnnnnnnnnnnnnnnnnnnnnnnnnnnnnnnnnnnnnnnnnnnnnnnnnnnncggctccgcgaccccgtcgccgccgacatcctcatgtccgccggcgccgactggtcgctccagaacgccgacgggtggtccgcgctccaggaggccgtctgcacgcgggaggacgccatcgccaccatcatcgcgcgccactaccagcccctcgcctgggccaagtggtgccgcagcctcccgcgcgtcctcgcctccatcaaccgcatccgagacttctacatggagatctccttccacttcgagtcctccgtcatacccttcatcggccgcatcgccccctccgacacttaccgcatttggaagcgtggagctgcgctgcgtgccgacatgacgcttgccggcttcgacggcttccgcatccagcgttcggaccagaccttcttgtttctcggggatggtgctcgtcctgaggatgctgggggcaaagagttgcacccaggttctctcatagtgctggctcataaggacaaggagatcacagatgcattggagggagcaggggtgcaaccaacggaggccgaggtcgcacatgaggtggcgttgatgtcaaagacgaacatgtatcgtcccgggatcgacgtgacgcaggcagagcttgtgcctcatttgaattggcgccggcaggagaggacggaagccgttggacattggaaagctaaggtttatgatatgttaaacgttctggtgactgtgaagtcaaggcgtgtgccgggggcgatgacagatgaggagctgtttgcgatggagggggaggagaagaatgggaggggcactgaacttgacgcggagctggatgaagtgttgacagccgaagagaggaaacagcttgattctgcgttgagaatggggaaccaggaagaagaatttgaggagaggtgcgaggaaggtgatggcggggctgatcatttggatgcaaatggcgtggcaaaagataagaagggatggtttggttggggtggcaagaaaggcaccaagaatgacgagaaaccatccaaggcgaatcaagggagtaaggatgaatcaggtgacctaggaaagggaaaggagaagaacagcagcaagaagaagaagggtgcatcatcaggggattctactaaacatgaaagtgaatacaagaaggggttaagaccagtgttgtggctgacaccagatttccctttgaagacggatgaactgatccctctgcttgatgtcttagcaaacaaagtgaaagctgtcagaaggcttagggaactcttgactactaaactgcctccaggcacatttccggtgaaggtaaccacctgccaacttgactatataatgtccacctatttcagcaattaactgaatttttgatatgccattcattttagtcaaaatttgcacgcttattcatttgcaacataaatggtgatatgattctatgtaactcaatcaacgactgtttgctgattgtatgagcaattattttgcactggtttctttgactgccagtgtttgttgtttgatccacctgctgtgtcatgcgtcgtaattcactccctagctgggacttgtgctgtctgccttgctgcttgtgcatagtactgtttgaacctggttatgacatgtgcttgaatatgaaattatgaatatgtgtttctttattgttggcgctgatgcgcggcttatggctatgcatgtggtttttttccctttagaccggacatattaatacaagatagttctgttcaagttctagaactagcacatcttatgtgtgtcctcccgggtaatcaatccctcgcactaacaaggcattatcataagatgtggtgcccgccatgtgcacaattcatatgattgatggatgttcgaataaccaaaccttttctattagttaccactactattggccacccatatggaataattagattccaataatagatattatatttgggtgtaaatgataaatgtgcagtgtacttgcaaaatatcattgactatttctaaggatttgatgcatgatggttgatgacattttttttccttgttgtattaaactttatatggacatggaacactatcgagttattgaatctagtacaaatatattgtatatttctatttgtctgtttgccatttcttttatgtggtgttaattaactttaaaagtagccagtgggtttctgctcccaccatcaatttaataatctcacagatttaagaaatgccaaaaaaatatatccattgaagctttcaaaactttcatatgtttatttcctattcatccactctatctcttcctctgtttgagtcttgattagctgggtcctactccaaaccaccataaaactgatgcccccctgtaccctactgaccttgtatccctaaatgcagttgatgatccatcgacatcttgtgaccactcttcctgtcaaatgttatttcatgtgtcatcttttctttggtgaatgctgcagtaatttttccattgcattattagactatttttaccgctttccatgttttgttgccatgctttattgtttctaaattggtacagatgtcttgtctcaatgtgcatagcaatctgaatcgtttcattttgttgtaacttttttggaatctcatcatttgttttgaatcttagttcttgttggataaggcattgtggtgccagtacaagacgtttgcactgcatcataattattatttcacatagtctcaaatttgaaatcagatctcttcttttaccaaaattaacatcactacagttacttcgaaaatgagattcacatgaattaatctatattttggaaaagatgatatctaactctctgtaacattgattttcagattgcgatacctattgttccaacaatacgagtcatcgtgacattcacaaagtttgaggaattacaacctttggatgagtttgctaccccaccctcaagcccaacgcaattccaggatgccaagggcaaagaatcagaaggatcaggctcatggtattcgtgggttagaggggggcgtggtgcacagtccagtgatagtggtgatagccgtaactggaaagatgaggttgatccattccaaataccttctgactacacctgggttgatgccaacgagaagaaacggaggatgaaggcaaagaaagccaagaacaggcggggctcaactcggaaacaatcatcgaaaagcacctcgtcggaaggaggtcacccgatgatggatggctttgaggagtaaaaaagtttcgccacatagcaggtcacctttcattcagagatgttagatgttgatgtcagctgtgctgcgcacctgacagcatagattgataatgtgctctggagaacgcgtagttgattggatctcctcgaggaagtacaggatggctatataccccgctaatctgtaattcaattctattttttgcccccttattttcttcttccagctggatgtatgtttgatgatcatgatgatacggccctgttgttgttaaagatgtgttttgtggggggctttttagctgtagcacttcccctcctgttgtacgaaaaccctcgaatctggcagtgattttctcgcaaagaggaagctcaatgcacatgcttgcttatgactgctgctgtccctcttctcttcgctttgtttccaaggaaactggacatcttatgcttgccagagacgttatcttgctttctgttggtacttaattagtacagctgctataacttgctgtagcttattgtgtttcaaagcagagtaattgtggtgctctcattgaggctaagcagatcatttacagtctgctgttgagagcgaaaccctgcgatgcagaaatgtacaaaactcatagttgatggattgaaaggatgttatatgattgtgaaagatcatgcagcttactgtcgatcagatgtcatcatttggtagcagtctctctcttcaaatgaggttattatggccacacacagtttgggattttgccggttggtaagctacgctatcagcttgagggcttgtttagagcgaatagttaaggggaaaacaaggttgaatgccagaattagaggtccaaccagctggattacgctgaaagagacgctacaatccttaccattagaccctgttttttttttcaacttcaaacttcctcattttctattagcatgtttttcaatatgttaaaatatacattcttaaacaattcctatatataaaagttattttaaaaactgaaaataactctattattcaagtttataataatctgtattaggtgcacttatattagtatattctactaggatatcctgtattatgtgcacttatattgggacgaagagaatattaataattaattaattatatgcttatgagatttactgttttgcgtgtgcttaaaattctccttcaatgggaggcaaacgaacgggcccttagaagctcatcacttgggccgagtcacgggccttagcccaacaagagaacagaactggtcggtcactgacaaagcgggccccacctaatgcggccccagcgcttttcggtgtacccatgccgcctgggcccacagccacagggcctcgcgctcgaaacatttcgaaatttgaaacgcttctcccggtcgtaaaattccc

SEQ ID NO: 25105 - DNA, 27062 bp, Oryza sativa
  unsure (1)..(27062): unsure at all n locations
nnnnnnnnnnnnnnnnnnnnnnnnnnnnnnnnnnnnnnnnnnnnnnnnnnnnnnnnnnctaaggcaaaatgaatgcggttgataggaaaagagagagcttcgatgtaaaggcgaagcagatcagtgggaaaagagggagcttcgatgttaatgtgaccaagcaatgtgatgagatcaaaggggaaagagagggctttggcaccaacgcaaagaagcaatgcgatgggattgatggcgacaatgagggctttgatgtgaaggccaggctaggtgacgaaatcaataagaagaaagatggatttgatacgaaattggtgaaagagattcatcccaagaaagttatctctagtgtcactggttcggcagaagcttcttccaaacctgcaccttttcctgctactgagaaggatggtgacggaggcaacaatgctgtcatccctgtattcactgtccatgtggtggacgtggacgatgttccttgcagagccagggaagagcagaagaatactgatgagcctaagaagcaggaggaaaagagcaagctggcagacaagattagagtttttgagaaagcgtctgcaagtgggggatcagtgaaatctgtttctagtttgaacaagtacccaagcaagctgcatgagaaactagctgcattggaagggagagtccaaaagatagcgacagatatcaagaagaccaaagagatgctggatgagaataacccggatgagcctaagcagatattatctaatatccagaaggagattactgcaattgagaaggcaatttcccatgtcaaggatgataataagattcagctcggcactgcagataatagtgagtgtgagatctcttatgctaaaaaggctgcagagtgtgctgttacaaagccaagtgacccgaagcatgctgcaaaaggtatgaatactgatgaattagaggcgaggttctttccacatcataaattgttgagagactgcaaatcgtctagcgctactcaacaggaatcgtccatggctgtcaaaaaggattgtaacacagatatggaactttcttcccttgagcctcaagaagatgagaatagtatagccatggagtttctggcttccttagatggtgaagaaagcggcttcttcaagaaccgcagagcgaagaacttggaaaaaaccatcatctgtgaagcagcagatgttagcagcaagacatcgggccaaggttcctcaaataatccggtaggcccaaaccatgacaaagaaattgaattgcttgctacagagaagctagaagagtttgatgaacaggagaacaagtcctttttgattttacaggaggaaacagaggaattctctagtgatcagttattagggatagggaacaaatcctcaactggtggatggtttgtttcagagggggaagctgttcttcttgctcatggagatggtacctgttcttactatgatattgcaaaccgcgaggtacttgattcattactatgttttctttttgttcttttcataatttatgttaatacaacattttgaagttctgattgcattaaactgaaaatgacagttcaagtctgaatacaagcctccgagtgtgatctcaaataatatgtggggtgattgctggttgatccgtgccccgggtgttgacggatgctcaggaagatatgtagttgcggcatcagctggcaatgcactggaccctgggttttgcagctgggattactatagcagagaagcaaaagcatttcacattgaggagatatctcatgcttcttcagtaccatcgtccagaactgttcttgggcctcttcctaatgtaggttcatcaagatctagctctgcaatttctactgtagaaagacagcaatggtggtatagaccctgtgggcctctcctgctttctgctgctagtaagcaaaagatggtcacagcttatgacatccgagatggtgatgtagtgatgaaatgggaagtgagcaatcctgtacagggaatggaatattccagcccactacaatggcgtagcaggggcaaggttgtaattgctggtactgagtcgattgggttgtgggatgttaattcgcttaacccacaacccctgttatctgttgcttctgctggcaaaaagctttactgccttcatgtgaacaacactgatgcagagctgggcggaggagttcgtcaaaggtacgcctggaattattagcttgaatgccctttgtgtaccattggtaacactatactagatcctgtctggttgaacttggcttatgcttgcaaatgcaggattttttagttcatttaccaatagctgatttttttttgtcttgatcattgatgattctgaaacttggaaatgtaactaatctaaaggagatgtaagttctgttttgtgtgagctgacatgttttcaaagttaacttgtttatcgttctgttttgcagagttagttcctgtgaggtggagggaaatgatggtgtttttagcacacaagaaagtgttaatgtatttgactttcgtgtacctgctggcatcggtcttaaaatggcaagacatggtggtacagcaagttcaatcttctcacgtggtgactcggtattcattgggagcacagaaggtaggctgcaaataaaagggggtctgaaatcacgagttcagcaatattcactgagaaagggaaagcttgttgcaacctatgagctacctgatttcaatgcccacttccatcactcttcaataacccaagtatggggcaactccaaccttgtcttggctgcatgtggtatgggactatttgcatttgacgcctttaaggaggacggtcaacaaacttacagctttgaccgtggagccactcttggagtaagagaggctattggctttgatgatttgtactgccctacattcgattactcgtcatcaagggttcttcttgtctcaagagaccgtccagcacaatggaggtatctgtcatagctatctatttatcgtgtgcatcatgtgatcgacatgtaatatatttgtactatgtttatgctttagcttatttagtcatctgtagtgccaagcatcttgctttcactgtattagcagaaatgattgggtttcttccccttcagttaattaatatctattgcatgtttattttaccccattgtgttcttatttccttctctaacattgacatcttacttattttgtttatcggcaaattatttgaattcagtttgatgcaatggtgcatatgaattcatggaatattttttttggagggtgggcatccatctccagatacatacataacacaaccataaacaaaattaagatcttgttagcgaaatgacgcccaacaatcttcatcggaccaagaagggattattccttcttttttgacgaactgcctcgattagctgctctgatttaagcttattccatcctaatcagcaacatcatggtcttgtgcaccaatggtctctgcaaactttattaccacttatgtaccaaatctagcggcaagcagcatctccattcctggaactctgatccttactggccttgatgttggcagcatgccggcatgtcctactgcttaatcaatcagtttcaagttcacggaatggtaatgggacagtcttcactgctctgaacttgccaacgttgttcaaatgttcattctccaatctgcaatcccataaaccatttcaccatgttacaccataacattaaattaaaattgatgttccttgtaaaagtacttccaattacctatagaagttccaatggcctcgtctgattatctctagtgaagcgagcgagaaatccagtaagcgcgactcaaccttaccaatatggatcttcattacactctcagtccatgctaggcgaagtgcaagattgagcatctgtaattatttgaaggcattagtgtcctagatctggaattttctagcctagtcagaaatgaagtatattaagcatagtaccatggatacgtagtagattgatttattcttcaagatgagctcgttacgaagccatcggttctttgattttgggtttaagaagccccagtccttgacaaagtcccagtagagctggtaaattgtggcacctgaggatgaaatgatgaccatccacacccagaatggtgttggtgttgcagcatatttgaacctaacagcagctgctaccattgctgatacatattttccagcattagcaagttggttgatatcatgtccttcctccaagtaccttcttaaacacttcaaaacatgacacagctattagtttgaaactgatccaaacaaagttgttaatcgttagtatttcccatctaaagattcatacctgcaaggctctccagaagtatgggagaaaggagatcacataggccagatgcttatattgttggccactagtacaggtctcatatgggtgagttctaaagcttccagccatgaagtagcacgctgtaaattccatgtgccgtaatagtggaatctgcagatagtagcaccagttcactcataagatgctgagctccaactctcaaaagctctagtgtaaagttcagtttcttcagtattacctggctagttagttggtcagccatgaagaaatcagccatcagaacctgcatgtcaaagcagcctgcttatcagatagatgctttcaacaatttgtgataagaaaactcatgaggtctttagtctttaccttatagaatggtgaaaatatgatattgcgcatgacacgcatgaagcagtatcgcgtcgagcggtagaatatgtcaaatggacagaatagtacacctgttgacagctgaaacaacagaatccgagttgagaactgaaaatcagtacatgaaacagagctgaattaccaaattttcccaaagtttatgtttcttactagtaggagtgctccaggcaaagcattggcataggctacaccggcgttcttgaggaaaagattgatgaccagtgcagcgacaacagtgcacattatcgatgcagacatgaggaaggcgtcccggtgcgtcaaggcggtgtttgaggagaaatcgaatatgaagttgtgattgatccttgtgttcttccacatgaagaggttgcacccatacaggaagatgtggaggctgatgagagcaaacatgctgcagaagcaaggtcacatctatacattactttgaggtaaaattgcatcttttattatcatgaggtcctaagtctgaaatttgaaaaatttgcaaacattgagcccacatgctaaatctaatcaattgaactcttgtcaagaacagagcatatatagcctgaacagaagtaccaagtacaaacgcagtaataaaaaatctatttctaaatagtgctttacccctagaactgaaccgtaattctcaagaatttacctgaaaacatggtacacaatttccatgtaggctgagttcccagtggaagtaaaaataccactaacatgggctaaaatcgcgtatatgatgaacagtgaaacaaaagtgcccgtgaacaaacctgcaaattagaacatgaaaaaaaagaagaagtgaagttagatttgtgtgccaaatgcagatgacagatctgatattctgatcttgaagttgctcagctacatgcctacgaggaaggtgatcatgtgagtgtttctgggctgctgtggcttaaggtatttcatcgccaccttcctgtcattgcctgtgaaatgcttcatgaagatgcactcgacctcatctgctagctgaagtacctgttcagaatttcgcatgcttcagttcatattcgtcagagagacatgtttccatcccccaaaaaactgattgaagtgaatttgtatgtttgtgcagctttgcagtaggattgtggagcaccagatgataccttgtcggagctgctaaatggcgacctcttcaccttctctgaaaacaggtctgtagctcgctgttgctcggacacctgaaatgcaaagcagttcgtaccagtcactgtcagctcggagtagcatttttttaaaaaaatatattaaaaaattaaattattccttgcaagaaaatgtttatgctgtctcatgttattaggctgactagtgactaggattacactgtcgagaatgagatctagtacctctgctttgagggtactaaactactaatagtacacttagaactttattctcctagaagccttatatatgtagaccggttttctttaatctttatcatctattatttagactcttcattcttccatccatccatttcaaaagggcacagatgtggctaattagtatattaccttgacaaatttcttcaatattttggtgaaagcctttacattgagagagctgctcccatccatccatgcatgcaaccaaaaaagcatccaaatccgtcagaaccacaagaacaccataattgacaagtaaaagaaatataaagacagccacctaaaataaccggtgaattaatctaccttttcaaaaaccacaaaagaattagtaatttgaaaggagaaacagtcgctttcaggtgacacaggatggtgtatggatggctacgtgatttacacggatgcttccatgcaaaacggggttgaaatttgactaaactactactgtactgcatgcttgggtgcagtgcaggtgtagttgtgtgctgctcacacagtgctccatgactcatgctgcaactaatattcatagtagtaatttgttagatatacatctatgaagaaacaacttaatttttttttcctagttggtcagttaaccaaactatctatatcatttgtgtgcatgcaattagtgtgatcgatcagttgcatgctattagtgtgaggtttggccatcagaattctaaatagcttacaaatgcgtatatatatgcatcatgcatggcatagaagacaatatacatagacacaaaaggcaagtcttgttctaaaataccgtgacttcgtggttttagcttgtcagatatggcaaaaaggaaagatgaagagggaagatgtgcctgaatttcttgagcagctcgaggccgcggtagagcgccatgaaggcgtcgcggatgttcttctcggcgtgctggatcttcttccggtggacgaacgccgcggcggggtcggcgccgtccttgcggagcacgttcacgagctcctcccacaccttgagcgccgcccgcccggggctcgtcgccgggatgtcgatcctcaccgtcgctggcagctgcagcacgcctccgcctccgccgccgccgccgccccgccctttgccgctgccgtccttggtcttgccgtccttcttcccggcgagccccacgaagctgacgccgttccgctccagcgccgccatcacctcgtccgccaccgccgcgccctccgacacctgcgcctgctgcaactccaggctcccatctgcaaaacacgccatcgacgacgacgacggcgacatcgacatgacatgacattgcatgcataaagagatgtgcagctagcccaggattcatgtgtgtgggtggttggtgtcacctacctgacatggactgcggcgaggagaggccggagaggaggtagcggccgctggagccgtgcaccgacgacggcggcgaggaggacggcggcggcggcggcatagagcggcttcgggcgaggccgcgggcgcggcgggcggcggcgtggtcggcgaggatgcgcttgacgtcggcgaggatccggagctgctccagcagcgcgtcgccgcgcgccagcagctccgcctcctgccccgtgtagaacgcgttcaccttctccagctcctcgtccgccctctccatgaactccctctcctacaccatccatccatgcatctccatttttacaatcaatttaattacttagttttatttacaatcaaattaactaattaattttatacatgcttgtccgtggatcgcacgagctcccctctgtccgggcactcctcatcctcctgcgaaatgcacatacgtattaacatcagaaatgtgtattaattaattaatacacgtttattagttagtatttgattcgagacacaacgacgacgtactgaggcagaaggctgttgtccagcggagaagcgggcggcgatggcgcgaacggggtcaagaatggagaacccatagccaccggcttccttctctgcgggcggcggcgggagaaggtggtcggctgcggctgcggcgttggcggcggcgaaggagtcgtcgcggcgggtgaccttgatcctcttgatgagcttcttgagccgcttgtagtcgacgaacgcagccttccactccggtatgatgctcgcctcgtactccctcgagaacttcaccatcttcttcttcttcttcttcctcgttgcagcagcagcagcagcagctgatcgatcgatcgatcgaacaattaactgaaacgtacgtacgttcacatgtgtggaatcgagctaggagaagatcaagatggatggatggatgcaggaaagggacaggcaggcagggatgatctcgcaagcaacaaccgtcctgccttgttagcttatatagatagacagttagagagagagagagagatcaggctactagcttggtgctcttctccttcttcttcaatcctctctctctgctcacctcgagtgctcctgctatataagcttagcttagctaagcatgcagcgaaatttggcactgctggtgcacatacagggacagatagtggccttgtatgttacaatattaggtagagctagctagcttagctaaattaaagtagaaaggtgtatctgaattcagagatatatatatacacttacatagtggggatcgaccatgccattcgtagaactgtttgtgtcctgttcattcagttagtggcttagttagttgcttaattcgatcagtgggatcatatatagttatattattatatactagttatgtacacgtaattaagcctcgtcgcatgatctggttggatgctaattctgtattaagggagaaattgattaagtaattacttctaattagagtaaggcagtgtatacatatttgtagcgcagagaattaaagaggagaaggaaagaaattaaagaaagaaaggaaagaaagccggttgctttaggccgggttgttaatttgagcggcccatcttttgggcgaaaaggcaggggcaatggagtgagggaaacatgagcagctgcaggaatcaagcagagacagacccttgcttaacctactcggccactcacactcaggtgaccatgcatgcagctgctaattagctagttgcctcctctaaaaaaagacaataactaatcaagtaattggctagttgacatgcactataattttcttattagtatcactaatcagctcatgtgttaattaattatttagttaattaaagaagagggcagtgtccaggggagtaggactaattaaggtcgtaaacttttaagtatgtatgtggatttctatgtctaaagtttgatcgttcgttttgttttaaactttttgattagtatttttgttgctattagatgataaaacatgaataatattttatgcgcgacttttttttattttttttataaattcgttaaataagatgtgcggtcaaacgacaaacacggaaacccgctaatgtatttaaaataggatggatgattatataattaattaattaattaattctgattagagtgttttgtgcggtgcagcatggagtgactgtagatatgctatagctttacacatatcgtggttcgattggatcgcggaaattaatggatggatggatggatcgatcgcaagttggagacaatggagctaagcttagctagggttctgctagtacagggaccagatcagccggatgctctccatgtatgcgcaatggaggccacgccaccgccgctgctgcagcgacgccggcctgacgtggccatgacgccgactcctactcctttttcttttctttctttttagtgtttttctttttttttaaaaaaaaggtatatttctctaggcgcagtgacgaaaactgggtagggcagttagggctgttgccctaagcttaaatatctattaaaagttacatttaaaaacttcaaaacacgaaaaataaaggtaaattatgtaaattatactagttgtgctttaggcgtgagaaaattctaactacaccactgctctaaggtatctatctacaattgtagtggagtacatggtatttgtgtgtgtgtgtgtgtttttaaaaaaaaagataaatatgaactgatcggttacacagtaagcatgcatgcacatgagctgagttggtcggatagtggcgcagccgtgcaacggaaaagtgtagctaaggtcgacagtactaacaagtcgcatacctcatcctaaaagaaaaaagaaaaaatatgttcactgtatacggttggctctggtatgatcgatcgacggcgtcgacgcgaccatcattaaatgaactagccgcccaacatcgatcgcttaatgaaactgaatcgaatttgccgtgcacactttttttttcctgagcttctagataacgtgatttttataagaactttctatatttgaatttaattttttaattgctgtttcaaatatattctttaactagaaaaaatgcccatgcgattgcaatgggtgaatgatattttaatcttattattgttatatgtttagctaggatgaaattcactgtgtgcaattaggagtccgactttcatttcaagttggcatgcgagtttttttaagaaatttcttatacaactccttttgtatttccaaaagcaaataaacttaaaaaccgactcaaatacggatgacgtaccaaaataccggcaaaaatattttcaatttttataatagtagggactagttaatatttactcactccttttctgattataagtcgttttgattttttttctagtgtaaatttataggaaaaaaattagcaatatctaaaataccaaattagtttcattaaatctagcgatgaatatattttgataatatgcttattttacgttgaaaatgctataactttttttataaacttgatcaaacataaataaatttgattaggaaaaaaattaaaatgacttctaatatataaaattaaagagagaaagtaatttatttgcttctacccttaaataactatcacaaatcactagctattcagtccttcaacacaaaacaacatgtcataaatggaagaaaatattaggtcagccagtttatttctcgtattataagtgcgcgcatacgtacgtattacctggcattaattaactagttcgcttacgtacgtacataacatatctacgcgtgtgtgtacatacacatccatctcccctgcgcggatgcgggggcgcgaaaaattttgtctccacgacgtgtatttcgcgccttttttccgcaaccggaaaaaaaaattgaaacggtgaggcgttattttgcctccatgtccgttacgcactgcagtgtaagtggtcgcagctgccgttgcgtcgcacgtcatggggtccaagcagaagtgcagaacagaagaaagagatcgaagaaaaaatgggtaagtacacccgcgttgcgtacacgtccatgacacctcggatatggtgcttgctgcctccctcgccacaaacaataggaaacccggccgacctcgtttggtataggtccagctaaattttgttatattcatactctaaactagctgaagtcttatatttttgaaaaaaaaatatagtagtcatagtcttgtcaaacaccatagagcttatgatgttaggtaggtttaatgtgccaatatttgtgtgtctgggtctagcgcaaacatgttcagtcaatgtcgtgtctatcatgaaatgttgtctttaaaaatttatacaaagaaactttatatttagagactattaatatagaaacatttagaaaaaaaatatatggttttgaattagaattagaatcagacatataaaatttttatggcctacaaacttaccagaaaatgaaaaaaaatatgatgctaaaaaagaaaatcatgcgtgattcgcacgatatctttttttgtaagatgttctcttcaagaaatctcgttcttgaaaaattgcattatgctgtaaattattgtttttttcctagcatttgttctagcagtttattttattaatggatcaaaagccggcttctacaccaacaagtgtgtacacagccaactagcggttcatattcatagtggtttttccagtggtcaccatatgggcagaacaaatacatcgacgttgtaaagtttcttggagcgatatgtttgtgcatgccaggatgataggaatccatatgattattcagcaacaaacaggcgtcagctcatctaaagaaaacaagtgtcagctcatgggaagcacatatatctctctttttgggggtcccttgcatgcaagggtcaaaatctggtgccgtgactaactggcccaactgtgcaatgcacacagcataattctggttctctgcaggaatcttcttgttggtttcaggaggaaaccaagtcactaagcacaaaccagaaagcctcaagagaagggtttgtagagatagcttaattaaatgttaacaaatctcaccaagggtgcaaggcactggctagcacctacttttcagggcttaatgctccttaacaagaatgcaaaacatgataataaaggcctttttttttccttcatccttccttccttcctttgctggctgttgttgccatttcatgagtgtccacttcacaacaaatgtgacctaaaaatgagagagagagataaccctttcttctttttttctcccaagccagaatggaaagatcattcgcaacactagctgcatgatttattcttctaaaccatcctcctattggctcatgcttccaaaaataagaaaaagtcagtttaattaaaagcttcatccagccatctaattggtcctttctgtttaggacatgtttaggatgctggttggctaattgacttgtttaatattcactaatctctagctatgcccatagttaacttattgcagtatgattctagttttaacccgtgcacgcatcgtttgtttgcagaatgatatagtgcgtaagttcagatagcactaagaaacctgtggctaatcgggcatctctctctcaattgcactttagtttattaattttggtatcttggataggaatagaacatacaaagttatagttaaattttgcttcgcataatgcacaactgattggactgaaatggctgcatacttctgagtaatggagctaagctaattgtgcacaatgactgtactttataagtaacagagcagaattagctaaaggaatcacaacaaaaatgtgcaaaatatgaaagatttgagggtgacaagtgtcaagtgcagcaatttgtcagtgagaaattaaaccagcgttgctttctgaattacatgatgttctagtgttctagtgtgtccggattgattttactaattaattactagttagcacgtaattaatgagtttgtaatcttcacgtatgtatatgaacttttacgtgcgcaaagatattccaccaaggaatgtgcatcttttcaggagttgatccggataaacgtgctgtgatctgggagagtcttgtacgtttctgacagatgatcagagatgtgtgacaaagatcgatcaatgctcaatgggatccacgatgcaaaccatatgatgatatcaaagccatcttttggttgattaattaagctttcatttcatcgaattaatgtttttcacgacgagcggcaaattggacactgaattgtaccactaatctgtctgaattgtactactaatctgtcatatcagtcgcttcatatatgattgtctactacaatgcaagttgtttcaagttttctttctcaagagataattagtctgagaagttatgtgggattactttgctaagtgattttacagtttgcatatctctatctacgctagctttaggaaaagctcgaagtggtagattctatatcgtgtacgaaaagaaatttcaggtggacccaattaattatgtaatcttttatacaataatactatgttttttggcacatctttttttttaataaagaaagtgcataatgtgatcttaaaatggtcactgcatttggctttaatttgatgataaaaagatgagcgtatggctggcgttttcctaatccaggctattgtgattagaagcttttttttctactttcaggtccatttatgccgacctttgttttgttcatcaaaaaattaaacatcgccctgccaatccttttccataaagtgatttatcatcgcacatatgtaggatctaagtggagagaagtgctactttataagagcagatgatgatgtataaaatgtatacatttcattatctgaaaaaaaatgtgtatatttgcaaccaaagtcctaagtgggcagtgcacaagttggtgtgctgctaggtgatccctattgttcctgcagctcatggacattgacatgggaaagaaagaattagtgggcaaaaataggtcactatcatatagatttatgaattccaaatccctaagatcctaaaatgatctgctgatttgattttaatgccagagaacagggcattgaatattaagtacttttactgcggttagaactatcactagtagcagtgatctcaactatcgattgatgaattctactaccagttgttaaggtggtagcataaaaatgtatgatccattaaatcaagagcaattttacagtacttgaggagttaccatgagatacaaaaaaatttagagtaaaatttaatacctcgtagaacctcttcataaaattgctcttaaattaaacaatgcgaatgatctctaccgtagggactgtgatgctcaattgctatgtgtttcagaaagattagttagtaggggtgtgtgtgcttaattcagtgatcaaaattagccagtgcagtgcaggtggtggaggctgacgtctcccataacgatgcgtctgtgtatgtgtgtgtctggttgtttccctctgatcctcacaatttgtctggggcaattctcctccttttggatgctctgatgatacacgaaaaagttgcagacgagagcggttttcagctgtaaagagaaacaagaaaagcagctttctcttctttatttcttttcttttatgtattttctcctcttttttttttctaatatgcgattcagactgatggtcacgatttggagttggatgtgttcgtagcagatttgttctcggccttcagactgaagccggaagaagtttttgccggaaatgcgttgtttttctgcagtttgctgaccatgagtcttgtccatggtgactgcaactgtttttggtgctttgcacggttcgtcagcagcatgaagcctcctctcactaccttttagtatcggatttcctgtttttaacaaaaatttggagataatgcactaaccggttgacttccttttgaatgatgctgcatctttcaagaatatgttccagatgagtcatgcgtcatacctggtaataatacaagtgttttttgactgaagtgatgatacaactgttagtgttctaatctgcattccaagtcagaagatgcactctgcactacagagaacgcactctcttatcccatgtctaaacccattttttgctacagttttgcctcacaataatcatccaaaaatgcacacaagttccatgcattgctagggcactactcgtctactactatagtaactctacctcctagacttcagataaggatgcatggcatccatatactatatatccatcagaatataccactttctgaattctgatacctaacattgagccattgaggccaagcaatgatcaaccatgcagtagtgcatttttactgctgctaaacttcatacatctgcatccactgcatacagtaacaaccacaacacaaaccattgccaaatactgattgcatttgcaaaaatcatccaacttgaaatcatcaggtcaatggagtcaccagggctccaagaaccgccccaccgaaggcgcgatcgccattgcgcgtgcgcacagttctcattccatggtgtccaaggggagagagccccctggggcttgatccatggtagaagctgataggattcagaaggaatctttggaagtggggagcaagctgaaatgcgatgtgctcatgtccactaccttggcattgtgatgtgttgcactcattatatacgatgtatgccacgagaagttcattgttccttttcttcagggcactgttacagtgtccctttcagagtttcaggatccatccatctctaagaagcagtgactggatggatgggttgttgagaagaaactagtgcatcactcttggccaggaatcgcaaatggaagcactagagaatggtaccttattaggagaagaacaaaaggaggtaaagtattacatgtcatctactcatgtagggtgacttggaaaaggttggctaaagaaaatttgtagagcacaattcttagtgcataggttcatgctacagtgttcctttctccatatagaaatggccagttcaacattctcatctgtcattggaactttgtcgaaatgatccatttatttgaagcaccattggtgtggtggtggagtcgtgggtgcgtgattcttaccactagggttaaaatcctggtgtccataatatggccatgtgcatcatagttgatgtagaggccacaaacaatacttccattatgtaaaaaaaaggtggagttttacagtggtctctattggtagtagaatcaatctagacagttcatgcaatactgcaaaacttgcagatttggtcgttgctgcggacaacgactctctcagagggccatcttggttctttcaactggaggtgggagagttcggggtcgtactccacccgatcagcttaccttgccctcttctcgggcaggatctcgtttcagcacctaccaatctggcgctcttttgccccacctcagtgtcacgtcgctacttcctgtggctggtcgctcactggcgctactggacgactgaccgattggagaagcgtggcctgccgcacccaacctattgtgtcttttgtgaccaactggaagaaacagttgatcacattctgattgggtgccttgagtccctatagctgtggtggactgtcctttcaagccccggcctccctcagtgctttccctctgacgctgattccttctttgagtggcactgctcctgtcggctcaaagttccgagggagcatcgtcgtgggttcaacacgattgtgactcttggcggttggtctatttggaatgaaaagggacaaccatgtgttcgacaaccattcccggccctagcctgaggttgtcgcaagccatggcgtaagaggccatcctttggcgtcttgcccatcccccgttgccagcgcttcctagttagcatgtttggtcgtttggtcgttcggtcgtcacaatgtaatcgcgagaataggcttaagtccttgttttccttttcttcctcccttccccccctcctctcctctcctctctctctctctctctctctctcttctttgtttgccatttgtgtaaattttattcctcttaatacaaaagtgcgtaatccttttgcgtattcccgaaaaaaatctagaaagttcatcttttcaaatccaatttctggtagtagatctcataaatcaatggttgaggtcatttctaatgatgataatgctagtagtaaaacactactagtacagaccaccgtaaaggtacttttaaaaaaaatagagagaaaggctagtgattagtgaatatgtgtattcatcaaagttcactggattttttgggtcatgtcttcaacaaatcaaatggttgacaaagaggagaatgccctggttgttctacaggaaactttttttttttgaaaccgatgttctacaggaaacttgtgtgtcaatttcttttacatggcatagctgttactgtcatactactataaaattctgcaattggatctctcgtgtaccacttatcagcattatgagtaccactgaaaatttggtaagtgcatcctcttttttcttgggtacactggacctcaggataatatatatctaggattaagtggataccagatcaaaatatatggacctgatttgatataacgatactgttttcctattagctcagaagtttcacacgctaaagttatctgctaggatggtgcatatatacatgccctattgccgtacagaagcaaacttaggccaaacatatctattcagaggagctaaaatacaatgaacaaggtttagcagcttctgaattgcttaccagaaccggtccttgttcaccgacagatagccagacatcacctttcctgcggtgttccgcatgccgtcgatgaggtagcaccaggttgatcccagggctccaatgaagaaatctgcttcagtggccatgatgaaattgacaaggggatagtttgtgctggtctcacggcccaggctggcctcatacattgccatgctcacattgacatcttggcgcgtcacatttgtgaaatagaaattccatttgggatataattttgtttcgtcgataacttcctacatttcagcattagcagagttaaattacagaccaatgaaatgaagaaattaatttacaccatacgagggatgagaattgaggagttaaattgcctgcatttcagtagaaagccagatgttcttgagacttggaaaacgttttcgaagacgaccagccaactccatgtatttctcaaagccaactacttccatttcacaagctttatctcccatccttacatgcatactgataagaggcccgggtatatatggtttatgctccgaccacacaagtcgctcaatgtcagattctgttctgctaatgctaggctgcaattgtgaaatctttcagttacttatctaaaaaagtaaggtggttagtgctaatgttgctttatccgaatgatgcgcagacaaaactctccacggaacaaagcaacataaaaatcttcagattgctaatacaaacctttggtggatctgggacattttcaagaaccatctttgctgcctgcatgccaaatgctgaatgtctagccacattcagtaatctgcacatgtactctgactggaacctcattaggtatctcagggcctacatggaagtttcaggttgatgaagcatatttgcatccccattatgaatagcacaaaatatgctcatcattcatcttggcatgaggtacacacctgtgcaatccaccatctccgatccattttacaatgatttttaaccaatctcccatctatctctgttgtcggttgcatatatttccatggtctcccccatatcctgcataacagcaggtttcagaaaacatgtgcatgaatcggcaagagccacaagaacagagcgatgaatgagatatactccctccgtccctaaatatttgacgccgttgacttttttaaacatgatcattcgtcttattcaaaaaactttgtgaaatatgtaaaactatatgtatacataaaagtatatttaacaatgaatcaaatgataggaaaagaattaatagttacttaaattttttgaataagacgaatggttaaacatgttttaaaaaatcaacggtgtcaaatatttaggaacggagggagtaaatgtgtatagctcatcagtattgggtgcgtgtttagctttccagaaacaggaccagcgcatcgaaatggtacctaggtatatgcccagcccatatttgcttggaggtatagttttccttaacttttataattccattttccctagaatctttgctttgcatgagatctaaagcacgtttctggcagtctgcagatgtttcaggtaaaaagtagcatgaccagctagatcttgctaggcctgaaaattgaacattgacagttatctcagttatcatgtcagttaaaagttacaacttgaggtagcactacacatatcatattatcaattcataatctacaaggtaagctggattgttcctacctttacaaccattgtgatcagcacggttgtagtatcctgcaactagaatccttctctcttttatagcaatagcaagaagtcccgacattccagcgagttgcgcacctataccaaatcccggtagcctctcccagtctgcatagagaaacctcaagcttggatcactgcagtttggaggatgttgatgaatccatacatctctctgcacttgtctggtcagtggatagttttcttcatctgatcctgcaatctttaaagttttgttgtaactcaaaagttagaatactgcattcatagtagtactgacaagacaattacgagttcaggcaagtttacacacccaaggtggatatggcgccctgtcagatttagcatttgacctgaaaaacatttgcctccactcttctgaatctgaatagttctggttgaataactcaagaccaagtgaccctttccataatgtccaaggaggaaatacgccgttgtcgctataactgtcaaatttcttatttctttcccatttaagcctgcaattctccagatgaggcggccgcggcacgtctgaacttttcataacttcatcactggtcgtatccagtaaagtgctccaagcattatacaaatgcattttatcagcttcattgatgtccttgctattggtggctatttctatcttttcttgtaaaacagataagtcatctgtttctgtagctccacctgcatggaagaagctggttacacagacattgtcacagctaaaaggaaaagaaaaaatacattcagcctagatgaacatatagtactacactactactgaattttttatgcgaaatggtgttcgcaaaataccaggttcagttgatgttgaattcaacaagattgctcgccgaaccggtggatgtaccgatcggatcatcaggatttggataggtgggagagcaacaccaaacaggtacacaatgcagacaccacagaagaagcccagtgcccatgtcttgcagggagcagagctccccatctgcagagccctccgagatataaacctttcaaggctcttgctgctgttgctgtggccattactcatcatcctcaattcctgaattcctcagatacctaccagcgcaacctgacccttgcattcaaacactgcctccaatcaagaaacaccaaatgcatcatggaatggaattcatgcaagaaaagctataaagacaaaaaaattcttcccaaagagtaaagtacaaatcaaatcacagatgagctaattgcttggaagacaacatggatttgatccacagatggcttctaagcacaggaatatacagtctacatgaaagatcatcggcatgcatgcacattaaacagattaccatgcgctaaaccccatcactaatcaggaaggaccaaggtagtcgcacaacacagccacatgcagaagtcactgacaaaccagtacagaaattgaaagatggttagctgaaaaacagccgctaacaaatcgcggggcttatcactcgtttactcccctcttactcggagtctttcaagtttcaggtacaagaacaggtcaaataaacagaccgaaattcaaaacaaaccaagttctctcgagtgtcaaacaactcaccgaatcttctgcaatcagcctaatcctgcaacttatgcatgcagagtgaaattcagagctggaagtgttcttgtttttctcatctcctcctccgtcctacgccctgaaacaggagaaaagagttgacgaccagaggagcaaagatcaacaatggctcaagatgaaaagaatctgtttaagaagaagaagcaaaaaaaaagactgcacaacaaccatgttattttgttattctcttgtacttatcaaacttctcggtgagtcaataaattggccggcggcaaggaaaggatgcagagaagacaagttcagaaaagaacatttttccttgatcggtcgagattctgtgttcattgctcagatgaggctgaggcattcacctatttctaaagagaggccgtttttagcttcttctggtaggattggcgagaccgatcgaagtaaacgagcaaagtgaagtaaacaccattcatcagggaaaaaaataaaaataaaatggaagtaaactcatcagatgatgttttggcgtgcttatgatggatgcattttactgctgttcatttccctaattaggtcaaacaattatctcatatgccttctctgtgtaactcgattttttgcacacagagagagagagatggtttcatcaagagagcatagaaaggaaggtgacgtgtcccagcgatgagttggtctctgtctactctgctctgtgctagacagctagagtagctgaaaaagcagaggaggtcacggtacaaacgaacaagacctgccacgtgtgggcccgacgccgaacacatgacaagtggcacgcgcgtggcagcaactcgctccacgtgtgcacgcagcgcaagagtagcagttggggtccacatgtcattgtcatcctcgggttgcgtggaaattggaacgtctcccgcaccgaacgcgcgctaatccgaggcgtccgtttgaaatccaacgactcaaaaccaatttggttgggaaagctctttttggctgtatttttttttctaagaaaagaacggttttgctattggataattctgctagtatatagtttgaaagctttttgagacgctacgatgaagctcgatctttatagatactccctttggtttaaaaaaacccaacctaattaaaaaacaggacacaatctagtatgagaaatctagatagaggattattcaaattcattgtactagattaagtctcatcccctaacaaggttaggtttttataagaatggatggattacgtgtgtaactgtacggtaagaaagtagattggatatgatgagatttggtgcagaagaaatcaaaggcaatggatggagctagaatgcagaatgttaagtatggaggaagcaaagtggcacggccacatgatgttgatgatttcatctgctgaattgaggttagcagcaaataaccacgacggctttgtggaagaacaaaactcggcccggcccaatatatatttggcccaaatactccatattacggtacagcctccaccgtcttgaaggccccaaagccaccgccatttccttgtaccgttagcaatttagtgctatctacatcatccgttataaaatgtaaaatcatttttcacacatcctacgtataccaacataaaacgacaaatactaaaatactccaacttatcgaatcgcaatgcaattattcagcactttgcctactctcagtatatttattctctattctttataaactttgatgtaatgactgctaaaaatgaatttatttgaaaacaaccgtgagaggttaaggccctgttttctttcagcttgggattattataatacaaattattaggagtaagctgaaagaaacagacaacttattgaagtagcttattataatctggagcccagcttattataatctgataagctcatttaggtgagctttttccagattattggatgaaaaattacccaccatgccaccccactccctttttagacttacaaacccaataatctaggctctaataatctaggaaagaaacaactaaccgcttattctactacagattataacaatctaacttatagtaatctgacttaataatctagattataataatcccaagctgaaagaaacagggcctaagaatgactttattccgaggaggaggcaaattagcctatctcatgatttaccttgtttggatgggcctcaataataatggcccatccaagtggacaggccctttttgttttttgtttttttgtcggcaggcagtgccagagcccagagctgagcagagaatccccaaggatcaagaaaaacgcaggcaggcaggcagcagcctggagcactggacgtcatgggtggatgaagaagacacgtacgctcaacagatttagtggactctggctctgctgctggcttgggactctgcctgctaatctgctgtcatctggtcatctccatgcacgcgcgcactaaaccacagcaaagtcagcaggcttttatccgtaatccatgacgctgcagatgatggactcacaccagcctctgcttgacatgcttgtattgctaaactatcatactccctccgtcgctaatcacatccaactaaaatcctttatatttagatacggagagagtactttcttcatcccaaaacgttgatttgatatatcttacccaaaacattgatttgatgcatcttataacaaaaaatctggacatatctcaatcttgttttaggattgattaaggttgtgttcggcactaagagtttccaactatcctcactcatttttcgcgcacacgctttttaaacggctaaacggtgtattttctgtaaaaaattttttataggaaagttgctttaaacaccatattaacctatttttcaattttttttactaatacttaattaatcacacgctaatgaactgttccgttttttttgcgccggaggagaacgtttccaaccatgagaaacgaacaaagcctaaatctcatcctaaattacaatatttcggaacggatgtggtactattatttcgacaaaaattaactaatcataattactatatagtacaaccgataaaatcatggcatgtttgcatcgccagtttttttttcattgactgaatatcacttcatgagaatttggatacccatctgagcaggccttagatgggcctgcaacgggccgtccgcgtacacaagcacgtgacacgtctatagtagaatccgagccgagtcacgtgcagatattctctctctttactcctttgtaacaaaagctcaatcctatcattcattcagcaatggcctcagagaccggcgagcctttcctcctgaaaagcagcgagactaccccctgaactgaaatgaagcgatgcatgcctgcttacgcctttgaccactctccatctccaatctccgtgcaccatagtagcatgtctctctctgccttagctgctgctgctactgcgggagaggctccagggtacagctgaccatcaccaaaggcgccatcacgacctgcacagctccatgcgagaaaccgcttcaaaacattttcgtgacctcactcacagtcacgctcacactggagtatcaccaaagcgcttggggcactcaccgttcgttctgaaagacttccaactggacgattcatagctaaaagttactccctccgtttcgaaatgtttgacgccgttaactttgtagcatatgtttgaccgttcgtcttattcaaaaaatttaagtaattattaattcttttcatatcatttgattcattgttaaatatatttttatgtaggcatataattttacatatttcacaaaagtttttgaataagacgaacggtcaaacatgtgctaaaaagtcaacggtgtcaaacatttcgaaacagaaggagtattatattttgggatggagatagtacatactccacaatgcatgttgcttggagtaggtcccatctatctctctccgctcccttttatctctccctctcccctctcacacattccgcaccactctctctcctggacggacgaagcaaagcggcggcgacaccgagctccacgcctccacctctcctcgtcggggctgaaggcggcgacgtcgccgcccgagcgccggtggagtagcggcggcaccgagctccacgcctccatctctcctcatcggggccggaggcggcaatgcagtggcgcggtccaagcttagaccgcaccgggcagagctccccgtatggcgcaccgtccggcctccttcctcggcggcaggcatggatcggggggcggcgcggccagcgcagatccgggaggacgacggcatcgccatcggcatcggcgcttctcccctccctcccccttcttcacctcttctcttgtgggcctagaagctgcgattctaacgaagaacgagccaatacctcccctttctccacctcttctcttgtgggcccaaaagcccccgttcttgcgaggctccgagctatgcctaggtgaaggggaatgacacctaggtgcagtgtgaatggccttagcctatgttctttgctcggtgttcccaaccctctctcttgtattctgcgcgcacgcttttcaaactgctaaacggtgtgttttattctgtaaaaagtttctatacgaaagttgttttaaaaaatcatattgatcctttttttaaaaaaacataatatttaattaatcacacgctaatgtaccgctatgtttttcatgcacaagagaggggttcccaacctatatatagaaacgaacacagccttaggttgcgttcgtttggagttgttcccaactccctcgtctcattttccgtgcgcacgcttttcaaactgctaaacattgcgctttttgtgaaaagtttctatacgaaagttgcttaaaaatcatattaatctattattgaaaaaaattagctaaaacttaattaatcatgtggtaaacgctgcttcattttatgtgccgggaccctcactcccgaacacagccttaatcatgtttgcacttgtgttcaatactccctctcccgtaatattcatttttagctattgttgttttacttgaaataaatttatttttagagtaattattgtatcggagtttgtaaaaataagaaataattatgggagtagataaagcgaaaaaatagttgtattgatatttgatataaannnnnnnnnnnnnnnnnnnnnnnnnnnnnnnnnnnnnnnnnnnnnnnnnnnnnnnnnnnnnnnnn

SEQ ID NO: 25106 - DNA, 2922 bp, Oryza sativa
aaaaaatcatattgatcctttttttaaaaaaacataatatttaattaatcacacgctaatgtaccgctatgtttttcatgcacaagagaggggttcccaacctatatatagaaacgaacacagccttaggttgcgttcgtttggagttgttcccaactccctcgtctcattttccgtgcgcacgcttttcaaactgctaaacattgcgctttttgtgaaaagtttctatacgaaagttgcttaaaaatcatattaatctattattgaaaaaaattagctaaaacttaattaatcatgtggtaaacgctgcttcattttatgtgccgggaccctcactcccgaacacagccttaatcatgtttgcacttgtgttcaatactccctctcccgtaatattcatttttagctattgttgttttacttgaaataaatttatttttagagtaattattgtatcggagtttgtaaaaataagaaataattatgggagtagataaagcgaaaaaatagttgtattgatatttgatataaagcatgtttattctattttttattggtatgtgtataaatgaatttactttggggcggagagagtagtgttcagaaatagcatacggttaagcaaaaatttaaaggatgtgagcttttcaataacggcctaaaggctaacagcatatgctaatagtgtaattcgaggctaaggccccctttgattcaaagaaaattcataggaatttaagaggattttattgctataggaatttttcctacaaagccttgaatcaaaggaatgaaccctatggaatcctatgaaattcctatggaatgcctttttccatacaagttttggaggaattttaacaagaggtagaacctcatggaagaagaaatcctttgagtctttatctctcctcaaattcctgtgtttttcctatggtccaatcaaacggtcattactatattttttctgtgttttgcaatcctctgtttttgtcacgccccgaactagtcccgaccggaactagcccgtgatgctccaaattaacccgttaatcgataccagtcccaggaaacagtgctggtatcacaggaagacagaatatcacagcaacagaggtctctttattatagagtaggagtacagtcatgttgggctgcggacagatctcgagctcacaactgcattacaaaagggaagcggaagccaagacttggaccaaacatcacaggcgcgacttgggaactaggccgaaaccctaaaactcatcatagccggcttgctcctggaagaactcctcgtcagcgggatccgcttcatcttcttcagcaactgggggggattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaacgacacggatgagacagtgcgtctcatccggtcggagtatgtgcaatgtttcagtcttttgaattgatcaagattggcacccggccaacagctttcaaacggccacctgggcctggctgatcccatcagccgcagattttccaaacatcaaacccattccacaacagcaaatttcacaaggcagtagtcaaacaaaactacgctaagaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccaaaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttgggaattcatttagttcgcaaacaccgacccaggtgtcgggttttccaagtcttttgtaaaacccaagttttacccaagatgtttctcagattttaagtttgaaggcgaccgtcgatacccgtgcagagtacacgattaccgaggcgcaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataattaagttcaaatataggctcaagatgtttaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaactttggaagttggacggagtcaaacggacttacggcggctagggcgggaaattagacttccctctggcggctagggcgcggcccgagagaatggggcggctcggccgagcttaatgggccggccggcccaagaaggcggcccaacgcgcgcgcgcgggcggggaggggagagagagagccggtgggccgggtccaacccgcgtggtcccgggtgggacccgcttgtcggcgactcagctcaccgtgagcgaggtgcacgcgggg

SEQ ID NO: 25107 - DNA, 1132 bp, Oryza sativa
tcctgtattatgtgcacttatattgggacgaagagaatattaataattaattaattatatgcttatgagatttactgttttgcgtgtgcttaaaattctccttcaatgggaggcaaacgaacgggcccttagaagctcatcacttgggccgagtcacgggccttagcccaacaagagaacagaactggtcggtcactgacaaagcgggccccacctaatgcggccccagcgcttttcggtgtacccatgccgcctgggcccacagccacagggcctcgcgctcgaaacatttcgaaatttgaaacgcttctcccggtcgtaaaattcccaaatcaaaccattccttccccaaaatctcgcaaaccatctccctctccctctcgtcttcccccagatccccccaaaccctaaccctaccatcgccatggcctcccgcatcaaggaccgcggcaaggccgcacccgccgccgcgggatcccgcccgctcacccccaaggccttctccgcctcgtcgtccgctcgccgcacccccgccgccgccgctgccgggaaggagaactcggcgtccaagccctccaagcccaccgccgcggtgcggtggtccacgtcgtcgatcccgagggccagcaggatcccgagctccgtggagtcctccaagctcgtctccaccctcagggcgtcctcggtgatgccggggagggcatctgtcgggaaggaaatggaggcggaggcgggcttgcggcggagcgtgagcggcgggatcagggccgctgccccggagagagcgaggaggtcggtgggtggcgttgggggtagggtcccggatgcgaggagagcaagcagcgtgcctcgtgctgatgagattggtaggaggagggatgggtttgatgctagggcgaaggcgagtgatgtgaccagtgggagaagagaaggctttgatggtaaggctaagcaaatgaatgcggttgataggaaaagagagagcttcgatgtaaaggcgaagcagatcagtgggaaaagagggagcttcgatgttaatgtgaccaagcaatgtgatgagatcaaaggggaaagagagggctttggcaccaaggcaaagaagaaatgcgatgggattgatggcgacaatgag

SEQ ID NO: 25108 - DNA, 643 bp, Oryza sativa
  unsure (1)..(643): unsure at all n locations
caagatgaatggcttcgccctcgcagcttcccaaagcaatcccaaaaaatcttccgtctgaggctgccacccgtcttcaagtttggcagacagtgaagccaaagcattggtggaggaagagacatgcccaacggccttcggcattcatgcaccttcaatccgctgctcctcctcagcttccctccgcattcactggtcgccaccaacctttcctctcgcagtccaagcctcttcaagcaaggatcagcttcctcgagctctttaaaaagaaggcggtgggtcactgcttccgctatctagctcaggaccaccgagttgcttcctgtagagaccccctgaggtgcattctctgtggcagttctggccacaaagcccgctggtgcccgggagacagacgacgggatagggggggtccagccttctcgccccactcctgcttcttcgctagccagtcggctaggtttccctccgctcccggcaatgtcgcgcccaggggacccagccaacaggccggacagcattcagcgcgtncttgccaggacgtcggccatccgtgaggatgaaagtttctttctcgcaccgcagcggtggtacaggttacaggcaatcttccagtgacgaacatgagacagatcaacaggtt

SEQ ID NO: 25109 - DNA, 719 bp, Oryza sativa
  unsure (1)..(719): unsure at all n locations
catggttccaacaaacccttaaataaaactagcatggtgacccgcagattgcgcggctagcatcattgtattttctctcatataatagcatatatgttttctcattatattattcaaatatattaaaatgacaacataattttaaattttgcaataactttataaacctactaatgtgtaatattcatattatattttatatacgtgttagttattaattatttttaatatcaaattttagttatttgtaaattatatatattcctatatggactctagactcgtcttttaatatttgtttttttaattccgaattttctgtaaattgtatttctatatagactctatgctcttcttcccatattatttatttttatttcagaatttttgttatttctaattgtatttctatgtggactctaaactcatctttcaatattctttaatttttaatttcgaatttcagttacttctaaattgtattcctatattgactttaaattcttcttctcatgtttttcttaatttcgaattttagttatttgtaaattatattttatacggactcaaaactctaatttaatttaattatgttattccaaattttagttagttttaaattcctatatggactctatactctacttctaatattncttactttttattcccgattctattttttttcttaattgatttctatatggactctatactct

SEQ ID NO: 25110 - DNA, 7116 bp, Oryza sativa
  unsure (1)..(7116): unsure at all n locations
nnnnnnnnnnnnnnnnnnnnnnnnnnnnnnnnnnnnnncaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacattttccataatgtctatatttccttatcatgtacgaaaacatattgtaggatatgaggtatgtcaatccagtataattggtaaatcgtaggataagaagtactccctccatattttaatgtatgacgccccctgactttttaaccaacatttgaccactcgtcttatttaaaaattttatgcaaatataaaaatacttatgtcgtgtttaaagaacatttgatgataaatcaagtcccaataaaataaattataattacataaattttttaaataagacgaaaggtcaaacatttgtaaaaaagtcancggcgtcatacattaaaatacggagggagtatgtattatttgtaacctgataaaatttcccatatgatttgattgtaaaaaaacaagaagttattcgttcgtgggctgtgtgagtcggggtggttgattaggcttatgggctttgctttgttaactggggtatatttagttcacgtcaaaattaaaagtttggttgaaattaaaacgatgtgatggaaaagttgaaagtttgtgtgtgtaggaaagttttgatataatggaaaagttgaaagtttaaagaaaaactttggatgtaaactcagcctgaagctcgagaaagcattgaaaatagactatcgaggcttactgagtacttctgactactggagcggcgtacatcctaaatatttcgcatatgttttgggtatgccacagtgcataccaggaacacacatctgtctcttggaataaattcccattaaatcttctaggaaagattaatcgaacgagagctaaagggttaaagaaacattagccatttgattaatgtataatggacggttaaaaatattttggtgtagctgaaaaaatccaagggtgcatagcaattgactgggccagactgatcacgtgcaagtggaacgcatgcacatctccctgcttttctgagaaatccttgcaaccacactggtcgtattcgtatcaatcaggcaggcagcttcgccaacgaagaagcacgtgtgcctaagcatacatcttcttttccactccaatcttccaactaatgaacgaatcgcgtgtacagtactccctccgtattttaatgtatgacgccgttgactttttaattaatgtttgaccatttgtcttattcaaattttttatacaaatacaaaaatacttatgtcatgcttaaagaatatttgatgataaatcaagtcacaataaaataaatgataattatataatttttttaataagacgaaaggtcaaacatttgttaaaaaatcaacggcgtcatacattaaaatacggagggagtaaaatctataatctatttatatggaaatcaggcggccatttaagcaaacagagcaacgagacaatagttttagctatcatgacagaaatgactaccagtgccctgcatctgcaggtgcttgccttaaccgtcttcctcgtctgcgcggcggcagtgacaccatcggcgtcggttcagcagcagcagctgccgggctgccccgacaagtgcggcgacatcagcatcccctaccctttcgggatcggcgcccgctgcgcccgcgaccaatacttcgagctcgagtgcaaccgcgcctactcccctccgcgcctaatcgtgtctacccaccggcaacatctggtcaacctgtccctcgccgactgcgaggctactgccctcatcaacgccagacgccagtgctacaacagcacagagggtttgatcggtgatgccaataattatgtcaacaatgatatcactcttgtcgagagcaatgcctaccgcttctctgcggcgaggaaccgcttcgtcgcgctcggctgcccaaacatgggctacttcgtcgacacctacggctactacgtcagcggttgcacgtccatctgccggccatcgcaggggaatggtgcgagtggtgcctcgaccgggggatgcaccggcgagggatgctgccagagcaggataccgaccaataccgactactacgagctgtacgttcaaactttcaaaccaggggaaggggaccccatattacgtggcggtacgactgcttgccggtacgtgtttctggcggaggacaagtggatcgacaccacctaccgcggccacccggacttcgaccgaaacgacgacttcgcggtgcccgtcgtgctcaactgggccatccggaacgtcggtaactgcagcgccgctactcgtaacatgacggactacgcgtgccggagcgtcaacagccactgcatcgactccattgatggccccggataccgatgcaactgctcccagggctacgagggaaacccctaccttgacggtggatgccaaggtaaaaaaaataaccacacctcccattaaataaagggagaatttgaaccatgccacacaaattttgcaaaatttatgatataccaccctgacctacatgtcattgactcatgtgggtcctacatgtcattgagatacgagtggtatatcttaaattttgcaaatatagggtggcatggttccaacaaacccttaaataaaactagcatggtgacccgcagattgcgcggctagcatcattgtattttctctcatataatagcatatatgttttctcattatattattcaaatatattaaaatgacaacataattttaaattttgcaataactttataaacctactaatgtgtaatattcatattatattttatatacgtgttagttattaattatttttaatatcaaattttagttatttgtaaattatatatattcctatatggactctagactcgtcttttaatatttgtttttttaattccgaattttctgtaaattgtatttctatatagactctatgctcttcttcccatattatttatttttatttcagaatttttgttatttctaattgtatttctatgtggactctaaactcatctttcaatattctttaatttttaatttcgaatttcagttacttctaaattgtattcctatattgactttaaattcttcttctcatgtttttcttaatttcgaattttagttatttgtaaattatattttatacggactcaaaactctaattttaattttattatgtttattccaaattttagttagttttaaattcctatatggactctatactctacttctaatattccttactttttaattccgaatttctattttttttcttaattgtatttctatatggactctatactctacttctaatattccttatttttaattccaaatttctattattttctaattgtatttctatatggactctatactctacttctaatattccttatttttaattccgaatttcagttatttcctaattgtatttctatatggactctagtctcctcttctaatattccttattttttaattccgaatttcacctatttctaaattgtatttctatatggactctagtctcctcttctaatatttcttattttctaattccgaatttcagctatttctaaattgtatttgtatatatggactctgctttttctttttcttcgattaatgtgagaatttttaggccatgagagcgaacgtggaggctcatttttctattcctttaataatataactagcatggtggcccgcacagattgcgcggctagcatcattatattatctctcatataatagcatatatgttttctcattatattattcaaatatattaaaatgacaacataatttgaaattttgcaataactttacaaaactattaatgtgtaatatccatattgtattttatatacttgttagttattaattatttttaatatcaaattttagttatttgtaaattatatatatacctatatggactctagactcgtcttttaatatttccttttttttaattccgaattttccgtaaattgtatttctatatagactctatgctcttcttccaatattatttatttttatttcagaattttgttatttctaattgtatttctatgtggactctaaactcatctttcaatattctttaatttttaatttcgaatttcatttacttctaaattgtattcctatattgactttaaattcttcttctcatgtttttcttaatttcgaattttagttatttgtaaattgtatttttatacggactctaaactctacttttaattttattatgtttattccaaattttagttagttttaaaaatcctatttggactctacactctacttctaatattcctaattttttaatccgaatttctattttttctcaattgtattcatatatggactctatactctacttctaatattccttatttttaattccaaatttcagttatttcctaattgtatttctatatggactctatactctacttgtaatataacttatttttaattccgaatttcagttattttctaattgtatttctatatggactctatactctacttctaatattccttatttttaattccgaatttcagttatttcctaattgtatttttatatggactctagtctcctcttctaatattccttattttttaattctgaatttcaactatttctaaattgtattcctatatggactctagtcccctattctaatattccttattttttaattccgaatttcagctatttctaaattgtatttctatatggactctactttttctttttctctgattaatgtgagaatttctaggccatgagaacgaacgtggaggctcctttttctatttctttaataatataatagatagattatatttctcatgtgagtttaaaagctaattcctgttgatttgggtgatttgcgaagatatcaacgagtgcgagcggccagataagtacgcatgcttcggcgagtgcaccaacacgctaggatcgtactcgtgcatgtgcccgcgaggtgctcgtggtgacccgtccattccacaaggctgcctcgaaaaggacaagttcactttagctctgaaagtagttacaggtgaaaaattataactgtcgtccatcatggcaacaccaatgcacctttttttctctctctctctctcgctctaatgattcttcgatttctgatgagtgacatcttcaggggtcagtgttggtgtcttcctgccactgctcatgtacttttgcctatacctagttctccagaagaggaagctcatcagaacaaagcaaagattctttgagcaaaatgggggagtgatcctccagcagcagatgcactctggcggaggtgctggtggattcaagatattctccacggaagagcttgagaaggccaccaacaactttgctgatgaccgtgttctcggtcgcggtggtcacggtgttgtctataagggtgtcctggaggacaacatggtggtggccatcaagaagtcgaagatgatggaggaagcccagactaaggaattcgcgagagagatgttcatcctctcccagataaaccacaagaatatcatcaaattgctcggttgttgcctcgaagtcgaagtgcccatgctgatctatgagtttgtctcaaatggaacactctaccactacatacatggcaaggaacccatagctcacatatcacttgatacccgtcttcggatagtagcagagtcagccaaggcactcttctacatgcactcgtctgcttcaccgccaatcctccatggagatatcaagacagcaaacatcctacttgatgacaagctcaacgccaaagtttcagattttggggcatcaaaactagcaccagctgatgaggccgagattgcaacgttggtgcagggaacttgtgggtacctagatcctgaatacctaatgacttgccaactgaccgataagagtgacgtttacagttttggtgtcgtcgtgctagagcttctaaccaggaagaaggcattgtacttggatggaccagaggaagacaggagtctggtgtcatgcttcatcacagcagtgaaagctggtcgtcatcaagagcttctggacaaccaggtaaggaatgagatgaatgaagaaatgctcacagagattgcacacctcctgatgcgatgcctaagtatgaacggggaagaacgaccgacgatgaaggaggtagcggagaggctggagatgctgaggagataccagcaacatccttgggttgaagctgaaggtaatgccgaagagaatcagagtttgcttggcattgaacaacggaattcaaattaccaactcaagcaacatgatgttcttgatctagaagaaggaagtacatatacatttagcttgtagatcatgtttgtttgtgttaaccttttataatcaatcaataaattcaggtacaaattctttaaaattcttttatgtgtaacatgagaacacatctatggagtgcaatgaaagaaccgccaagaaatttatgtgggcagtaatttttttttaagggaagacggcaggagctctgccaatttcataaaaggaggagcagacaatagaggtcgttttacaagccagccacgcaagctgagggcaagcacatagcttgcgagattaaaaacagatgggaaaccccaatcttgagaaagtgaactgcaacaagaagaagaaagcgtagaaaactcatctaggaactaagggcttcatcaaactctttgcacaaagcaatgatgaaatcaacgacctgagctaccgagttgtaaatgtcattgaaaatc

SEQ ID NO: 25111 - DNA, 12203 bp, Oryza sativa
  unsure (1)..(12203): unsure at all n locations
tcaagcaacatgatgttcttgatttagaagaaggaagtacatatacatttagcttgtagatcatgtttgtttgtgttaaccttttataatcaatcaataaattcaggtacaaattctttaaaattcttttatgtgtaacatgagaacacatctatggagtgcaatgaaagctcggtacccgccaagaaatttatgtgggcagtaatttttttttaagggaagacggcaggagctctgccaatttcataaaaggaggagcagacaatagaggtcgttttacaagccagccacgcaagctgagggcaagcacatagcttgcgagattaaaaacagatgggaaaccccaatcttgagaaagtgaactgcaacaagaagaagaaagcgtagaaaactcatctaggaactaagggcttcatcaaactctttgcacaaagcaatgatgaaatcaacgacctgagctaccgagttgtaaatgtcattgaaaatccttccatttctttgcagccaaatgccccaggtagtgtagatgaaaaggccgtcaaaattacgtctttgttccttaactagctccttcctgcaagcctcccaccaatctagcaaacgtcccggaaaaagagagggtgaaggcatgtgtaggccgagcttgttccacatggagctccaaacttgtcttgcgaaggcacaatccatgagtaggtgattagccgtttctggttcaatgccacagaggggacagatctcactgttatcccagccccttagttgaagtttatcagcggtgaggttttttctgtgaatcatcagctagccaaagaatttgcatttattttccattttggccttccagacgaaagttgatctgttgtcctgtatacttcttagaaactggatcctgtaagccgagctagccgaatagcagccattcggggtccatctccatgatatggaatcctcaatgccatcctgcaaatgaatttgctgcagagagtgccaaagaatgatgaactccctgacttggactgtgcttttcattctctgcatctgacgaagccagcgattatcgccaagttcctgggcaaccgtcctgtttttcctggatgcgatctgaaataaggatgtggcaatatctttaggagctttaccttccagccatcggtcatgccagaatttgactttgtttccatttcctaaggagatgacggtggaggccctgaagagttgcttatctgtttcatcacagggaaggtttgagccctgccacggtttgtcctgagctgtccaatcataccataaccacctcagtctgagtgcacgaccaaagagttccaaattagtaatgccgagtccccctaaatcttttggtctgcaaaccctcttccagttgactagacagtggcctccattagcctgctcagaacctgtccataagaaagccctgcgaatcttgtccatctttttctctgcccatttcttgagggggaacaccgtgaggtgataggttggcaaagctgagagggtagacttgattagaaccgctctacctgttttgttgagaagttttcctttccaggtaggaaggcgagcagcaaatctatcaattaggggttgaacatcaagcctccgaagctttctgatgtgcagaggtaggccgaggtaggagcacgcgaattctttcaactgggctgggaagggggaaagaatatcctggaggtccagatcttcacatctgatggcgtaaacctcgctttttgttaggttagtgatcattcccgttgttcgtccaaagtgaaggaggatagcttgcactgcctgtatctcatccttgatcggcttggtgaaaatgacagcgtcatctgcatatagagccatgttaaagcgggcagttctcctatgaaggggctgcagcaagccttcatcctgtgcagccgcaagaaggttttgaagtgggtctatagctagaataaagagcatcggagataacgggtcaccctgccatagacccctgccatgcatgaaactgttaccagctcttccatttaggaggacattagaagaagaagaaccaagaatggagcagatccaacctagccatcttctaccgaaccccagcgtcctaagcctgtcaagaaggtaaggctagctgactgagtcgaaggctttggcaatgtctaatttgaggagaattgccggggtcttggaagaatggagctctttgaccaagttgttgacgaagaggaagttgtcctgtatgtttcttccttttatgaaagcgctttggttgtgggacacaagctgttgaagtttcggagctaatctgtttgcaaggagcttagaaaagagttttccaaatgcatggatgaggcttatgggtctgaattcactgacacgaagagcattctctttttttggaagcaaagcaatgtaggctgaattcaaaagccatagcctgcgtgatatcttcctgaatgatgtcccaacattttttaaaaaagcacctgtgaagccatctggacctggggagttgtctgaacgggattgaaaaattgcacttttgatttcttcaactgagaaaggtgcttctagatnnnnnnnnnnnnnnnnnnnnnnnnnnnnnnnnnnnnnnnnntcacagaggttcgagacctatgttctcccaagtgctgcttgtaaaagttgaaaagttcttgtcctttttcttcatgagagtgaaccatcccggagtctgtcaggaggtgttgtatgaagtttttccttcttctcacgctagctttgatttggaagaaccgagtgtttgcgtcacctgctttgatccacaattgtctggatctttaacgaagtcgcaccctgtctagggctgccagacctaagagcttctgcttaagggatcttctgaaaaggatctcctgagctgagaggttcctctcttcctgtgctaagtctagtctgaagatcagctcagtagctatctccattctcaactttagactcctaactctgcatctgctccagtttcttagtgctttcactgttcgggctaacttgataagaattcttttcagggcatcaggcgagtggaccggttttgaccaggcagactgcacagtttcaaggaatcctgggagccttatccagtatttttcaaacctgaaaaggttgcatttaggcctagaagggtttgcagttagcagcagaggacaatgatctgagaccatcgtagagatagctgaaagcaagcaattttggaacctttcttcccactcatgtgagcaaaacaccctgtcaatttttgttaaggttggtatttctgtttcgctggatcaggtgtatcgacggccatttagttttatttcaataacttccaacatgtttaaagccgccctaaaagactgcatcatgcccctgttaagattgctgttatttttgtcggagtcctggacaatgaggttgaaatcatctaagatcatccacttttgatttactgtgttctttgtttgctttagttcctcaagaaattctcttttctcattgtctggttgtggtccatacacccctgttatgctccaagccaagacatcttctttttcttttaagtttgccgtgatcgagtaaacacctgtttgcacactttcaatcgagtattttgagtcagacaccgccagcaggatacctcctcttgtacctgtagccggcaggaaacagaaattatctgcaaacgatggacctagaacctgttgactattgcttgatcaaagaactctaatttagtttcctgaagacatacacaggagcagtttatgtccatgacaaggtttctgacaacctgctgacgggccgtggagtttaagcctctaacattccaactcaaaatggcacagtcatttgtagacatttaacgggaggggcacctgcagtatcccaagcggatggaagagcacaacctatagaaatggtgaggcttgaaacatagtagagaagcaaaacacagtcgcagggagagatgaggtagagcttggccggtagaggcaactgagcacttcattttctgcagagacataacctggatacataactgaaggaccatccttactagatcgaggtctaactgggtacagggggagcatgaggcacagcatagaagaacaaagccaactactcgagctacaagagctccaaaagaaactaaactgctctaaacccctcaggagaagcaaacaacccatttcagtactacaaagactcatgatagcaaaaaggaacagcacatcaacaagcggcgaagccaactaagtcttcttcttgctgtcaccaatggcgcagccggccaccagagcagagaaggcatctatgacctcctgagagagaggctgcttgaaaagcttgacgtatttggccattgcgtcctcagtcttcttgccgtcctcagggagcaggccagccttcttcatcagcagctcatgagcgaggtcaccttgcttggccggagaggaacgagcggctgccttcttggccaaccgagcactcttgcggcccgcctggctaagacgggtcgggatcttcttcaagagctttcccttggagacctggcgcgtgggagttttgagcagaggaggctgcaccgccgcgaaggcctgggtcaggaaatctgcaagcttgtctggggagatcatcagaggcgactgggaaggctgagattgggcagcctgagagacctacaccagcacggcggactgggacgcctggtcagctaccagctcctccagcatagggtcagcctccatcacgaactggttggcctgaagaggggtggcctgggtgatcgggtcctgtggggatgtagaaggggggcgagacagctggaagccgccatccttcatcactgcaggaaccgacagcgacggcgggggggatgaccttccacgcggagacctcgagcgagcggccctcaccggagaacaagctgccctgcggtgaccacccccgtaggacccacctctgttctccgaagacctggaagaggagcgcctggggaaagctgagctgcgagcaggagggacatcccaccccaaggggcggcggcgctccctcgctggcggagagcgggaacgtgagcgtgagcgatctctgcctgggcccgggctagggaaagccggaggctgagggggaagagtgccatccttgacgccaaggctccaaataaaatcatgatgctttgggatttcttctgtcatcgagacaggggagatgattccactggcctgactccctagactattcatccaagttggctcagttggcggcgggttgaagtcgagcacctgatcgagatgcacgagcaccgggtaggccagcagcttgggaggggaagtcctctgccgagcctctccgtccaggtcccagcgtgagtctggggagcgcggggacagcggttcttcaagctcgaagtgcacctccttcgggatggagtccggatcgtccgcccacagccaggcgcagaggcaagccgtctcgttctccgttcttggctcatcaaggtcctggatcaagcatccttcatcaagcagtcctgtaactgtctctgccgaccaagcgtggctggggatgccttcaaagcagacacgaatgctgaagcaccatttgaccagctctgcctggacgcgtctcgaccacgggagcaccgagaggtcaatgtcctccacagcaaaagggctcgccgcaaccatcatgtccctgagcgaccgagaggtgcaggtgaccaggtagcctcctttggagaagacgacaacattgaggtcctcacgaggaacctgaaacctggacgccagtaacctgttgatctgtctcatgttcgtcactgggagattgcctgtaacctgtaccaccgctgcggtgcgagaaaggaaactttcatcctcacggatggccgacgtcctgggcaggacgcgctggatgctgtccggcctgttggctgggtcccctgggcgcgacattgccgggagcggagggaaaactagccgactggctagcggaggagcaggagtggggcgaggaggctggaccccccctatcccgtcgtctgtctcccgggcaccagcgggctttgtggccagaactgccacagagaatgcacctcagggggtctctacaggaagcaactcggtggtcctgagctagatagcggaagcagtgacccaccgccttctttttaaagagctcgaggaagctgatccttgcttgaagaggcttggactgcgagaggaaaggttggtggcgaccagtgaatgcggagggaagctgaggaggagcagcggattgaaggtgcatgaatgccgaaggccgttgggcatgtctcttcctccaccaatgctttggcttcactgtctgccaaacttgaagacgggtggcagcctcagacggaagattttttgggattgctttgggaagctgcgagggcgaagccattcatcttgctgcctgaatgaagctatcctgaggagtaactccctgtaccttcaagccggagggcacaggaggagtaaatccttcacccaccctgcgcagtaaaaccggggctgcttgaaaacttaaagaacctgtagaggggggaacctgctggatcttggctggcaccagggggacgcgcatccgctgcctcactgaccagatttgccaggaggaattgagggcgaagcagatctggcagatccccatccgagtagctgccagagagggagccgaggctgactctctctagaaagggaggatagccgaggatgaaacctgtgctagcgggggaggacactagggccggactggtcggtggaggagggggtgggcgcctgggccagagtggcacccggcgatagggcgagaggaggaggaggagacgcgtcgaccattcggtcgtgaagttgccaggaagatgactgtccatgtgggcagtaatgaaaagcaggaaactgcataggctatagagaacaatgatatgcaactatgagtattgaatggttcatcaaatccaccaaacacagagcttaagttgtgcaactaacaaacaccttggataggcaaaagaaaaatcaaaagaattgttgttaatgctcacaatgccgacccattaccatcgtgtgccgtggtgacagatagagacagttataattttggtcctttttccactaacacgagaaatatggcctggatttcggccctaaaacaaaaactcatgccatgtttgcgccttttttcttggttttagtaccacctcggtaacggaaggcggaggagggcgcttcgctatgtatataagcaggtgggcttgttcaaaacaactctcggccttttggctaaaatcaagggtttgtttggtagagctaaaacttctaaatttaggtacaggagttgagtctggggtagagctgtttaaatccagctccacttttttagtttattttgtgagataactctgctcccatttttggtagagcttaaaattgtttagtttatttctagtttattttgtgatacagctcctctagttcattttgtgatacagctctactccactccctttttggtggagctgaaattgtttggctttatcttgtgagacagctccacctagctccgctcccatttttggtgaagctgaaattgtttggctgagattcagctttagaagaggtgggactagagttagagctgtgccatctgtggaccatatatccactgtgatattgaatttattttttataggggagggtccatcacagtgtattgctactgggggccctcacgtgtcgcctaggcgttgcactgatgccagggcctggcacacccccaaccaaaacagcttttaaaagtttgatgatttctcatgctgaacgctgatcctctacgtctgtttaagttgtttactgcaggaagagttgagttgagtactgatgttgagtgccattaatttgctacgaaattggtgatccatgaaactcaaaatttcggatagctttcgtcgtaaatttgctaaaaaattggtcactgacctgttgacccatgaacaaaaactctgcaagagtctgcccaaaatctagacatcgtcagagttcagacttcagatgtgtccaactcttataagggcgtttacaatatgcggacgtggcattcagcctccaccccaaaaaccgaatattccttgccacatcatccaaatgcacaacttccttagctcctagtagccaacattggctacccgttcttcgtctccggtgggacccacaggcgggctagaggagagaggggagatgggcaaggcagcagacagggatttggatcgtctgccttcgcagagtgaaggcacgagcatgcagtcagccccttatccaccattgaagtaatccaacggctcacgtcgcatgtgcgcttaaatagacgaatgaatttgtctgtgaaagaccacgatggttctatcgcaaaaaaaaaaatcccacgatggttgttttggtctgggaagtgtacgcgagctaaagaaacttacaaactatattagtgctaatacacatgaaaaaaaatggatgatatcaccaaattaaaaatacaagaaaactgaaagtttcaaataacaacactaattcattacaaagtagttctccatctttttcatattataagtcatttgactttttttctagtcaaaaatcgttaagtttgactaatttatataaaaaatagtaatatataaaatatcaaattaactttattaaatctaacgttgaatatatttttataatatatttgttttgtgttaaaaagtaaaaaaaaagaagtttgactagaaaaaaaagtcaagcgacttaggccttgtttagttggagaaaatttttgggtttggttgtcacatcggatatacggacacatatttgaaatactaaacgtagtctaataacaaaacaaattacagatttcgctaggaaactgcgagacaaatttattaagcctaattaatccgtcattagtaaacgtttactgtagcaccacattgttaaattatggtgtaattaggtttaaaagattcatctcacaatttacacgcacactgtgtaattagtttttttttccacatgaaaagtttttattttgggaactaatagagggagcatgacgcaatgtcaagtcacatcataaaaagcaaaagaaaaattatgattagagcataggattgataagaaaaattacaaaatttataatgcaaacatcattggtattcggactgaaatatagcagtagtgcttcgtggactttgacagacagatatccattcagacgtgcacaggcgacgtgagccattggattatttgaacggtggatgaggtgccgactgcacgctcgtgccttcaagccgtgaaggtagaggatccaaatccagcagacagggagagaggagcggcagcgccgcccggcatcgtcgtcgctgcttagcccgcctggcggcgcctccttgctgacgagccgcctagcccgccgtcgccgtgcacagccgacgagcccgccgtcgccgtccgcggccagatccggcgagcatggcggccggaggaggaggggacgcgcgacggccggaggagggaggcgtggcggctggaaaaggaggggaggaagtgcggcggccggaagacgaggacggcgacggggctccggtcggcagcgacctccgcgaggacgaccacgccgccgctcgtcgtccgcgaggaagacgccgtgaggaagacgccgacgccagatccggctggatctggccgtcccatcgccgctccgcccggcgccatcactggatacgccggcgctccgtccggcgctgggatcgccccgccgcctctccgtcaaccgcctgggccgccgcgtcgtccgccgccgccccccgtgtccgccgctccattcgccgccgcctgtgtccgccgctccatccgccgccgccgcctgggagagaaagaggggcgccggcggcggagtagaggaggggacgcgccggctgggttcgcagagagagaggagagaaaaagttaggagagataacgggtgggacccagtgtagggaaaaagtagaccacatgcattgtggagcttgttgcttatgaagtttctcagtctaggtggcagttttggctcctcaaaactacgttacgtgacgcattgtgactgccctaagtatcatcagatttcgctgttctagacttcagataacttcaattttaccgaaacatttaggccctgtttagattccagcttttttcttcaaacttctaacttttccgtcacatcgaactttcctacaaacacaaaccttcaactttttcgtcacatcgttccaatttcttcaaacttctaattttggcgtggaactaaacacagccttaggccctgtttagattataatttttttcttcaaacttacaacttttccgtcacatcgaactttcctacacacataaacttccaacttttccatcacatcgttccaatttcttcaaacttctaattttgacgtggaactaaacacagccttaggttcgatatgctccgcggtaacattactacactgaatactaggaaatcgcctcacaaaataggaaaaattacaatgatattcaaatttacatccagaaacccagaatacaaatcaaatccatatttgcatttaccattccctccatctccatgggactttattgttcttttcagaaagattaatactaatcaaatcaaatccatatttgccgttcaatgctagcctcgatgtgcctggctgaaagttcaactatggtcgacattccgtcttctgttggaactcacaacggcacgttcggatttaaatccccgccaaaaaaaaaaacctggcaatctggtactccctccgtttcaggttataagactttctagcattgcctatattcatatagatgttaatgaatctaggcacacgtatatgtctaagttcattaacatatatatgaatgcgaataatactataaagtcttatataatatgaaacggaggaagtagcatctattaccatggtctctactacggggatttatggggaaatattccaaatcttgcacggcagaagctattgtcatggtcattggtcgtgccatcatgtttgacttaacaccaccggtggtaccaaaaaacgcaaagaaccacttgtcatacttgcgacagcgatggcatgtgaacgaattccgccgaaaagaacctccaatctaaacattcagcgttcaaatagttttgaacgacaaattctcgacgtcttcaattcgtcctcgcgttcaatagtgggccgtgacgtatagagacaggccttctccactagtaacaggccaacagaaataaatacggcccatatttcggccccgcaaaaaaaatacggcccagatttcggcctcaaaaggaaaactccggcccatgtatgcgtttaaacgatagcacctgacgggatctggagatggatggatggttcttcggtttagtaccacctcggagacgaaggacgtacgagggcgttgcgctctgtatataagcaggcaggattagacgaagcaactcatacctttctcggccttttggctaagatcaagtgtagtatctgttcttatcagtttaatatctgatacgtgggccatgtgtccactttgatattaaatttattttttgtgggggagagcccaccacagtggcttgccactggggccctcacgcgtcgcccaggcgttgcactgctgcccgggcctggcgcaccccaaccaaaccaacacaatgtttgatcgaaatttttagtttttgtactttgttagtttcaatcgtgtagctggtgaatgcggtagagcattgaaaaatccatcagcaaggaaaacaattgtctctagatctgcaaacggatatctgagttcagatgcccctccaattctgaataatcgatataccttcatcagatatctttttatctatgatgggtgttgcctgggagatgtccagcacgcacagtcttttcaaagggaacggtgccgacatgatgcccaccaagtgctcgacgccggtaccaagctgtggcatcaccaagtctgatgccgagagcacacctaccacactggaacatgtgttcctggccaccatgaatccgtctacaccctcagccgcatcagcagcagcggtgccac

SEQ ID NO: 25112 - DNA, 4071 bp, Oryza sativa
agtactactattattcggtgagtcccacaaaatctccttggactacagattcaccaagttcatgagtagaacgattattgtcagtgctggcttgttgcaaattctggttcctggatggtgtattggctatgcgctgcatctttctagcacattttggaattcctaccagcatatgcagcttttagcctatggttggtcatttgatgatcatgttttgttcctcccactaatgctagttttctggccaattcatgacacctggagtgaatgcttgcttggttatactaatgaagatcacgatgtccaaaaggttttgatctgtgacaagaatttgcggggagtgctaattcctacagagctcaaaattccatggccaccaccaaacttgactgttcaaaaatatggagtgttggctaaaatactgttaccaacaggattgatcaagttgaaggttttggataacatattgcgtgcacaacaatggtattgcagctccttgggagaatcactagaagatagcaccaatggtttcaccaagttgcagagtgttgaattggttcagtacaaggttgattttgctagtagctccttgcttgatattgtagtattgcaaggggatgattctctgccatttctacttcctggaagagcggttttagaatatcaagaatttgtgactcatgttaagatgacagaacaatcagtttcgaaaggtgaaacggatgtgccgaagctttgtgttctcaagttcagtttggacaaattttcaaattattcagttggagatacaatgattgctgtgttgcttacgcaaacttgtgtacaattagtttcaagctacaatcagtctttatctgggagcaaaaatcactacaaactcttgatgacacaacatatgtcagtcattgcaaactatgaaatgatttggtggaagtcagagcttggtgggggcaagattagcttgtgtgcatcatggaatttctgggatctgtgtttttgttgcaagcaaatgtctacagaaattatggctgttggattatctggtgtgaaggtatggctgttgtttgctatatcagagctgtggttacaaagaaaacagctaaaacttgcattattagaggaacatatcaaggtgctctgcaattctactatgttattcttcctgcaagcgacaatacaagcatgactacaggactatcttcgttccatcttgcacaatgcccttacatatacttctgaccaagaaaaatatgatgcacagaacagaaaatatgatgcacatatgctccgtggtaacagttcactgaatactcggaaattccctgcaacatagaaaataaatacaatgatattcaaatttacatcctgaagcccagaatacaaatgaaggccatatttgcatttgccgttccctccatgggaccttattgttcattacagaagggttttacatgtgtaagaacaaaatataaatgcctactacacttgcacaaataaacaatctcagagcccttgtgtttccttttttttcctttgttttttccctgttgctctctgtttcccatcgcaacagacgaattcgtatttttatcttgattttataggtaagcacgttttggaacgggataaatcagaggcaggtgacccttctgctgcatgcataggaccgcctcattcaaactcttcctcagtggagtgaactccaaacccaaatccttgagcctctggttcgagaacttatacggcttcgccatcggcttcccatcatcctcacacctgaaaaaaaaatccaagaaacacacgcatgagaatttgagatcgatcgattgcatctcacaagagcaatgaagcaatgcacataagcaaatcaatggctaatatctgcatactttgcagtggcagggtaccgtgggaagagctccctgagcatccggaggagctcggcgcggtggagcacggtgccgatgcagaggtagcggccgcgtgcctcggggcgctcgtagacgaggacgtgtgcgcgggcgacgtcgcggacgtcgacgtaggccgcgacggcgttggggtaggacttcttggtgcccatgaggtagcgggcgacgtggttggtgctgaagttgagcgtctgctgaagcatgggacccatcgtcatcgacggcaccaccaccgccagctccagccccctcttcgccgcctcctccgtcgccgtcatctccgccatcatcttggcgcagcagtacaggttctgcatgtacgacgagaaaatttgccgagatgaatttattgttcatgtaagcaacgctgttggagttggtagaaccgtagaacggagcagagtaatgtgcttacgtctgtttgcttgcagaattcgtagtcgctccagcaggtctcgtcgaggacggcgtcggggctccggttggggttcatgtgcacggcgccgtacgacgacgtgaacaccacgcggcgcacgcccatgtccgccgctgcgttgatcacgttcctcgtcccctccactgcaaccggaacaaggtcctgcatcacggagcagcattagtaaaagttggaggaggttaaaggtgccattgtcgtctcttttgggctcaggaaccaggctagtgaacttacagggtcgttagacaccggggaggcgacatggaagacgccgtggcacccgctgaaggcggcgcggaggctggcggcgtcgaggacgtcggcgcggcagagggagagcctctcgtcggctccctccagctcaagcaggtgagcattcttgctgtcagctacagatacgcgcatgcaagaaccgatcaataaatcaagcacaacacgcaccaaatttatgcaaacaccgtgaactaatagtactagtacttaccaggatccctggctgttcccctgacgtggtagccacggatgaggagctccttcaccacccacgacccaatgaagccacctgctccggtcacacagaccagctgcttctcgccattgttgttgttgttggcctcaaaattggacgacatggtgagagacgctgaccagttactgtcactaaccaaatgctactctgaacttgtgagagaactttcgatcgagcttgtgttggctgctgctcgtatgtcactcgaactccgtatgttggtgtgagactagcgtgtctggacacggccgctatttatacctgcagaaaccgcgcgccgccatgcgacggaggaggaggacgacaagaggaagatagctagcgtaggttggtcagcaggtgaggggtggggaggcgcagctgcgaccgggggaaccggagtgccgtcgccttgtcgactcactgttcgtccattcttcaggattcagtatttcagctgcgcgctcgcccgcaatactgggcatcacatcgcaaggccgaattcgccgatgggttggggcgtgcgcgtaggagcagtagagtatattccattgcctttctggacgaggggatcacgaagccaaccctggcacgtaaaccgtctcaggttttcgctcaacctggcgaatcttctctccaagtctacaacttgtacttttttaaaaaaaatatctgctgtcagaacgaccgacgattcgagtcagactggcacgattgactactgtccttttaaacctgacgttaatagtgctaccactaatactcctcctttttataatgtaagtcattttagtatttcccacatttatattgatgttaatgaatctagatagatatatatctagaattcattaacatcaatataaatgtgggaaatgctagaatgatttatattgtgaaacggatgaagtactattttaatgtataacgtcgttgattttttatgcaacgtttgaccattcgtcttatttaaaaaaattatgtaattatcatttattttattgtgacttgattcatcatcaaatgttctttaagcatgacataaatgttttcatatttgcacaaaatttttgaataaaacgaatggtcaaacgttggccaaaaagtcaacggcgtcatacattaaaatacgataaaaactataggacggtagaccgtctcaacggtatagttta

SEQ ID NO: 25113 - DNA, 508 bp, Oryza sativa
aggggagagggccgagggagaggggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacat

SEQ ID NO: 25114 - DNA, 366 bp, Oryza sativa
cggcaagtcacgagccatccccgacgccggccgccgccgctccgcatcagcgccgtccctcgccgcccttccgcaccagcgcctaccctcaccgatccggtgatccccatcccctagaaaccctagcccacagcgccgccctcactccacctctcctgtgcgtacgcatctcacgagccgagcgccgctgcctcctactcgccccctttccgtccgtctgcctccttcctttccggtgcgctcgacccggcgggccacggttgagcttggcgcagcactcgagtgggatgcccggccgagcgctggggttgcactccgctggcatagtggtcgatcccatccgtcgccgtcaacatagctgcataa

SEQ ID NO: 25115 - DNA, 594 bp, Oryza sativa
ctctagaggatccccttacaggcgatagccacggcgcgcgcttttgcgatcgattggcctgttgcatgatagctggcgaccgatcgagtagagatgagaaaattctcgagctcccaaccgggcgtgacctaatcctgtcccgcccgaacagtgctgcgattgccgctcccatctcgcgcggtcgcgttactggttcgccttttttttcgccaacccggccgcgcggtcgttgtcgcctcgtggaacctaccattcatcgatcggtggccgatggatggatcggtcattcgatcgcgcgaggcagaccgggcatctccacgaggcgtgcgaaaggaagggaggatggcggccggtgtcggtggccgtcgtaatcgctacctcctctctctcctactactgcttggttaccgctacagcaaagtgactgaatcaaaagatgcaagccattgcgtttacagtaagattccaaaattttcagttaagcttagatgctcgatcaacgtgccaatgtatatatacgcgtctccgtgtgcactgacacgtggatttgggcggagatctcatcgaccgaccggctttcgcgacgccgaaagt

SEQ ID NO: 25116 - DNA, 562 bp, Oryza sativa
  unsure (1)..(562): unsure at all n locations
tagggcagtcacaatgcgtcacgtaacgtagttttgaggagccaaaactgccacctagactgagaaacttcataagcaacaagctccacaatgcatgtggtctactttttccctacactgggtcccacccgttatctctcctaactttttctctcctctctctctgccgaacccagccggcgcgtcccctcctctactccgccgccggcgcccctctttctctcccaagcggcggcggcggatggagcggcggacacaagcggcggcgaatggagcggcggacacagggggcggcggcggacgacgcggcggcccaagcggttgacagagaggcggcggggcgatcccagcgccggacggagcgccggcgtattcantgatggcgcccggcggagcggcgataggacagccaaatccaccggatctggcgtcggcgtcttcctcacggagtcttcctcgcggacgacgagcggcggcgtggtcgtcctcgcggaagtcgctgccgaccggagccccgtcgccgtcctcgtcttccagccgccgcacttgctcccctgctttt

SEQ ID NO: 25117 - DNA, 538 bp, Oryza sativa
gagggagctcgacggggccggattgcggcgccggcaaccggcggcgagggaagggggaaacggcgacgaggtcatgaggggccgattcccggcggtgagagcatctacgcggctacgggaatccgttgctagcgtcggattgggcggagctacgccgagcgaggccggcgacgagcgggcgctacggagcacgggcgacgacggcggcgagcacacagcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacggcacaggagtgatctctccggcctcgggccggggaagaggaagaaggcgagcgcccggagtcctcttccatgtcctcgctcgtgccggctcctccgacacgcgcgacggcgaacggcgacagcgaacagagcacgggaggcggcgacaatggagtggaggcgaatggg

SEQ ID NO: 25118 - DNA, 698 bp, Oryza sativa
  unsure (1)..(698): unsure at all n locations
nnnnnnnnnnnnnnnnnnnnnnnnnnnnnnnnnnnnnnnnnnnnnnnnnnatgccaatgctttgcctggagcactcctactagtaagaaacataaactttgggaaaatttggtaattcagctctgtttcatgtactgattttcagttctcaactcggattctgttgtttcagctgtcaacaggtgtactattctgtccatttgacatattctaccgctcgacgcgatactgcttcatgcgtgtcatgcgcaatatcatattttcaccattctataaggtaaagactaaagacctcatgagttttcttatcacaaattgttgaaagcatctatctgataagcaggctgctttgacatgcaggttctgatggctgatttcttcatggctgaccaactaactagccaggtaatactgaagaaactgaactttacactagagcttttgagagttggagctcagcatcttatgagtgaactggtgctactatctgcagattccactattacggcacatggaatttacagcgtgctacttcatggctggaagctttagaactcacccatatgagacctgtactagtggccaacaatataagcatctggcctatgtgatctcctttctcccatacttctggagagccttgcaggtatgaatctttagatgggaaatactaacgattaacaactttgtttggatca

SEQ ID NO: 25119 - DNA, 258 bp, Oryza sativa
tacaatacgcacttctagattagtacaactaataccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggca

SEQ ID NO: 25120 - DNA, 887 bp, Oryza sativa
  unsure (1)..(887): unsure at all n locations
aatcacaccactttaggtatgctccaaacttaatatcataacctaaatagctatgaaaacaaacatgcaaaaaaacagacaaaaaaatatagcaaaaggctatagaaccctagtaaccatcagcaaaaggttggttagttgcaaaatgtggtaatagcttctgaaacaaactaacagtcaaagatgttaatgattatgaatgacacaatactttaatgtatgcaaagattcaatgtaggatgtgatgattcatcatcatcaacaatgaaaccatgtaagcactaagcagcacatattttggctttaaattcaatttaacttgattgtgcaatgacaatgaaaatagagcatgcaaatcaaatcaagtatatctatcattagatgagaagtatacacacattccaacgatgaaaatatagaattaaaaagatgcaaacgtaccatctggagatccctgcttccagaagtactctccacaagattgggacgagcacggacatcataaatgattggcctctcaaaccatggaatcataaagtgagtcccctcagggtatacctgtaggtagtacatgttaaatatatattagtcatccagctatgttaaggtggattgaactgaagtattaagcgcagcacaaggaaagggcaccaaaacttagttcacatgatagcaacaaaaccttgagaactactttacacaataagaatacaggtttacctagtgcgaaagatccacgcaaagctctgatgcacaggaaagggaggactcacaacagctcttttttatactaaataagatcaataattataatgatgaagacataggcannnnnnnnnnnnnnnnnnnnnnnnnnnnnnnnnnnnnnnnnnnnnnnnnnnnnnnnn

SEQ ID NO: 25121 - DNA, 269 bp, Oryza sativa
cgcgcccccgcgcggtcgccgccgtcgtcagctgcttgttgcccgtgcctgtgccgtccggccccgcgccctgccgcgctgcgccgcctgcgctgcgccctgacccacgagccagcacgcctggccgaggcacgccgcccgcatccgtccaaaacctgaggcagcgcctcccgctcccatctctctcctccccaaattggcatagcgcgagctccctttcccccccttcgtttctacctttcccctttcggcctggcccctgcttcccc

SEQ ID NO: 25122 - DNA, 5553 bp, Oryza sativa
ccatatacgataaataaaacagataaagccaaataaataaaagaaaacatgcacacgtacctagaatcggaaagaaatactaatcgtgaaaaatcacactgatgtgttgtcaacatcctttaaactattattttattaaaaataacactacacagatatgcacattaaacttaatctctgatagataaaatgtcaaatcaaacgttttgttgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaaatttttttattgctatttgaggagagagaagcatacatcatagatatatgtaaataaacaaataaacaaataagaattaggcagttattttgctacaatacaatccttaattcatcatgagaattatgattatccatgtatgttttttctttgccaagtagtattggcaaacaatcatgtaaaacacgtataaaactataaattctatatactgagtataattgatggacgaatgttatacacctctgaacccaattttgtcaattctttacctcaaatcgactcaaaacataaaaataatactgttttcgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatgcaatcatttgtagtgtgccaatagtgaattgagtgttaaaattgtactttaagatggtctttaggggcacggttacatcgatgcgagacccgtgtttcaaggcattatgtaagaaagcctaggttggctgctacggtcgacttcatctgttagaaaatcattcatgaatatttttaacggtgttatcgtattatctagtagatatgatatttttagacaatttatacatagatgtgaaaataagttatgcataccgggttatgcagtgtagatgatattttttgtgtataaataatgtatcatttattttagtggtacaaatacagtttcttttattaaaagtgtacctaactttcaaaaacaatgataataagtagtggtgataaaagacgagtttatatatgaccaggacaaagggatttttacttaaatctaatagacattctatcacatttagtaatctataccgtctattttacggcaaatatatttgtttttttatttagggtaatctacattcccttacagggtatatgtattaatgtatatactaagatatgatttattttagcattctttttcttgaacaacaaataagatgcccgtgcatatgtgcgggtttcctttccgatttatattatgaaaatatcctccattttatattttgtccttacattgtttgaaacatagcctatgatacatgcatgcgcgcgcgaatgcgcgggctaccttcctagttagttcataattagtgatacagtaacccatatgtgctaataacggattaattaggctcaaaagattcatctcgcggtttctaggctaagctagttataaaattagtttatttactcatatccgaaaatctcttccaatatccggtcaaacatcagatgtgacacctaattaataattttcttttggctagctaaacgggcccttgcatacttggacatcgtatctgttcttttgaatatcacacagccttcctcacagaccagacgacagagcgtatggctagagggcacgaaccgagagttactaccattaccatgaagcatctacctttcctcgtacacctgttcttcctcctctgccttggcctgagcctcaccacgaggtgcgccggcgatgtccagttcatctactctggcttcaccggcgccaacctcaccctcgacggcgtggcagcggtgacggcaggaggcatgctcgagctgaccaacggcacgctgcagcgcaaaggccacgccttctacccggcgccggtgcccctccgtggagccgccggccccaacgcgacgacgacgacggcggaggagtccttctctccacttccttcgtgttcggcgtcatgtccgaccatgtcggcctgagcgcccatggcatggcgttcgtcgtggccgccagccgggacttctccagcgcgctgcccagcgggtacctgggcctcctcaacgtcaccagcgacggcgacacgggcaatcgcctgctcgccgtcgagctcgacaccatgcagaacgacgagttccgcgacattaacgacagccatgttggaatcgacatcaacagcctccagtctctgcgctcctactctgccggatactacaacgacgacgacaacaacaatggcttccgcaacttgaccttgatcagtggaaaggccatgcaggtgtgggtggactacgacagagagacaacgcggatcgacgtgaccatggcccccctcgccgtcgccaaacccaagaggccattggtctcagcgaggtacaacctctcaaagctgctcaaggatgtcgcgtacatcggtttctctgccgcgacaggaggcacgctgagatcacggcactatgtgctcggctggagcttcgggttgggccgtcccgctcccgccattgacatcaccaagcttccgaagctgccgcgaactgtcagcaaggaccggtctaggattttgcagatcaccctaccgttatcaactgctgctttcctactccctgtgggtgcagccgttttcatgctcgtccggaggcatcggaggtactccgagttgctggaagattgggagattgagtttggcccgcacagggtcttgtacaaggatttgtttcatgccacggaaggattcaaaaacagctgcatactaggcataggggggttcggaagggtatacagaggggtacttcccacgtctaaatcggaaattgctgtgaagagggtgtcacacggatcaaggcagggtatgaagcaatttatcaccgagatagtcagccttggttgcctccaacaccgcaacctagcttgtgcaactacttggctattgtcgacgcagtggtgaacttctcctggtgtacgattacatgtccaatggaagcctcgacaggtatttgcatgatgaagaggggcaatgcagtttggattgggttaaaaggatccacatcatcaaaggtgttgcatcaggcttactttaccttcatgaggagtgggaaaaagtggtcatccaccgagatattaaggcgagcaatgtccttcttgacagtgaaatgaatggacgttttggagactttggcctcgcaagactatacgaccacggatctgatccaaaaactacccacgtggtcggtacaataggttatatagctccagagctcggccggtctggtaaggcaacacctcttactgatatatttgcctttggtatattcattctagaagtcatttgtggccaaagacccatcaagcaaagcagagaaggtcatcaaatcctacttgttgactgggttattcaccattggaaaaatggaacgctcatcgaaacggtggacaaaagactcgagggaaaccatgacactgatgaagcaatcctagtgctgaagctaggactgttgtgtgcacatccatttagcaatgcaaggccaagcatgcgtcaaatcgtacaatacctcgacggtgacatggcattacctgagcagatgccaacagaccaaatctccaatcagacggagggcttagaccagtatattcaaacagggcctcaatcaacaattccagtcaatgcaagctatggcacaatgtctaacctttcaggtggaagataatttaacaagtgggcattaacacctttaagtgttgcaagacgatgcatatgttattgcaagcagatgatcttgtgataggggaggtgatttgtggttagctgcttcaactaattaaatcgttaagctttaaaatggtgaattgtattcaataaaaatcaggtgatagaaaaagacagtcatgtgtactcctatttctgtgctagctagtgctaccatattttcattagttcaagattttacatgttgtggacttggcaatcccatccctcaagaatggcatttaatttgcatcgcactaatgatgtacgtatgtacatatatcatcctagtttgcaagaaaggtacgttttggtcttgaatgaatcatggtcatcattttgtaaatgttgaaagagatgggtcgagactttttctgcaagtttcttgtactaattagcatcacttttgacggacatgtatcatatcaagcgccccggtcatcacggcatgagatttacgagtacatacctgctctgtgacgcatgatcgctacagtagccgtactatacctcggtgcgtgggatcagcttgttgatctgttgatctggtaacccgttcctacatgcatttgctaagtctccgagcatatagaaataggctatttccaaaggtgtatgtgcaaaacaatttaaagaacctcctgtgtaaatagctaggatttctacgggcggagtttttcaccggttgctctttaagtaatggtaaaaattacttttacacatgccatctactacatcattacccgtctgattcaagtcatatatgataggcgggtgacaatatttcagcaaatagcgaaataatgtttcaattcactgtaatatttgatccataatagcaaaagattatgagtatacactaggtgaaacatttttttggaaaaaaaatgaaatggattcgcttaatagagggtttctataatatttaggtgatttgttgcgaaagaatatttcaattcactgcaacatttcatctattcataatgaagcatcataagtacactaggtgaaacattgttggtggaacaaaaaattgaaacggattctcttaatagggtttttccgtaatatgtggggatttgttgcaacagggtgagagtgactagtggggacgcatgggagacaggcggagatgccggggggggggggggttgggggtgcccgatttttctaacgagcgttgggcgcctgatccaggcgttttcccaatggcggccaagcaacgcactcgtagctgtatggatagctagatttttcacattttggtccttttaaaaaacttatttcgtaaatagacctctagaaaaacttattctagaaatggtcctttttggggcgccaaagtggctagcgccgtcctcctgccacagtggcggggcaaaatatgtgacttgtaaaattttctaaagctctaccgaaatggacaaaatatgtcatctatctattacatactaaaagtccattaaacttcctacaaacgctcttaagccg

SEQ ID NO: 25123 - DNA, 2547 bp, Oryza sativa
  unsure (1)..(2547): unsure at all n locations
tgaatatttttaacagtgttatcgtattatctagtagatatgatatttttagacaatttatacatagaagtgaaaataagttatgcataccgggttatgcagtgtagatgatattttttgtgtataaataatgtttcatttattttagtggtacaaatacagtttcttttattaaaagtgcacctaactttcaaaaacaatgatgataagtagtggtgataaaagacgagtttatatatgaccaggacaaagggatttttacttaaatctaatagacattctatcacatttagtaatctataccttctattttacggcaaatatatttgtttttttatttagggtaatctacattcccttacaaggtatatgtattaatgtatatactaagatatgatttattttagcattctttttcttgaacaacaaataagatgcccatgtatatgtgggggtttcctttccgatttatattctgaaaatatccttcattttatattttgtccttacattgtttgaaacatagcctatgatacatgcatgcgtgcgcgaatgcgcgggctaccttcctggtttattaaaataggcgtaactttctcatacggactcggaatcaggcaaataatatattcacggatatctacagaaaaagttacatcngattcncggcatcgccccaccacgtcggcaggggnacggcgccanagagncnggnnccgtcccattggacaacggcgccaacctctttgacgcccaaaaagaaccatttctaggataagttttttcaggggtctatttacgaaataagtttaaaagaaccaaaatgcgaaaaatccaggtgcggatagtgttacccgagttccattttcttgcccgatgaccaatgccaacggcagtaataattaacattgacattaattgggatcgtctggtgtacaccttttctgcagcatcaaaatatcttctgcaattattgtacggtttctactattacatgatggggatgttatgcttgacaaaggaaaacaagaggaacctccttacactagtaaaacaaaaaacattttttcaaatggttaaaaaaaatttcgtgtgtgattaagtcgcccgtctagtgtgaaaatcactatttttctacacggttagcaaacacgcacgcaaaattacatatcccactatagtactccctccgtcacataatataacgaaattttgaatggatgcgacacatcatatctagattcgtagtactattatgtgtcacatccacccaaaatatcttatattatgggacggagggagtatcatactcaaactacatagcgctcgcgatctgacgacccacctatatatactttcttttttcaaactgcaaaagctagctttaaacatccgttatactccctcggtcccaaaataagcgcagccatgagtttccatgtccaactttaatcgtccatcttatttaatttttttttagaaaaagctaaaaaacttaagtcacatataaagtattattcatgttttaaatctaatagcaataaaaataataattataaataaaattcaaataacacggacgatcaaagttggatacagaaactcatggctaatctcattttgggagggaggaagtatgtcttaatacaaatgtgacccgccaagcgaaaatctgtcaaacaaagagcacaatgatggaaatatattatattaaaccctgagggtttctttcttcaataattcaaggcgtggttaggctgaacttcacgagtctacgagctttcacatacctatcaagctatctcctattacaaaaaccatttgatttaatacaggaccccagaaaatatcttgttggcacatgttacctgaaatattaactcatgttttgtattttgaaacatataatgctttggagtcgtttaattatttgaaatatatgattatttttcagatagattatttgaaaaagttttctgcttcccatgagtgatttattggaaacttctaattccacaaaaatatttaaatctctaaaacgtctgaagtcatgtcttgagtatcaaatttgttggagcggtgcatccatatacaaaatttatattgatttactgatcatgtcaattgtttctaataaacaacgatacagtaagcttattctgaatttcacaagctagatgcacatttgcaatgtgaacataattataagtaaattatgctacactaaaacacaataatgtatttctcggaagttgttcttatagtagaactataaatgatatttttagaataaggatgtgttccttccggttcaataattctgtgacattttgaactcttataactttaactatcaataactctaaaattattttgcttaaaacgtactagaacaacatattagatttgtcttactaaatattatattaaaagtaaaaaaatatttatttattatatatattataatagaaaacatagtgaatgatacatttaggaaaccatgttattgttcaaaacatcaagatctatggaacaggacgcagtaca

SEQ ID NO: 25124 - DNA, 4392 bp, Oryza sativa
  unsure (1)..(4392): unsure at all n locations
nnnnnnnnnnnnnnnnnnnnnnnnnnnnnnnnnnnnnnnnnnnnnnnnnnnnnnnnnnnnnnnnnntttaggaaaccatgttattgttcaaaacatcaagatctatggaacaggacgcagtacaatcatgttttttgcactgcatatattctggagtggtccagtctattcatataatcatggaaactaagtgtaaactcaccccttatttattttgcatttgacagacatatatgcacttgcagtaataactagctaattaacaccatttcttatactacctccatcccaaaatgtttgacgccgttgacttttttaaatatgtttgaccgttcgtcttattcaaaaaaaatttaagtaattgttaattctttttctatcatttgatttattgttaaatatacttttatgtatacatatagttttacacatatcacaaaagtttttgaataaaacgaacggtcaaacatgttacaaaaggtcaacggtgtcaaatatttagggaaggagggagtagttaccttccacctaagaggaaggatacggtgccaatggttgctgcagacgatggatatgacattggatatgagtcgaacccttcattctgcattagagccattgtgctaaagctcatatttgttgatgttaagtctgggagtggagtgtcaccatcaaggtattgcatgacttgtctcatgcccggtctcaagttggcagatgggtgtgaacacagcagtcctagctttagcacccggcatgcctcatctgtattacagtcaccttgcaacctcaggtccactgtctcattaagagagccttttttgaaatggtcaagaacccagtcaactaacatttcttggttgtatcgtccactatcgtcgttgaccggtctttgcccacaagttatttcaagaagaaacgcaccaaatgtgaaaacatctgttagtttggatgccttaccggtccatattagttctggggccaagtatcccattgtacccaccacatgtgtggtttggggatcggtgccatggtcatacaaccttgagagtccaaaatcacctaagcacccattcatttgatggtcaagaagcacattgcttgcttttatgtcacggtggatgacaactttctcccacttctcatggatatagagcaagccagacgcaacacccctaatgatatgaaacctttggctccaatcccgtaaaggcttatcctcctaacaatacagatatttatcaagactaccatttggcatatattcatacactagaaggagttcaccttttcttctacaatagccatgtaattgcacgaggttgcggttccgtaagcggccaatggtgacaaattcagagatgaactccttcataccctgccttgactcgtgagaaaccttcttcacggctacctccaatctagacttccgaaaaactcctttatacacctggccgtaaagtcctgtacccaggagatgtttgctcttaaatccattagtagcatgatatagatccttatatgagaatcgatgggggccaaattcaagctcccaatcttcaagcaactgagcatacctcagatgccttaacacgagtagggtggcaatggtaccaagactgagcatgactgttgctgtagctattggtaggacgattactaagaccttggatggaggcttgggtccgaaacacggcagcttaggaagattggcaatgttaatcggcggagcagggccattcatggcaaagctctagccgagcaggtagtgccgataattgatctcgctagtcacagatgagaaaccgatgtatgcccactccgtgagtacagttgagaggtcatacttagcggaaacaagcggcttccttggtttagccactttgattggtgccaaagccacatcaatctgtcctgtgttgccatcatagtccacccacacctgcatcgcttctcggctaaagagggttaggttcttgaagacgccattgttgccgtcatcgtagtagctagttggggaggattgcaaagagtgaagattgttgacgttgatgccaacgtggttggcgttgacgtcttgaaaatcggtgttctggacggtgtcgagctcaaccgcgaagaggtggttggtcgtgttgccgttgttctggacgttgaggagggccaggtacccaaccggcagtgcggtggtgaagttcttggtcggggacacgatgaaggccataccgtgggcacagaaatcggtgtagtcggagatgatggcgaacacgaaggcggccgagaaggaccgagctgtgccatcaggcgatgtgcggaactgcagaggcgcggggaagaacgcatggccttttaggttggtcttgcggctggtcagcacaaggatcccatctggcatgacggtggcgttgccgtcgagcgtgaggttggtgccggtgaagccatgataggcgaactggaagtctccgctgccggaacacaaggcaagtgctaggtgaagaaggctgatgaggcgcaagaggaagaacgcaggcttcatggtcgtatgtggtgggggattgtgcgagagggcatatcgttggccacactctctaataaagcacctttcactagtcaatccttaattaagaggtgggatatgatagtcttggcagccaaacgtacgtgtcgagatgtctatgtggatatatagctgtagtgatagtgtattacagtatcacaagaaggagaatgccaattctaatctcttgtcatggcatatagtatttttctgttacataaaaaaatggttttcatttaacgcccttaaaatatttgttggctgtgaagtgtgcatagcttaattgattaggcttgctctggtggaacctacccactcaggtttaagttctagatttgatttggttctcgcatttaggtctaatattcttttagtgatgtacctttcaatagtgttcatgtgggtgtcgtgtgcgtttataaatatagtgagtgtttccatttgtactatatttttttaaaaaaataatcgttggctccctgcaccagtttagtccatgaattactgagatgagtcactttacccctaataatatttcttttttttccctctctttgaactttaaaatacaattaggaagatagtccgcgcattcgcacggacatgtatcataggctgtgtttaaaaactataaatacataatataaattggagaatatttccggcatataaaggaaacccgcacatatgtacgggcatcttatttattgttcaaggaaaagaatgttaaagaaatcatacatcactatatatacattgtaaggaaatgtagattattctaggataaaaatagacacatatttgccgtaaaattgacagtagattctaatataccactaaatctaataagaatgtccctcagatttaaataaaaatcccttcgttctaggcatatataaattcgcattttgtcaccactacttattatcattgttctgaaaattaggtgtacttttaataaatgaaactgtattagtaccacaaaataaatgatacattattaatacactaaaagaattcatctacatcgcataacccggtgctcgtcacttaatttcatatctgtatataaatagtctaaaaataccatatgtaccggataatacaataacactgttaaaaataaacatgaatggctctctaacggatgaagtcaactttagctgccaaccaaggctttcttatgtaatgccttgaaacataggtcccgcattgatgtagctatgcccctaaagaccatcttagagtgtaattttaacacttagttcactttaggttaatttcgaactcagtgacaatggagagacctaaagtgaacttattcgctaggagctagcctccgtatcaaccgccacgcactctgggctttgcctgggccagaaagaaatgtgtaaccagcattgctagctatttgagctaacggtacttgtaagcagtaattggcttgcaactcctgtacgtgctcataactggcttacatgaagagaatttggagcagaattactatccctgcgatgatgtatgtgttgatccatgttcagcaaatactctcgaatgcacaatgacacgaatgttatatatcttgatctgattggcatagctctaactcctaacttcaacttacctttaactaaagttatgccaaacggtcaaaatcctatgtttttttgagtggggtttgtagagttactcctagaaaatgaactaagagggtggagccgggtttttactgttccatagccccactccacccaaaaaacccactgctctttaannnnnnnnnnnnnnnnnnnnnnnnnnnnnnnnnnnnnnnnnnnnnnnnnnnnnnnnnnnnn

SEQ ID NO: 25125 - DNA, 38643 bp, Oryza sativa
  unsure (1)..(38643): unsure at all n locations
cttgtaagcagtaattggcttgcaactcctgtacgtgctcataactggcttacatgaagagaatttggagcagaattactatccctgcgatgatgtatgtgttgatccatgttcagcaaatactctcgaatgcacaatgacacgaatgttatatatcttgatctgattggcatagctctaactcctaacttcaacttacctttaactaaagttatgccaaacggtcaaaatcctatgtttttttgagtggggtttgtagagttactcctagaaaatgaactaagagggtggagccgggtttttactgttccatagccccactccacccaaaaaacccactgctctttaattattagcaaatttttctaccggacatcacaattttgtggttttaaccgtaggacaccacacaaaatcatttttgggaaacacactctgaaaatatggttatttgctaggggacactctatccattaaattaatgttttcgtgttgactagacgagagtgggctcacatttttacgtgtcttgaccaaattacccattctttctttctcttccttatctgaaatctctccctctctcttttttatctcttctcccggcggatggcgtggttggcagcgtcgacatcgacgtcagcacccggagcgcgtgtggcctattcagcggcggcggtggcggcagcctgctcggcggtggtggcctgttcagcggcggcagcacgcacggcggtggcctgctcactggcggtagtctgctcgacagcagcagcagcctgctcggtggcagtgcccggagcgcgcgcggcctgctcggcggcggtggcggagcccgaagcacatgcggcctgttccgtggacggtggcgcgcgcggcctgctcggcagcggcggtggccacggaccacgccagtgcgtggatctctgccaccagtccaccacggctcgctcggtgtggacaactgcgacaatgacgactctaaagtgccccctgtacagggaagtgacggagggaggtgtcggacgtatgtgcctgccacagtacggttcggcaacggcctcgccattgcgagagcggcagcggcaccggcggatgaccacgacacatcatgggcacgtggtgctcatcgtggtgatgttgctgctgttggtttggtggtgttgctctccatggttatgctgctactagctgctggttggtgatggggaagaagaagacgcactccaggcagtagatgtccaaccactcctcattcgccgatagacagagaagagagatgggagaactaacatgtgggtccagggatatttttgatattttatacaatttttctctcctctctatctgaaaattattattttaatgggtgcagtgtccgctggcgacttaccacgtatatggagtgtctttccccaaaagtcatttcgtgtggtgttctacaactaaaacagtaaagtcacgatgtagtgtagcaaaattttctttaattatttgacgtatttacgcgaaaatgccactgacctaccccaacctccttacctccctacccgacgaccgggcgagcagaaggccacggcattccggcggcggctcggcgatgcgcgtgcgggcagcagggtgacgacggtgctccggcagcggtgcgcgaacggccagcagggcgacggcggcacttcggcagcggctctgagcgcacaggcagtaggccagcgacggcgcagcttggcgacgcgtgggcgggcagcagccgcagcgctccgccggcgtcgcgcggccgggtagcagggcgacggcggtgctccaacggcggttcggtgcgcgcggccagcaggctgacggcggcgcggctctgagctaatcccctagaccctttttccttttttttttcaatttcaaatctgcacaaaaagaacaatagggtgattttgcatgtatgttgtgggggatttcttttttatatgaactatatagatgtgaaaaattatcatgtgtttatacaaattgaagtgagaacaaaatggtagactatacaaatttcaaatctaaaccaagaaaacactaggatgctttcactaattatgtcaattattttggtgattaagttttaaccttataattatgttgctgaaattctaaataaaaataaacatttatcagtcatacatcacggaaatagaaaaaaaccacaagggtactattgtcaacctccccctatgctctgtttctgaagttctgaagcagagtaagcttgtcaaacacttttcacatgacatccaactcccacaggagcgagtgagagttaggagctaggagttggaatttggagccctcccaaacaggccttcctgcataactagctttgtcctgtttttgtacgttgctagcacattgtgatttaaactatacaagacaaaggtgagaaaaataagtgaaaattcctttataataattaataggacgttcccgtcattaacttaaccctacaaacattgcttcattgcttgaaacatctaactaaataattttaaattctatcaaaattttatataataaatcatacgaacatcttatataaacagtaccgtggacgtgttctcagccatacttaaaatgtgttcttgctggctttcccaaactcaccctccttgttttttgcaaaaatattctatacacaagttgttttagaaaatcatattaatcaattttttttaaaaaaataatgcttaattaatcatatcactactagaaaaacgattttttatggcgttggcctaatattttctctggcgataaaatgtgaaaaccgccaacaaggttgtaacgaggggtgggaggcaacgaccgccagcaaaaaaagattttcgttggcggccgagtaatacaggccgccagcgaagatttttttattttcgctggcggtaccttctaagtgccgccagcgaaaataggttcatcttcgctagcggtatgatgatatggaccgccattgaagatgaacctattttctctggtggctctctttagccaccgccacctctatcattttatatggcggtgcattaagtagtccaccagtgaaaattggttctcctatataaggccgtgcccaagctaccatgccatttgagcacgattttctctctcttatgaactcaaacatagggggagaagtttttgaactcgaatggtttgatagatattttgtaccaaaaggttagttatactttatagttctccatttctcaattttttttttcatttttatccgttctatgttgagattttgcaaggtcaagtttccaaggcatgttcgttttgatttgttttgtggtgttgaaaacggtcaaaattgttatgatatattgtacatgatcaatgtatatagatttcacaatgttttgatatgtttatttatagaagatctatatggcacggttgttttgtgcactttaaatctatatatctggttatgaaagagaattgagagaaagaaagagggtagtttggtaattttatctagttttttctagttgtatgtctagttgtcatgtattgggaatatatgagtggtagtttttttttaaaaaatgaagtcataatatagttttaatttttccgtgtttatactaattgtaatatttttcacaatgtttaatttatttgtttacatattagcataattattttaatgtgacatattattaaaactatttaaactaagttagtttttttttctcaatgcatagacgatggcagacagatcatgaatgttcatgaatgtatagagagatatcgtgcgtcatatattgtaggagtcaatatatttatgaaagctgcgaagaaaaatgctgtagctaagaagacaaaggaaattaaatgtccatgcaaacactgcaaaaatcagaaattttggaatgattcatctgtaatcgagcaacacttggtgacacatggatttgttgaaggctacacaaactggtcacaccatggagaaatccctgcaagcttccaagttcccaaccaagagatagtacaggatgaagtgttcaatgattggaatttcatggtagtagaagaagaatcggttgatgatgatggttatgacacagctaatgatgttgatgatggtcatgtcacagtagatgatgctaatggtagtgatggaactgcttttgatttggaggagatgttgcgccatgctgaacctgagacaattttcactggcggctcccttgagaaagccgctagcgaaaatagatcttctctagtggttggactccgccagagaaaactctacatcttcactggcctttactctctggcggcgcctagtaccgccagcgaaaacctgttttagctgccaaaaaaacgtatttcgtagtagtgtatggtaacgagttgtttcgttttgcgtcgaagggattagttctcaacgaacgcaccctgtatgggcagtgatatataggcaagtacgcatgcagccttatatgggtagtcaaatgtagtcacgaattaaactctcccttaggtacaacatatgcatatgccactttcttcatgagcaaacatcgctatggatgctagcaatgttgcgccgattgatcgaaatataggtggcactaggaagcatgccaaatggatttgcagccaaactattactggtgtaagcatgcaatagcctccatctacacactcccagaacaccactcaactcacactacttgaaaaacgatttttcatgacgttatcctattttttcgctgtcggttatataagaaatccgcttgtaaaattctgatgagggatagtgtgtttagaaccgccattttcgctggcggtgagtttagaaccaccagtgaaaatccgttttcgctggtggtaggttaagaagtccgcttgcaaaaatatcccaatttttgctgacggacctcagcgaaaatcctagtggaggaccgcgccgctctggccctttaaaaaatcgcggcattaaaagtcgctccacctacccatccttatctcctccttccactccctctctccctccaactatctctccctccatccacaggcatgagcggtgagctcgggcacggccagcggtgtgcttcggcgcgggtagaggaaagggctggcgcgggcggcagcgagctcgattgtgggcaacagggagggcggcggcggagcttgggcgaaagggagggcggaggagagggctggcgcggtcggcggtgagctcggttgcgggcggcggttgtgaaaagaccttaatgtcgcttagagggggtgtgaataggcgttcctaaaaattatcacaacttcatagcatattagaattatgagaactttcggttcaaacaggaacttccgatatgagattggaagttccggtctcaaccgaaaagttcggcggataatggaataaaacactagctatgaacttgtagctcaaataaacaaaatgtatatgaatcaaaaagtgacaaataaggtatctaaacaagatataaggtcaccaactaaatcaattaagcatgcaagtagatcgggtaaaaacaagctcaagcactatgagagaatacacaaatggacaaaccaagagaggagacgcatgatttgtttcccaaagttcggatccacggatcctatgtctccgttgagtagacacaagggccgggcctatttcaaccctttcctcacgaggttgcacaaatgcactcctcggtttcactcttgatttcttcccttgcggaggcgaaatcgaagttttcacaaactttccgtggcacaccacaaccttgggtgctcaccggcgacgcctagccgtctaggagaccttagtccccaagagtaacaaacataatcgaagatttgcttgctatgaactcgagtgctcaaagtatggagtgaagctcattagctctcaacttctcaatcactcaatccaactctttcctcttctcaaatccctctcacaaagaggcaccacaaaggatggagtgaaactcactagctctcaactcctcactctctcaatccaactttctctctccccttctcaaatcctcctcacaaagaggcaccacaaaggtagggaaatggggatggctatttggctttggatgtgtctaatactccccaagagcagcagccactcaaaggtggggtggaggagtttatatacccgagcctcttaaaaactagccgttggaggccaagactgtaatttttggatttttcgaaaagcattttcggacaattccgaaaatctacagaagcaaatcttggattctgtagatttatccgaaaacttttcagagttttcgataatttttcggactttccgaaaagcacagagtaaaacaactataacttttcgctcgggagtccgtttttgatgatcttggactctatggaaagctcactcagaggactacccaactcaaccaaaaacaaggtctaaaaccactcaaaggataggttaaagcttaggtttctctcaagatagcactatgataggtcactttgagcaccgagacatacacaaacacctcgaagttgcatccctcttaatagtatgacattcctaaactcaaatgtaaataagaagataattataccattaggaatacctttttttcatctttcttttattgtcttaagggatgccaatgccgataccgtttcaccatatattcttcaaatgattgatgcggttacttgtagcttcaaatggtctcgcacggtccattatgacaaagccatcactcgacctttaccaccggatttggttcttcggcgccaagccccttgcttgcccttcaccgccgcatggtccatcgcgatcgagcatcgcttgcccttcaccgtcttgccataatagctacttcgtatcacacatcttcaatatcttcactttgtcattcttggtattgttaggtgtaattgtatcacttgaacatcaacatctttgtaatccttgggacctatttctttcattcaactcaataaaattattagtcccaatgatccggttgtcaacctccactgttgaccaaccgatcgcatgtataaaaggatatgaataaatgatgagtattaatcaacaccacaagtgtcatatactcaaacatatgttcaaatgtaaagatcccaattaaatgaaggtgaataacttggatcgattacatgcataactaaagtataggatttgctccccctaaatgtatgcatacaaaatatttgtgtgaagtaagagtatgcataacaagatattaaacattgagagcttatcctatacaagaatagaaggcatttatcaaatatagacaataaaataaaaacataccttcatcatctccatgttctcaatgtaaagagactaaacaagatatggctcaaacaaaacattagtctcacatgctgtagcgcccgttccgtcgtggcgcctagcgggaaaaattaaattctaaaaaccctaattgcgaaatctgtttcgttgcttgttgtcagtctccatgccaatccctgatctcgaatccccaatctatcgtcaaattcaaatcccgaatccaaatctctccaaattcaaatccctctgtaaaagtctagtttgccttcctcaggttcggtgggccgatttccctctcggcccatatctctctctctctccgtcagctctcccctcgctctgctcgtgcgccgcaagcgcgtgcgcgtgagccgacgccgagccgagctctttctctctctctctctctctctttctcgttctcttgctctcgctctccccggtccatccccggcaagctcacggcgcgccattgcgtcgcgcgcgcgcccccgcgcggtcgccgccgtcgtcagctgcttgttgcccgtgcctgtgccgtccggccccgcgccctgccgcgctgcgccgcctgcgctgcgccctgccccacgagccagcacgcctgcccgaggcacgccgcccgcatccgtccaaaacctgaggcagcgcctcccgctcccatctctctccctccccaaattggcatagcgcgagctccctttccccccctccgtttctccctttcccctttcggcctggcccctgcttcccccattctgttcccgcgccatggacgcagaggagcagccgcgccagccgtcgcccatgccgtttgaccccacgcccgtgagcccatcccttctcctcgaagctccctcgccccagcactgctccgaggtcggtttccgaaccgacattgccaccccttaaaagccgcccctcccctctctctctcgatccccctgtttcgctcgccgttcgttgtcgcgcgtgtcggaggagccggcacgagcgaggacacgtgacgtggactccgggcacaccctctccttcctcttccccggcccgaggctggagcgatcacgccccgcgccgtcggccatcgtcaccgcgccccttcaccccgtcacggtagtgctttcctccgttctgcctcctcgctccatctcctccccttagactcgggtagtagcacgagtagaccccccgtagctatctggcgccgccccaagccttgccgccgcctattgtgtgctcaccgccgtcgccgcccgagctccgtagcgcctctcgtcgctggcctccctcggtgcatttcctcctaatccagcgcaaggaatggattcgcggagtcgcgtagatgctctagtgcgaaggaatcgaactcccgtcacgccgtcgccgtttcccccttctctcgccgccggttgccgccgccacaatccgccgccgtcgcactccctccggcgaatccgagccgttagctcgtctcctctagtcccgcgctacctcccggtgtgttcgccctcgcccgcatccccgtatatcgccccgccgctcgccggcgccatccgccgtccgttcgcggccgcgtcgtcgtcttcctctcgccggtccgcgtggcagccacgtcggcgccagctcggccaagaccgggtcaagcagaccacggccccccgctacccttcgccacgctcgcgcgcgcggtccaccgcgagccgtgaggctgcgcgtgggcccgccgcatccgcatcccaccgcgagccgcgcgcgtgcaccgcgccccctccgaaccctagcgccgcgtcgcgtgctcctcgctcactgtgagccgagccgccgacaagcgggtctcactcgggaccacgcgaggtggacccagcccaccggttccccctccctctctccccgcgcgtgccctttggccgccttctcgggccggccggccaatttagctcggccaagccgcccttttctctcgggccgcgccctagccgcccgagggaagtctatttcccctccctctctcttttctttttccaaaagggtttaattaaatcctttgtcctttagaccaaaaatccaataattttagaaattcaataacttctcaaccgtacatccgtttgactccgttcaacttccaaaaatcctcaaatctcgagatctatctaatggcacgcctataggtcaataatagggttttattttcgccatttgttgagttgtcccgtttcacgtgtagttttggagcccgaagacccgcagtgcgaggatttcgaggatcaagctcaagatctcgagcaaggtaagtcacctttgatcatcttgcacctataatttaaatctaagtatttcttttccgcaaatattgcatgaataggtttaacacaagtaattcggccgcggcttgcaagatagcctacagaccccaatcctaattgctgcaattaccctccttgaattattgaacaattaaaactcctttgtcgacttttgtgcttcgatgcacgggctttcgggcacgcgcattgaaacacctcccctcaaatataaaatatccaacaatgggtaaaacttggggttttacaaaagacttagaaaaacctgacacctgggtcggtgtttgcgaactaaatgaatttccaaaaccgcagaccgggggacgtaccgggagtacggtttcccgctcttgcacttaaggaccgtttccttggaatttcatccgaacataagacaagtgcgaccacatgggtgtaatggaacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcatatggtgaacctgtgtcggctttcaaaatgccttgtcatgaaagcctcaaggtctccagacgtggccgttctgcacgggctgggtgattcgggttagtaatgtcatgtgggtaaagtgtaccccctctgcagaggttattaaactgttcgaatagccgtgcccacggtcatgggccaatgtgaggtgattcctagcgtagttttgtttgactacagcttgtgaacttactgttgtggaatgggttcgatgtttggaaaatctgcggctgatgggatcagccaggcccgggtggccgtttgaaagctgttggccgggtgccaaccttgaaccaattcaaagactgatacattgcacatactccgaccggacaagacgcactgtctcatccgtgtcgtttgagaagcactcacttagttgtttcaaaaaggagtttaaataaaatcaattgtaaaaacaacagcctttcctttgaatcctgcattaaacacttaattcccatggcttgctgagtactcctgtactcagccttgctctatataaataatccccccagttgctgaagaagatgaagtggatcccgctgatgaggagttcttccaggagcaagtcggctacgatgagttttagggtttcggcctagttcccaagtcgcgcctatgatgattggtccaagtcttggcttccgctttcccttttgtaatgcatttttttttgagctcgggatctgtccgcagcccaacatgactgtactcctactctgtaataaagagatctctgttgctgtgatattctgtcttcctgtgataccaacactgtttcctgggactggtatcgattaacaggttaatttggagcgtcacgggctagttccgtttggggctagttcggggcgtgacacatgcttatgtaatcacatgaaaatattatatataaatatatcaatatgtgcacggataaaaagagtggtacatatagcttgatctccatacatttcatccttgtgatttaggtacaccatcaatgaacgtttttctcttaactcatatgaagtccagaaatcacctctcacatattccactttcatatccatatgagactagtagacaaagaaatgcttataacaatgttagtctcatgtaattggatttgtcattaatcatcaaaaccaaaataatggcacttgaactttcaggttagcggcggcggagctcgggcgtggcggttggcggtgctcgggcgtgggcggggaggtcggatctgccgccgccgcgccgctgggaggccggatccactgtggggacaaggccgtcgccgctgcaggggacaaggccgctgccggtggagctactcctcatccaggtctatcacctcatcacctcccaatgtcagcacccatccgttcttgcgcttcgattcgccatttttgttgacacggtaatctgaaatccgtgtgtggtggtggtggtggatgcgcagaggtgacgaaggcgctgtgggcgaggaagaacgagaagatgcggtggtgcgagcctaggcagtagcatgaccagctccagcgaggcgacccgctcgccgatgtagccaaggagagatgcagcggcagtggcgaggggacttcaaattttttttattgtgttgatttttgtgatgctattgtgttgatttttgtgatgcttgaatgtttgagtgaatgaaaattctttaatgtaaatttctgtggaattttgaatgcttgggtaaatttctgtgaaatttttgaatggtgaagcgttgacggaggcggacggagcagtgttgctccatccgtcgttttttttaaacttggcaagcattaacactggcggctggttcctataacccaccagtgataattcatttacgccggcggctggcttaagacgaccgccagcgaaaatgaattatcgctggcggtcgataaccactagcgaagatctacattttcactggcctttgctttgtggcagctgcgatttccaccagcgaaaacccaaaatggccgccacgaaagatggtttttgtagtagtgtcaagagtaagacatctgagttttcatgccgcacagcccatggacagatgatggttgatggcttcaaaccgtctattgccatgtcatatgtgcaagcaaggtccctgctcttatctcgtgggtcatacgtcatgcatataattatgcacaagcttgagaaaaagaactgtaagactgctgtgatatgttagttgataaaaggaagatgagttgtgggagatatgacaccagagataatggtgagactactatcttagatgcaagcactggtagagaactcatattcagtcccggttagaaacccccattaattccggctataacaaccgtgactagcaaatagagaaccggttgaaataatcgatactaaagatgcataccaagtcaaaaaaaaatgtgagcttggtaaggtcacagtgatgacagcacagtggctcgatgaggctacaacaatgacggagcgacggcataaggtactggcagctagcgatatcgctggcacgcgaggcaagtggtcatggtttgcgcctatagtgtgggcagcgaccactagtatcaattagcgcctcttcggataagaggcaactaaggaggaggctgttgcaaggatgctggcctatttgagaggaaagcttgtgaggaggtggacaagcatggtggtggtcataaggaggctaaccatctgttgaagaggaggtagccatgaggtggtcgatcgatgagctagcgactcttcaagaggctagccgacatggacgaccagtggatttgaggtggagctccccccagaggatgttaactggaggtgtggtggtaattacatgttagtgattgttggttggtggttgatttggaggatgatggagctagggcgtcttggcaaaggtaaggccgatgctaggcgaaagcctcatccagtgaccacaatctcctttggggtgttctcgtggtggctacaatctctttcccggtgagatgctctaggtaataatcattcccaatagttctttgggtgggcaacgatggctctttggtgtcacggctttattggaggcctagtccttggagaactgtctccgccttttcatttttagacagttggtcctcaccttctttggtgttcattgtatgtcatgatagcgatggatctgtctgagagacgagagaatctttcttcactctcaccctttacccccgcaaccctaatctgttgtgactatcaggagtccccgctcgaatttggtaactagttggctggtgaggtcaacactaggtaggcagttttgtggcactcctggctgatttgattgataatgggcctattagagagaagagtggatccttcttctttctcatcctctccctctgcatctccaagccgggatgggaattgggagcccatatgtgtttttttgagcggtttggctttgttggggttgtgggcttgtgggcttgttagaggcctagcagcggccacctagtggcgcacggtttggtgctaggttcttccttaagggtgtgtactggtgtcgtctgcacacatggttgtcttgtgggcatggttgctcagcaagcggacctctgttagactttttctgctataaaatatagaaactccacgtgctattcgttagaaaaatgatgctagcgcagtgcgctaccagtgacacctttctttccaaaagaagaggagtgttcttttcctcacatgaatgtgtcttgctaaaaaaagatgcgcacatacactttcattaggccatcaccaatgcgtagcctcgggtcatcccctcgccgacggacgtccggctccgtttgccgtccccccacgagagagcgcgtccctcagctgggagacgcgtcccttggtcacttttggcttagggatgacatggagcgatgcgttgggggtgacgggctcctgtggacaccgtagctccaccaccaaattctcctttcacccctctcccctctctctctttccggttcccctcgaggtcgagccggaggaggcggcggctcccccggtgaaggcgtggcggtgacgccggaggcggagaggacgaggatggaggtggggcgaagagggagagagaggcggtggcgcaccagatctggcgacgatccgcaacatcaacgggcggagggagccacgccgtcctccccagcctcctccgctggtcggagtcggagcgtcgtgccgtcctcctccgccggcgccgtgcccgacaccgccggcccctcgcccgcatccgccggtgccgcgatgagggagagacgccttgagccggagacgggagagagagagagggtgagaggcatggagccggcgacgggaggccggagtcgtcgagccgacggaggcatcgtgttagtgatatgccctagaggcaattatagagatgattgtatcacatactatgtttacatatttatccgacattgttccttgaaatagataactccttattggttaatgaatatgtgattctttcatgagactctttatgttgtttattactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatatgtagtagcttacttagggactgctaaatgctactccgtaaatgggtagctataaaagtagtttttgggtatgctatgaaacatgtagtgggatatgaataatcaagatgggatttgcccctcctatggagagatatctctgggcccccacgatgttgtagattatggaagtgcttggccatgccaaaggtgattgaggagtcaatcacaagttactatcaacaggttcgagtgaatgattgaactattagaggatggcacatatctagccttgagcttaatcgatattgtgaagcaaaggggttcatacaagtatacactagaggttcagccgatatgatctttatgtatgcccggtgggtcaatacgttctgctaagggccgctgttgacgcattgaccgaaaaggagttttcgtgttacagccgagtatatatgaacctacagggtcgcacgcttaatgggccggaacatggggattggatagagatccaatatgagcttaattcggatatggatccgaataggagtcctacgggccttggaggcaagagtgatagatcctatatattcgtgaggggcgtgaccagcggaggcattgtatcacgtgagaaaccctagctaccacttccctccccgagcaaaaccatagccgcgcgcgggtgctagcacatctgcgcgtggcgttcagtccttgtatgtgtggataccggtggaggtgccgttggtttgcggtgctgatcggcgtgggagtacggcgaggagaacgcatgaggaggagaaggtcgagccggtgcgatcgactacttcctctacatcgacgcgcgctactttgcgagagttccttcgacttctcagcgtcttcttttgctgcacagcgcgtcgagtggtaacgatctatgatctaatacttgcatggttcctagtttacgcaatagaaaattttgatttatgctatcgtagcctacgcgtatcccaaaagtggtatcagagccgccttgtatagtttatgatctagatcattgcatatagttagtatgcgggtgtagtagatgagatctattatgttgtatataagtttttaggtgatcggaacatgagatgaaccgatagacgcaagggttgatgagatcaatcggtatgtgtgttggtgacttcactgaaatgtttagtactcaccaaggccgagcgcgattgtgttcatcggatagtccgatgtccactggaaccgcacgccaatgagaaaaaacgaggcaataagattgactcagtttcggcataattcgattacgccgttaaagttttcacatagcgggactgccgtgtgcgttgtcccttagatttcgcttggggtttttatatctatcttactttattgctgttatatatttgatatgacataataggatagattccctcagaaaaattaagtgtaatgtatgctcttccaataattgcacctattacggttgtgatcataagtgataggtttgccatagcaaagtgtcactttttatcatgataaaataggatagatgtcggatatctatatgcggagattattggtttacttgacaaggttaatcaaacaagtttggaccttggggcataggttgggttggacatggagatgtcaccccaacagcacaagaagcacgtatgatgtgattagcaaggtgtgcctaactattttgatagttgtctagctgtgataccaaagctcactagccactaataaaatgaggatcttgggctactatgttattagagggaattttgtttaacaatacatagtgggagtatcttttgttaaattgtttaatgaaaggttaaatgtaaacatggtgctgattttgcatacatatatttctattgtagatcatggcagctcctgcaccatccaattttaacttgcggtctattcttgagaaagagaagttcactggaacaaacttcatggattggtatcgcaacctgagaattgttctcaggcaagagcacaaagagtttgtgctttcagagtcttttccagctaacttgcccaacaatgctcctgctgctcaacgtagggagcatgaaaagcgatgcaatgattatcttgatataagccgtctcattcttgctactatgtcccctgagcttcaaaggcaatatgaggcattggatgctcatacgataatcacgggactacgtaacatgtttgagggccaagcaagagctgagaggtttaatatctcaaagtccttgtttgcgtgcaggctagtagaaggtaatccagtgagcccacatgtgatcaaaatgattggttacaccgagagtctggataagcttggctttccccttagccgagagttggctactgatttgattctccaatcgctccctcctagctttgagccgttcataatgaatttcaacatgaacaacctgaatagggccttggtagaattgcctgggatgctaaagactgccgaggaaagcattaagaaaaactccacccatgtgatggttatgcataagcgcaagcccacaacaagaaaagtggtcaaaagagaaagctaaactctgatgagatcacgagtactagcaattctaagaccaaggttcaaaagacagggcccgctaaggatgcagagtgcttcttttgcaaggagacaggtcattggaagagaaactgtaagaaatacgtagagcagctcaagcagaagcagcaagatggaaagaattccacctcaggtattaatgttctagaaattaatcttgctacttcctctactgattcttgggtatttgataccgggttagttgctcacatatgcaaatcgttgtaggggctgaaaagaagtaggagcttagcaagaggcgaagtggacattcgtgtgggcaatggagcaagagttgctgctgttgcggtcggcactatgccattatctttaccgttaggattagttttggagttaaataattgttattgcattccagctttgtgtaagaacgttatctctgtttcttgtttgcaagcagagggttatggttttagatctgtggacaatggttgtccagtctattataatgacattttctacttccatgcacccatgatgaatggcttatacattgtgaatcttgatggatattcagtctatgacattaatgcaaaaaggcaacgtcctaatgatttgaatcccacttttatttggcattgttgcttgggtcatataaatgagaaacgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactaatacatactgatgtatgtggaccaatgagctcaactgacagaggtggttttgggtactttattacctttatcgatgactttagtagatatggttatgtctactccctgaggcataagtctgagtcttttgaaaagttcaaggaatttcagaatgaggtacaaaatcatttgggcaagacaatcaagtatctacgatctgatcgtggtggagagtacttgagcctagaatttggcaatcatctaaaggaatgtggaattgttccacaactcactccgccaggaatgcctcagtggaatggggtgtctgaacggaggaatcgtacattgttggacatggtgcgatcaatgatgagccaaactgatctgccgctaagcttttggggttacgctctagagacagctgcattcacactaagcagggttccatcaaaatcagtggataagacaccatatgagatatggactgggaagcgtcccagtttgtctttcctaaagatttggggctgtgaggtctatgtaaaacgtttgcaatcggacaaactcacacctaaatcagataaatgcttctttgtggggtatcctaaggaaacgaaaggatattatttttataatcaggaagagggcaaagtgtttgtcgcccgacacggtgttttcttggaaaaagagtttatttcaagaaaggattgtgggagcatggtgcgacttgaaaaaattcagggaacaccgaaaaacgcttcaacgtccacataaccataagctgagcaagatgttgttcaacaggttgaacaagttgttgttgaaccagttgtggaagcaccggcttcatgaaagtccgataggatacggcgtacacctgcgaggtatgcgttgttaactacaggacaacgtgatatattgttgttagacaatgatgaacctactacctttgaggaagcaatggtgggaccagactctgagaaatggtttggagccatgaaatccgaaatagaatccatgcatgtcaatcaagtttggaacttggttgatccacctgatggtgtaaaagccattgagtgcaaatgggtctttaagaaaaagacagatgtagatggaaatgttcacatctacaaggcacggttggtggcgaaaggtttcatctacaaggcacggttggtggcgaaaggtttcagacaaattcaaggtgttgattatgatgaaactttctcgccagtcgccatgctaaaatctattcggattgttttagcgattgctgcctatttcgattatgagatatggcaaatggatgtcaaaacagctttccttaatggaaatcccgatgaggatgtgtacatgacacaacccaagggttttgttgatccacaatcagctaaaaagatatgcaaattgcagaaatccatttatgggttgaagcaagcatctcggagttggaatattcgttttgacgaagtactcaaggcgttgggctttgtcaaaaacgaagaagagccttgtgtatacaagaagattagtgggagcgcactggtatttctaatcctatatgtagatgacatattattgattgggaacgatattcctatgcttgaatccgttaagacatcattgaaaaacagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacgtccagatgtttcatatgcacttagtgcaacaagccaataccaattagatccaggtgagagtcactggatagttgtaaagaatatcctgaagtacttgagaagaactaaggatatgttcctagtctatggaggactggaagagctcgttgtaaatggttacactgacgcacgcttccaaaccgacaaagatgattttagatcgcagtctggatttatgttctgcctgaatggaggcgctgtgagttggaagagttccaaacaagatacagtggctgattctacaacagaagcctaatacattgccgcttttgaagcagcaaaggaggctgtttggataaagaaatttgtttctcaactaggtgtgatgactagtgcttctagccctatggacctttattgcgataatagtggtgccattgcgcaagccaaggagcctagatcgcatcaaaagtccaaacacattttacggcggtatcacctcattcgcgagatagtgggtagaggagatgtgaagatatgcaaaatacatacggatttgaatgttgcagatctgttaacaaagccactccctcagcctaagcatgaggcacacactagggcaatgggtataagatacgtttatgattgactctagtgcaagtgggagactattagtgatatgccctagagacaatcatagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgataatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatacttagacctgagattatcatggttctcaacatgtgtagcagcttacttagggactgctaaacgctactccgtaaatggatagctataaaagtagttttcaggtatgctatgaaacatgtagtgggatatgaataatcaagatgggatttgctcctcctatggagagatatctctaggcccctcgatgttgtagattatgaaagtgcatggccatgccaaaggtgattgaggagtcaatcacaagttatataatctatcaacaggttcgagtgaatgattgagctattaaaggatggcacatatctagccttgagcttaatcgatatcgtgaggcaaaggggttcatacaagtatacactagaggttcagccgatatgatctttatgtatgcccggtgggtcaatacgttctgctaagggccgctattgacgcgtggactgaaaaggagttttcgggttacagccgagtatatatgaacctacagggtcgcacgcttaataggtcggaataaggggattggatagagatccaatatgagcttaattcggatagtgatccgaataggagtcctacgggtcttggaggcccgagtgatggatcctatatattcgtgaggggcgtgaccggcagaggcattgtatcacgtgagaaaccctagccgccacttccctccccgagcaaaaccctagccacgcgcgggtgctagcacatctgcgcgtggcgttccgtccctgtacgtgtggataccggtagaggcgccgttggtttgcggtgctgatcggcatgggagtacggcgaggagaacgcatgaggaggagaaggtcgagcaggtgcgatcgactacttcctctacatcgacgcgcgctattttgcgagagttccttcgacttctcagcgttttcttccgctgcacagcgcgtcgagtggtaacgatctatgatctaataattgcatggttcttggtttacgcgatagataattttgatttatgctatcgtagcctacgcgtatcccaacacgtcggtccagctcctcgcctcctcggtggatgccacacgcggtagatgggagggagtaaatgaggggaagagagagaggggggagaagagaggggtagtatagtaaaatgtgcttttttggtagggatactcattgggctactaggggtatcctacattgtgacttgtgaggggagtttcctagagagtactctcagttagtgagggcacccatagagtatccctgattggtgatgcccttagtactaagcagagcccatgttatttaaaaaacaagtaccgtatccccactctcccatgtatataagtaccgcatcctctctctcatatgtactccatccgtttcacaatgtaaatcattctagcatttcccacattcatattgatgttaagggtatccataatgtagtaaagaagtgggtattagggaataaaaatattcttactactaggtaagatacattgtggaaatagtaaatagctactaccaagccataagcttactattaggttatagcactttgtggtgggtcctacctattttttaattgtggcatggctcatgtttggggttatttttcagatgggtcccaccttattacccactctacacatatatacattgtggtgcatcttcaatctactattaccatcttacataggcccaccttactacctacttttgcaacatacattgaggatgccctaatgaatctagatagatgctaaaatgacttatattgtgaaacagaggaagtatatcattttcaaaagaaggcaccatgcagttcataccccattgcactggtatttttttaataaaaccacttatattttttaaatcgtatgttattttaaagatttgtttaaaccattttactccactcaaaacatgtaaaaaaacaagtctaatattaaatatattttgaatagcaatatagttactttaaataccatcaagagttagtaccgtgaagagtacgatggctcaaacggaatctaaaaataatacatggtttaaaatatgttatatttggtacatctagatttattaatattaatattattgtgggaaattttagaatgacttaaagtataaaacggagggagtattataaaagaacatgtctacttcaccgagagaaaaaaacaacacgagaaaaacctggcgagcacaccaccaccgcatcaccggtccaccgctcttgccttcccctttcttgcagggcaggaaagaaccccacgccctcatccaatcccagccgtccatccaccatccaacgcctntcaccgcgccgctcacctnctcaagaccaccacccaccactcccctcctctctcctctccattcctcctcgcttcgacaaacaaaaccccccaaaaccctagcctccgccgcccgccgccgccgccgccgcgcaacccccgagctcgagcggcgcgatgaacatcaagggcggaggccgggtcccggtgcccccggccggcgcgggcacgctcgtcaagctggtggtgctcggcggcacggccgtgtacgccgccgtcaacagcctctacaacgtcgagggtggccaccgcgccatcgtcttcaaccgcatccagggaatcaaggacaaggtaaccggacacgcccatccccccgccccttccctgttccatttcgttacttggatgtgccgcgtggtttggttgcggcgttaacgattcggtcgtttaggggagagattggttggaaataaatatttggtctcgcgcgctatcttatgttaggttgcagggtaaattgtgttttgaagcaaatctatttgggtttataggtgctatctggtaaatctgaactaaccaggtggtcttcatgatgtgtgagatacctgcctatctttagataacttgtttagctgcagcgatttatcaggctgaaaacatgacaagtgttccctttcttgtgggtgatatcatttgttgaggtttgaggattaaaaaggtcaaccattgcgtgtgctggaactgattccaagttcttggtaaaaaatccaatttgtagtatgattgactgctgattccagtaccttatgccttgaaaagagaattacctctgaaacaacacgatcgctctgtaccaatgtgtgtggtttccagtctggcttgcactgaggttatgaaattttcctgcgctagatacctgtaattggttctagaaagcagctgctttgtcttatttattggcctgcggcaggtccacgagtaccatgccgtggtgtagttcagaacagatagtcacatgatgtttctaccttcattttttatgttgtttgttgaaatgatctgaatgtggtaaacacttattgaaattaaattgtaaatgaacacgactacttttgttttatcattccttaaaaaccatttgaaaatatggtaacattcatcacagtccagtcgatttaatgcacacgagaccactgctggttggaagatggtgccaagatcaactgaaaaccattgacttctttcagtgtttgccgcattgtggtttttttataccaaatttaccatggacaagtgcaatcgcattatttgattttagtctggaagtctggctgtgaccattatatatggctcgccatcagtacaatcagggcatattgaagttgtttgtgttcacaaaaacacacattcttttctgtactcacaatgaactgcacatttagttctgtcacacatgcacctttttcttgtaatttctttaaatgtggttcatgggagtaacgcatttccttttaaaatatgtatctttattttatcactatgtggtttcttatgctctttctttctctcttttttccttttcaaaaagtaataaaatgtattgttattaatggcattcaattgtggttctctgtttcataatgcaacttaaatagcattaaatttgttagatttgttgaaaatatctgttatcatatatcttctgctctaactatcttaatcgaccttagatggccggttcctagcaatctactcaggaacagcctagataacgacagaggctgctttcaccttcttgcccataggttacttcgcccaaaccgacgacacttctccccacctttttgagcagctttgatacaggatatggcgactctttattgcgagtatagcatgactatgaacctgacatgcacacacaggtgcaaacaaatcataacaaggagtagtgtcttttacattctggctccttgcattattttggactaaaagtaaatttagggttgttttgtttgctgtgccatccttccgtcgccagctgtagatggaccccagacatctaatgccccctttgatatcttcctcgcccaaatgtgtcatgcctgagttagtctcctagattccttcttgacatatgatctcctgttcctttaaaaataacatgtccatatttcttgcctagaaaagtaggtttcaaatggaaacggagttacgtatgtatatagcatgcatgacttggtttcctttatatccccatagcttgatctttgtagttaccaaggcaggtgttgatgccgagaatagctctaatgtagtgtctgtccgctccgtgaagcgggaccaaatttgcagccccacacgaccagatcgtcattgggtgcaaactctgtcacttttggtaccaccaagcggcaccatctatcaggtgttctgttgctgccagtcctgtttttcaattttggctgcttgctgaagaatcgctcaaagcaattgaactaaggttgtgggtcttccttgctgttttaaatgtcataaaccctagatgataaaattgtgaagctaaagcttgcttgcaaacagaattaccgaaccctgcagcaaaccatagatggcagagcagctattagctcagatagcaagttgtcatgaaccgaaatcatgatgaggccaatgtcagctgggaggattgctgaatggtgcaggctgctactgatgagttgagggcttagactgggatcatgaacattaggggaaagattaacagtttaattttcttcattgaatcctctccggtagaccagctcattgcctcttatagggccagctcctaacagtgtaatctaactaatttaaattgattttatcagctaattaaaaggaacaacctagataactatggctgctgctgctgatcttcttggtccatgcccatggtaaccaatattatgtttttatcttttaagatataatttgtgattgtgagttatttccttgctgttcttgattttcgaatgagatttgttgtgtgcatgctatttattaaaaaagaggcatggaatcagattttacttcaaaaaaagagaccacatgtttgcatgttacgtccacctctcactgtttactgtgtttggttagtcattccaaagtgagctttagaatttccttattttatttcctaaataggatggtagtatttatctaaagttgtgttaacaatgcttgtatagctagatgctctattctttcattgttagtgctggagcattaaatgttttatgcttgtttaaagtgtattatgaaatatgcaagaagcttgcctatgtcttcatcattataattattgatcttatttagtataaaaaagagctgttgtgagtcctccctttcctgtgcatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaggtataccctgaggggactcactttatgattccatggtttgagaggccaatcatttatgatgtccgtgctcgtcccaatcttgtggagagtacttctggaagcagggatctccagatggtacgtttgcatctttttaattctatattttcatcgttggaatgtgtgtatacttctcatctaatgatagatatacttgatttgatttgcatgctctattttcattgtcattgcacaatcaagttaaattgaatttaaagccaaaatatgtgctgcttagtgcttacatggtttcattgttgatgatgatgaatcatcacatcctacattgaatctttgcatacattaaagtattgtgtcattcataatcattaacatctttgactgttagtttgtttcagaagctattaccacattttgcaactaaccaaccttttgctgatggttactagggttctatagccttttgctatatttttttgtctgtttttttgcatgtttgttttcatagctatttaggttatgatattaagtttggagcatacctaaagtggtgtgattactcagagttcattttggctcatggattttagtaaattaattattggaggcaaatgttaattggtcattctgttattgtttatagataggtacgtttaggggtaaaccttttttgtgggctaacaaccagacagtccttttttacttatggctatattccaaattctttcctactttatgatagcatgttactccttgtaaagatatttgattgtggacttatttggtgattaaaactgttctactaaacatgccaggcatatgtggtcaggttttagaaaaaaaattgaactagtgagtagtgagccaattagaagggatgtgccaaattttggaaataaacacagtcgaagaaaatatgcaatttcggaaataaacgcagtcgatgttttagtttatggttgtgccatgtgcttttatgcttggagttccatttgctgaacataaaacccttcttcatattttttatgcatctattgtactctatttttggcaggtaccctttatattttttatgcatgtattgtactctattttgggcaggtgaaaattggtctccgtgtccttacaaggcccatgccagagaagctaccaactatctacaggactctgggggagaacttcaatgagagagttttgccttcaattatccatgaaacacttaaagctgttgtcgcacaatacaatgcgagtcagctaatcacacagagagaggttaagacctgaacatatgctttttatagtctttttttcttatatttgatgggggtcaacattacttgggggcgctaactgtttgtttcactctccaaatccagaccgtgagtagggagataagaaagatactgactgagagggccaggaattttaatattgcccttgatgatgtgtccatcacaagcctgagcttcggaaaggagttcactcatgctattgaagccaaacaggttgctgcacaagaagctgagcgtgctaagttcattgttgagaaagctgagcaagacaagaggagtgcgattatcagggcacaggtaagaaatctgttttatagccattgcctgatgtcatgtgccggagatacagtttgacagtacatattatataatggttttgccattgcatgtctagttaacattgtctcttaaacatggcctttctcttctttcaacagggtgaagctaaaagtgctgagctgattggtcaagccattgcaaacaaccctgctttccttgccctcaggcagatcgaagctgccagggagatctctcatacgatgtcatcttcagctaacaaggtgttcctggactccaatgatctcttgctcaatctccagcagctcaccgtggcaaacaagtcgaagaaatgaagtcattctcgcaccatgttctaggttattagcagatgtcagtctaccagacaatgtgaggaacacttggtcctctctgtagttgcactagtgatcatctgtgatacagaactcgacgagtgactcaacttttggcaaccggcaatctttttgcaaattgcagctaaactttgcaggctacattttgactctgctagtccttgaggaagttcaataaggaataccattctgttttaaggttctcaatctgtgattgcgatgatggattaagaaactgttagatctattgatcaatctggtaggtcccctactggtatgtttatctgatatcatgctgaatgtgtaattttcagcaacattacaggaaatatgccgttgaagaatctaaattagtacactgattaacagatcgtcgatatgtccgagtggagacagactcgaaatctgttgggatttgcctgcgcaggttcgaatcctgctgtcgacgttttttgcttaagttcttttttggctacgacttgacagatgatactccatattcgtttattggaaaaaccagaaagaagttgaaccagaaacattttttaagagaaaatattaataattttggctctttgagccttacattcgatcaaaactatcacgccacaggaaaatgaaggatctacaagatgtggtagttttaattttgtgaaaaaaaaagtaacttctatgctaacgcatatattgagtctccttactattactccctccgtcccaaaatagaaatatttttagcacatgttaagtcaaatagttttaattttgactattaataaaaaaataataaaaaagatcaatcatgttttgtgatgattttggggataattttgtgatgcaaatttgtgggtgatttttagatgtttttgtgaatatgtggatgattttggtgatgtaaatttgtggatgatttttagatgtttctatgaagttgcagatgagtatgtgatatcaatttgttgatgattttatctgtgtggatgattttgttgttgagttcggtgtgaaatcaatatgaaagtagcaaaaaaaaaagagaaaagaaaagagaaagcatcacgtggcgcttttatttttactcccgcttggtgactcaaaccaaatatcgctacctttagtcctggattctctctctcgatttgcaacctgggactaaaaagggttgcgaacggagagatgtggggtactctggtagtgatcctatataattggtacccactaaggggcatttatactcctataaagtaaaacatgcaagaagccacatcatcaataattttaagccatcagatcatattagtacaaagataacaaccgttggatcaaaaagctacttattcatccaattcaatcatttattagcaatccattcacctcaatttgctccacctcatagtcacacatagcattgttacatattttgtgtataacaccatgttttccgaatataattcaaattattgtttaacacgtgattattatttaatatgtgtgttttattttattatgcatgataagatggcatataattattaggtatcgttaactgaatacattttcagaaaaagacgagtgaagtagaggtatgcaaactgtctaactacaacgatacacatattgcgcatgaaagtaatattcatatattataacaatacacaatgacacttggaaaaataaagcatgaatttattgtaataatataaggcatatataaatccatattatcgtatattttgtatataaatagagttgcacctaaccatttaaaactatgattttgtttgatcataaaattacaaaacccgcgacaaagatgtggggtgccaactagtaagttcaatgacagactcctagcagaaagatccgctcatcctcgcgcgaacctagaacagaaaccgagagaacgccgaaggccaaactaggaagaaggaagggaaggcgagggaacatgacctcctaggtgacgcctccaagaaggttgcaacgtcaaaggtgccaccgtcgcctgctcatattggactaggttttcacctaaaaagtcatgtcggggagggaggatggcagctcaacaatgcccacaagagggagcacggcatcaagaggcgttgtcattctcggcccaaaaatcgagctaggcttttgccaactgtatcatctccctccgaaccatcgacatcccaaagctctgccacccgaacgacctcctccatcacgtgggctcgtcgcaccagagcccctccgctggccaacacccctgtcacagccccagctcgtgccacacactacctcgctccgctagcgcctccacactgggctcacctcacacaccgcaacagtctcctgctgtcactgaccgcattttcgcacgctgcatcagattccgcactacaagccgcgcctccacgcgtcacaccagtctatcgctgtcgccgaccaccggatctggccagagggtaccagatttggcgcccactgctgccgctaccgcctcgacattgccgccgtcactgcaatcccaccgcatgacatcgctgccccgccgcctatcaccacctccgctcggctctagatacagcgatgtccatcgtggatccggtcgggtttggcgcgtgggtggctctccgtcgccgccgttgtcgcctcccgtgccccacctttgtactctgcctcccgtaccccgccaccgccggcccgaccacgcttgcaccaccttttcctgcatgccaacctcaacgccggcatccctccggccatcctcaacctttgagtctgccacgccggatctgtggaggccgccgccaacctcacaagtcgccggctttggtgccacttgctctggcggctgcgtctagggtttccacccgagtcgcccgacgcgggcagtgacgcggacgtgggagtatagtgttcttggtctattttcacgatgatacctaggagaggccggatggagaggacaaaaggtgggtgaggtaggatgcttgtagtccggggatggggtccttgacctggaccacgttatccacacgatttccagtgtgccaatgtatcggcccatttggtacgtgatatacatcggcttttacaattaatatataaataataaagcattagatgctgccaaatactcacgaactaatattaaacatgcatggttacacagaattatggagccccgttgattatcctaataaaccaaagctgttgacggtcgttatacaccaaattcgactgtcaatataactaaaataaagaaaaactagctatgcttgcaatgcatatttatttaagaataatatagttccacttgtacctagagtattatttgtctgcagagattaatacataaatggagaagaaatgagaacacttcactcctaagcaagcttaaggataagatgggcccacatgtcaggtgtaaccatgccggaaaccgccataactgccacaactgtcatagggacccacctgacagtgacctgaccgaagctggaggcctgctgggccggcccaggttcggccgaactctgacagcggtagctcagctcggctctccagtgtacgctccagatgactccccaatgacggttgcggggcatttctgacaattccaaccgttttaaccatcattgcaaggctatataaagaggtcacttcattcattctccaacacactcaagcaagctcaagatctttccctatactttagttttgtgctctagtgctaagtggagtagaatagaatagctcttggagtcctcagagtcttcggaagagttcgagtatggctgtagtagcttttctttcttcttttgtatgactttcagaattactagtatattattctttatatactctcggtactttatttgtccgagtatcggctttattttatatctatgtcattatagttgtgtagctagcctaccagagaggtgcaatggtgtgggtttaatgtccgattattcggttgctctgtgtcattccaggggacatagagtagtagaggtggtgtgtagattattaagtatcattatctgagcatatatgctgcgggacagtagaggtggcccgttgatggtgacaactcagtatgggtattcctccacgtcagtatatattcctaagacatttttctggggagggtactcctccgtatttagccccgattggatggccatgacaggttgtcataagaaactcggtaacctagggtggtctctcgaaacaccaggagggcactgttaggggtagtggccacacaattgtatactagcagatgtaaactaaaatggagtgtatactagaagtatatgaattgattgcttttctatttcttcttccacatagcttaggattaattaataagaagatctgagttctttttgctttgtgtcactctacccttatgaatgtattaatccctgcttagactctaatcgtaccagtggtgtaaataaattattagcatagttctatattataaatctttctttgggattaaataaatatgataccttggaatacttctgggtaaaatgctacaatagtatatccgtgcgcttgcggatcccttatgtaatcatatatataccaggactatttctggcgtcattactgggaatttatatttctagtaacatcgttaagaaataccatcaagcatttctagcgccgttgccgggaaagattaataaagagattactataagctaataattttatatgcattacctctgtatagatcactgtcctttgttggctaaccttgattgttttcacccttaaggagttgcctccatgaattcaaaggaggaggtttatgatcaaagatgaaaccattcatttgcctccaaatattcctagtcccacaaagattttttttccatgaaacaatggctttgataacagtttcttgattgtaccatcatgttatccaagctcagagatgtgtcccaggagatacctagaacatcatagcaagactttgcaaaggtacactgaaaaaaatagacgcaatagagtcgacctgcaggcatgcaagattggacaaagaacacaactaagatcacaatcaggtgggggcacaatgcttatggtccaacacatattttgtgttcaacctgtccatcaaaagtaaccaacaaaaaactttaacctttgaggtagccttactcttccatagccaaatttggccaaagaattgatgaagctgtccatgttctgtaatccaattcggccacctgttacagtgttgacttcaaacaaccgccaaatgtgcatacgagctctgttttcaactgatctatccccgtcgccaaattccatcttagtcatccgcagttgaagaaacaaggtgttgcatcatttgtaatgggcctatgagcttgtaattttgtctgggacctcggtccaactttcgccaatgtggggtgtgccccaatctgggggagcacgaacccaatggccctcttggttgtcctcccacctctttcaatagctagatacccctttagggtttcgcgggttttatttagattaaagtttagccattgcaacttttcctcgtgcttacgcgtgtcggttagaccgcctaattactcgtcttcggaagcccatcttatcgtgcattttaattcctatttgcaattcaaattgatttatcttgttcttgcttgtttctccgatttgcttgccggaataagattgatctgcaccggcaagatcaataacccacagagaggtgtatcgatcgctaagacacaacacaacaatatcttgtacgattatagttgggtcatcaacgtttctcccaaatgattgttatcatcaactcatcgaaagatcgggtcaatcgaagctgtgagcgtatcgagtggagctcaaggtttatcagagggtgtagttattttggttagtgctttagtcggcaaaaattccacaaacaaagcagaggagcaaccgtacattaggagatatggtctaccatgagcagcatgtctgtccagccaattacatatctcttttcctgccgtctagttggtggtgtgtgcttcactcatacattttgcacagtatttgcagccaaacaatactatctacagagcttaattgttcctttaaagtaatatgaactaatagttgatatagaaagtaagataaatataaatccataatgccgactgaaagatcttccgttggttcttttcaaaagaaagcaaaagaactttggttgatagatggttttcattgcacatgatcaaggccatatagatagttccacacttccacatacacttaccgacttctttttagaaagggttaagttgatttatgtcatttcagataaataccactactattcgtgtgttcgtaaccatgtcattgcaataactgcaaaattagatcataccattttatacgcataggattatcttttgaataatttttgctactgtatttttatatggaaaaaaaatacctaatctacatatgggatccagccgtaagtttcaccttcttcctccaatcctccacccaatccggcgccgaagctttctttgtgctgcacgaccccgtcgccgtcaacgccactgcacatgagggagccatggccacatttgagcggcatccctggtgatgagcctgtctagaccatggcggcggcctctccatgctcttcgacaagctagcagtgtcgcagccggcatccaaactcatggcaccgctgctacttgactcctgggttcatccaaactcatggcacagtgctgccaagccgtccaccgtgtccatcgcccagacgtccttgttcgccacgtggactataccatcccgaggccccatccctccagtgccgttgcctccacatctcggcttcctctcgttgccgatccaacccaagccggggcaaagctgctacacggacagtcagtccttgcacagcagtggcgacgggaggctagggttgatgcgtggtaatacgggtcagcccaaagttcgtcctccaggaacacatcggcgccagcagtggcaatggcatggagtgcacccgtggagcccgcgaccatgggcggtggggagccactgcggatcgaagaggtccatctccagttcacactccctatttcgtccatcgagcatccgaaaggggatgagtcaaatctttaatatgcaagggtaattttgaccatatgaaaataaagtacaaacaaaataagtcaaaccgggcttgtgatgtacagcatggcatggaaccaaattttttgtgtagtcaggtaacatggttatgaatagatgaatagtaatgtcatttatctgtaggatcgtaaatggtctttcccaccccaaaagctagccattgaggtgaggggatcgtaaatggccttttccaccccaaaaactagccattgaggtgaggggctccacggaacaggcccacggtccatcaggtatacggttcccgcaggcacccacggtccatcaggcaacctagcctggctctgataccaattgtaagatcgtaaagggcctttatcaccctaaaagctagccattgaggtgagggactcccctacttataacttaggtcctttacccttccacaactaatatggaactattcaacattatcaaaaatgacactattgtaatagcatggatcaaattaacccttttagaaatcactacacctaccattttgataacgcattgaacatttacctgtttcaccattaaataacaagaaattaaaccgtgattgatagactgcaccaaactagctttatatataccaatcttatcatattacacaaaccaaataacctttacatgaaccagctagaagggagaaaaaaaatcgttggagtaggagacatcaggaaaacatggaagacgtaattgtcaatgtaagcatcatccatggaccatgaaaccttgtgaacctataaattgatgaaaagaacccagattgggtgatgtccgctcgaattagagccccaatttatatactctgcttctagtagttccttgcataagcgtgttcaacatgataatccatcttttgtatcggtttacaaatcataggcttttgttctggccgttatattgagttggatgagaagttcatcatgtgaatgtagtattcatcagagatctggtttactgaacattgataaatgttttgtcaagtactaagatgacatatcaaataatatctcaattgaatattgcccaaatcataagagaaccaccaccttttatttgcaaatttacagtggcccccaacttcacgatcaccgttctgagacgtcatatgagatttaaaccacatttaatttaatttttggggtgcataattaaaggatcgctatgtaggaaacaattttttttataggtaacacaaaactttagtcatgacctcatccacattaatagctcttagctttgtcatccatgacctcatccacacaaagcatcattatcatacatagaacacaatagcattgcgactaacagaaacattaaaaactgaaataacagtagagggttataccctgtgaaagtccctccgctggattatgaggcagaactgcctccgttggtgttgtcgatcagtgcaccagctcccggtgcactagcttcggctccaactcccggcgcgctatctccaggtgcggcagacatgggtgatgcaaacgaccggtcaaagacaaacagaggacgaggagcagtcgtgcggaagcactccccaaaaacctaatcacccacctacccggtgcagatctcaggcgaaggtgtggttccgaaggccctgctcgttccgatctcttgtgcgcgcaagcgatcagaaccggggaagcagcagcagcacaggcagcgcgaggaggaggaagaaccagtgtttggaaagcaatgcaggagatctgatcgaggttctctctttccttatagcgcaggagagaaatccgcccgttgccgtagtaacgacacgatcaatggatattgaatcgcctgcccgttacagaggcaatcatgtggttggattccgatccattgcaaaaggatagagagagagagtgagtcgcaatgcacgcatgcccgccacgcccacggcctcggcccgacctagcgtgcacgcgcgcgcgtgtggctttccgatccccacctcaaccggtcaacaggagcctccaataactctctatttaagttgagatactcctcttttattcccatggtggtattattatccttaacatttattatgggcccttgagatttaatagaaaaatcgggcctcgcctatttattctaacaatccccaccaaatttcatggctcataagaaatgttgtcaaagttgtgcctgtttgatataacagtgttttggtggagactgttaagttgaaattccacctaggaaatgaactacgtcagacc

SEQ ID NO: 25126 - DNA, 1125 bp, Oryza sativa
catgaaaatgagcccttttcaagggtttcttctttcagccacacaatagtttgtttcgccatccaaatttacgggatctccgatcacaatggacaggtttccactattatgcaaccttaagtgggtatcaagcacatttccctcgatgcactgtctatcacattacgtggtagccccttggtaaactgatctgccagatttttagccgtctggacatagtccaatgctatcactccggagtttttctactttctgacagatttcagtcttcttttgatatgcctagatgacttcatgttgtcctttgacctgttcactttaataatcactgtttgattatcacagttcattaggatagctggcactggtttttcaaccaccggcaaatccatcaggagttcacgaagccactcggcctcaactgtcgcagtatctagtgctgtaagttctgcttccattgttgacctcgttaagatggtctacttgcaagacttccaggaaacagcgccacctccaagtgtgtacacatatccacttgtggcttctatctcatcagcatcagatatccagtttgagtcactatacccctccagtacttttgggtacccggtatagtgaattccatagctcatagtgccctttagatagcgcattactctttccagagcctgccaatgatcatctcccgtattttgagacaaaccgactcagcttgcttacagcaaatgagatgtcaggcctcgttgtactagccaagtacatcaatgaaccaatgatttgggagtatctcagttgatcccttgctattcttcggtttttccttaatagcacgctgggatcataagaagtaggatctggcatgcagtcgctgtatccaaagcgactcagaaccttgtccacatagtgggattgcacaagtgtaatcccaccctcatctcctcttagtagcttaatgttaagaataacatcagcctctcccaaatctttcatttcaaaactcttagacagaaagtccttgaccccctcaatcacattgaggctggtcccaacgatcaatatgtcatcgacatataaacacaagatcacttcttctcccccaccatagcaatagtacacacatttgtc

SEQ ID NO: 25127 - DNA, 755 bp, Oryza sativa
taatgacggattatttagactcaaaagattcgtcttgcgggttccaagttatgaaattagttttttcattcgtgtctgaaaaccccctttccgacatccggtcacatatccgatgtgacatctaaaattttcttttctcgaactaaacatggcttaaataccttgaaaggaagtttacatatagtaataacgtgccacgtatccagcagagcaccgtcgttccatttccgtgctaatttggtgtgctgcacacctatatatcggccatccgccccttcccatcccgcactgccatcgactctctttctcaggcacatgcacgagtaatttttatcaggcacagccatgggctagctactgggagcgccaaatggtgcgtcaatatatatatattctagtgtgttgcactattgtctggtactctctgcacctatagcaagagtgtatagcagttgcatttctgacgaactgacgaaagtgtgataccaattaaactcatctatatatagctaagggcacccatgttgattggataatctgtatgctaactttctagtgtgttattttgggtccattgaacaagcagtcgaacactggacaagccaaatgtaataccctatagcccccatccatttttcttcgggaccatgcatccgcgctccctgctctaccaataaattccaagctaacctagctttgagtttatgagcatgtttgtgattgacctaaatcataaattagaaacaaaagtgggg

SEQ ID NO: 25128 - DNA, 824 bp, Oryza sativa
  unsure (1)..(824): unsure at all n locations
nnnnnnnnnnnnnnnnnnnnnnnnnnnnnnnnnnnnnnnnnnnnnnnnnnnnnnnnncccctcgccactgccgctgcatctctccttggctacatcggcgagcgggtcgcctcgctggagctggtcatgctactgcctaggctcgcaccaccgcatcttctcgttcttcctcgcccacagcgccttcgtcacctctgcgcatccaccaccaccaccacacacggatttcagattaccgtgtcaacaaaaatggcgaatcgaagcgcaagaacggatgggtgctgacattgggaggtgatgaggtgatagacctggatgaggagtagctccaccggcagcggccttgtcccctgcagcggcgacggccttgtccccacagtggatccggcctcccagcggcgcggcggcggcagatccgacctccccggccacgcccgagcaccgccaaccgccacgcccgagctccgccgccgctaacctgaaagttcaagtgccattattttggttttgatgattaatgacaaatccaattacatgagactaacattgttataagcatttctttgtctactagtctcatatggatatgaaagtggaatatgtgagaggtgatttctggacttcatatgagttaagagaaaaacgttcattgatggtgtacctaaatcacaaggatgaaatgtatggagatcaagctatatgtaccactctttttatccgtgcacatattgatatatttatatataatattttcatgtgattacataagcatgtgtcacgccccgaactagcccccaaacggaactagcccgtgacgctccaaa

SEQ ID NO: 25129 - DNA, 513 bp, Oryza sativa
  unsure (1)..(513): unsure at all n locations
nnnnnnnnnnnnnnnnnnnnnnnnnnnnnnnnnnnnnngttgtgtgcacatccatttagcaatgcaaggccaagcatgcgtcaaatcgtacaatacctcgacggtgacatggcattacctgagcagatgccaacagaccaaatctccaatcagacggagggcttagaccagtatattcaaacagggcctcaatcaacaattccagtcaatgcaagctatggcacaatgtctaacctttcaggtggaagataatttaacaagtgggcattaacacctttaagtgttgcaagacgatgcatatgttattgcaagcagatgatcttgtgataggggaggtgatttgtggttagctgcttcaactaattaaatcgttaagctttaaaatggtgaattgtattcaataaaaatcaggtgatagaaaaagacagtcatgtgtactcctatttnnnnnnnnnnnnnnnnnnnnnnnnnnnnnnnnnnnnnnnnnnnnnnnnnnnnnnnnnnnnnnnnnnn

SEQ ID NO: 25130 - DNA, 18662 bp, Oryza sativa
caccgttagccaccatccccgcaccgccatgcgcatgccgagagagagagtaagagcaacagagagaggaagagggaaagaaatgtatgataggtgggtcctacattttttaataaataaaatcctgattggattgccacgcgtacgccatgtaggacaaaaccgctctagattgggtcgagggggggtaatttgtgcattattgaaagttgagggtgaacgatgtctggtttctgggatgaggggggtaattcggttgaccacgatagttccgaggggagggtaattcgtactttttcctttctttttcagatgtgcatatgcatatttccatgtacttgctgagtatttcatgtaatcaccacacaattgccccaactccagaaggaaggtttccgctattatctaaggagtttgctactgaaatcgaggactaggccatgtgccacagttgattatctgtgacatgttgaatggagcttccgtgcatttattttcttttccgttgtgctattttattcttgtgttgccctcaagataaataaatgtaagtgagccataagggttatcacaattatttttattaataaatgttagtttttttttttgatgttggctgttatattatcttcgtactgtgtgtgataggttgattctggactagcacgtatacacagtaggttctatttttggatggagttgccgtacgtgcgaactctcagcggtgtatcaattaaaggagcaactctgttctactcccctgttttatattataaatcatttgacttttttttcagtcaaactttgttatgtttgacgaaatttataaaaaaattagcaacatataaaatattaaattagttttgttaaatccaacattgaatatattttaataatatgtttattttgtgttgaaaatactgctatatttttctataagttatttaaaaagttcaactagaaaaaaaaagtcaaacaacttataatataaaatagatggagtattgattaagtagcccaagtttcacccgcaaattcataatctattcatttcacattgtgcaaaaaaaaaaagcatacgaaacaattacaagccataaacatcatcagggaataaatgtgagactcaaaattacagactccatcgaggattatgccagtctaactgcatgatggactttctaatgggacccattgccactagccagaccgagccaacactggtccaaccatccctatagacgatcatcaagaacctaacaacacccggttaaaccacaccacatctggtccgaccgggccttatcttttcgtttatacttataattgtcagctaaaatttaaatttttaaccttaaatttggagctgcctttgaagtttttcatcaaaatttgtttttcagccttcagttctagatcgctaagaacaaatatataaaagttttatttataaattattttttatttataaatataccgtttcgcttattccgcgatggcttcgtaggaggtaccaacaggtctgaccaatcatggaacactagtccaatcatacggctcccgatcgatttgaccgggatcgcaactccactccattcagaccatctattcatggctctttcacccatttaattaaaatgttttaattaaacatcacttcacaacaatatcttaggccctgttcagtttcagagataaaaagttttgacgtatcatatcggatatacggatacatatttgaagtattaaacatagtctaataacaaaataaattatagattagtctataaactgcgagatgaatttattaagcctaattaattcgtcattaacaaatgtttactgtcgcaccacattgtcaactcatgacacgattaggcttaaaagattcgtctagcaatttacacgcaatctgtgtaattagtttgtttctatatttaatactccatacatgtgtccaaatatttaatataacagagtgaaaagttttttttgcgtgggaactaaatcccttataatcattatcataatcaactgttcatcacaaactattattcttcaccatgattttacatattgttcacacaattgagcagtatgtggatcgacgatatgcagaaggcctatgcgtttgcatgtttatatatagtcacaagtacggtagaaaatgtgacataacaagggtacctaacggtgggggccagtagcccagtgaaaaaaaaaagagagaatccttatatgccactgaaaattggtctgattccttatatgtcattgaaaattggctactcccttatatgccattgatctaaattttcacaccctctcatgtcactcccgtcagttgaccgttaattctcaagaaaaaaagacatatttacccttctgattatagggcatgcctaacaactcagagagagcaaatatgtcttttttacttgagagttaacagtcaacacacggtcaattgacggtagtggcatgagagggtgcgcaaatttggaccaatggcatataagggaagagccaattttcagtggcatataagggatcaaaccaattttcagtggcatataagggattatctcaaaaaaaaaatgcccaaggagctagctgtgggtatgtgttcgggaaccctcgctcccttccctagctcgtgaaacaaagtagtgtttagcgcgtgattaattaaatattagctaaaataaattagaaaatttggattaatatgattttttaaagtaacttttatataaaattttgtttttgcaaaaaaaacgtactatttagtattttgaaaagcgtacgtgtaaaaaacgatagagatgagttgagaaagcatagataaggactcaaggtccgatccctgccacataattgggccacgtggctaaggcctggtttagttactcaaatttttttttcctaaaaacattccatcaaatctttggacacatgcatggagcaataaatatagattaaaaaaactaattgcacagttagggggatatcgcgagacgaatcttttgagcctaattagtcaattagccataagtgctacagtcacccacatgtgctaatgacggattaattagactcaaaagattcgtcttgcggtttccagttatgaaattagttttttcattcgtgtctgaaaacccctttccgacattcggtcacatatccgatgtgacatctaaaaattttcttttctcgaactaaacatgggctaaataacctgaaaggaagtttacatatagtaataacgtgccacgtatccagcagagcaccgtcgttccatttccgtgctaatttggtgtgctgcacacctatatatcggccatccgccccttcccatcccgcactgccatcgactctctttctcaggcacatgcacgagtaatttttatcaggcacagccatgggctagctactgggagcgccaaatggtgcgtcaatatatatatattctagtgtgttgcactattgtctggtactctctgcacctatagcaagagtgtatagcagttgcatttctgacgaactgacgaaagtgtgataccaattaaactcatctatatatagctaagggcacccatgttgattggataatctgtatgctaactttctagtgtgttattttgggtccattgaacaagcagtcgaacactggacaagccaaatgtaataccctatagcccccatccatttttcttcgggaccatgcatccgcgctccctgctctaccaataaattccaagctaacctagctttgagtttatgagcatgtttgtgattgacctaaatcataaattagaaacaaaagtggggttactcattgattatatcgatcgatcggcagatacaagctagtattttggtacagatcatgaaaagagattcgcaccttccaacaatagtaaaaatgtattttgaccaaaaattaacttaaacaataatgcaatctactcgtagtataatactacaagtagaaagcaccagagcgtcccccttatagaaaatatagatgtcgttcgtgtgataggtatttgctaactagaataattccattctccccaaccacctagtgaaaactgtaacctcttgagtgccaggattcagcatgcattatacgatcaaggtgcacaccctaaactagcgcatcaaagatggttaaactcagctatggttaaaaaatgcaagcttgaacaaacctgccttaaaatcacattaatcacgctagttgaagccagttttctccgaggactgatagtgtcacaagcacatcattatgttccccatcaccaaccaacaatttttacatatggcgttgtggagaaggcatgagagctgcattggccatctcaccgcatgtccatcaaccgagttgacaaccagcccataccaagatcacacattagattcctcatgccactcattccaaaaagagtgtaaaatgctcaagtgcatgtacatcgatcttgcacttgttaaaatcgatcgaatgataactagaagtatatatgtgtaaatgtttttgacagtgtgtggttatgaattaaatgatcgatggcatgtataaataatgccttatttcaatttgcaagcaagctggtaaactgatgaccgctgacatgactcacttgaagcatactaaaccagaagaaaaagcaaggttataaatggactgttctgacaaacacgttggctaatgtatttgtactggtccacaaagaattcaaaacaatactatcacttcgatctccttgcaacaaaaataaaaataaaagaacaaagtccattttattcccttgaactattttgctagcgagtagcgagtaaaatggacttcttcagaataaaagaaaaggtgttatatattccagcaattaaccgtatcggaatatattttggtcaaattttctctctctctccatatgtaagcttaatatatctacactaacttttttaccaaattgtagaatgtattgtatcaaatggattacaaactcatttaattaattttaagtcccaatcgtcctccctgtatagacattacgatattattaggaaggtgaaggtagaaaacctaaacatccaagcgaatccttgctcgcacgtgcaacctgtttacaagctagtccttctcgttcccgaccagcaaagctccaatcataacctaaggaatcaattagagtcgacctgcaggcacaatctaaaacggcgttgctccaatcatgttataccagcactctagctaacaaccatcattatttaacttcgactgcggaccttcagctaacttgttttactgacaccgctcattccgatcaaatgttcatgccagtcatgcatatttctcgaacgagcttcagtgacgtggatatcgagtttgtctctgcccacagactgaaactagtgccaaatcaacctggcaatctggacttgagtggatcaaatcggtcgatcaagcaattacaatttgtctttgttttttcttacctagcaaacaaattaactggagcaacccaaaagataaagttgaggatatcatgagcacatgaggcaggtgaagggagtgagcattaagtaaaagcgccagaatgtgctacacctatatttatacaaacgcatatatgggttcaaatatttaatcatctcaagtgcatatggataaatcaactgtaactatggacctatcgtagcgcttagagtttgcgcctttcagtaagtggtaggtagtttggtatccaggacggtttagtataggctaaattgtacattttaggtctgcaacatttttagcacatctgccttatcaacaccaactactagaaaaaccatatccacaaacatcccgttttattttttgaaacgggcttaaaaaacccttgcctataaaaatatattggactcctccagttaagacctgcttgtgtaaattatttttttttcaggtggtcatcttaggtggtgtttgaatctcctaaagatgaagataaagataaagattaaatgtttcacacaaaatgagggggtaataacgtgtgattaattgagttttaattattacaaacttgaaaaatggattagtctgatatttagagcaactttcatatagaaatttttcgcacgaaatacaccgtttagcagtttgaaaaatgtgccacgagtatccaaaattgaatcttgtgcttgcagaaggtctcttagggagatgcctgaaaaatcccttctatccatttggcccctactattgaacacctgaaaaaaatacccgtatgtgactctccaccatcttcaaaatattttactcgatggatactactgtcctgcattttctcctcctcccacatctttccgtctctcctcatcttgtccctctcctctccagcggatactgcaatagcagcagctaatcgaactacaatggtagcagcaaatcgaactggaacggcggcagcgggaaggggcggtggtggagacgccggatctgagggtggtgtttaaggggagagaaggggccgcggtagcagcagcagagaataagcggctgtggtggaggcaaaggaactagaccaaccggtgcacgcagcttgagcagaggattggtaagtgtcacataaagcctttcacaatgcaagctacacagattgaatggtcatgtgaaaaaaagttaattccacattgaataaaagtattagaagaaactcatcccaccgtgtatgaatccctagcaactacagaataatatcaaactaatacttttcgcttttcagtcatttcctctctcacctagctagtctctgcatcctttgtaaactatgataaggcccgaaggccgccttcgttttcttcatatggacacgaggtgtatcgcgagacgcggtatttgtgcgcatggagaagaacctcctacgtggatagttgaggctaaacgccatatacgtgcactgtgaaagacctaaccggctaaccccagtcacccactaatacatctgacatatggctctgtggcggaggcgtacgtgagcggtagctgcgccgtccatgactccaacccttcacggcctgtcatagactcatagcacgtcaatcaacaattcaacatggacgacaaccagcccataccaaggtcacgcattagtttcccattgccactcattccaacaggtgtaaactgctcaagtacaggtaaaccatgcacttgttagaacggttcggataatgatatatagctagaaacaagtcaaattgcaagctgattggggagatacatatgcgagaagcttgaatgggatctatatatgtgtggtgatggcgtctgtatgataagaagcatgcaggtataagagacaggagtttgtgaagttatgctgcatgtactggccatatatatgcacaaaattcacaattgcattgaaccctgtttgctgcttaaaattgaacatgaatgggtagtttcatatatagctgagtacagttgcacatggtcatcgtgtattagtttccacattaacataataacataatatcatctatcttctattacatattaaaagtccacaaacgctctaaagtcgtcacatgacacttctataaacgctcttaagccgtcatatggtactttttaatcttaccgttgattttcatttaaattggtggacccgttctaatctcactgttgatttattattttacactattagcttagatttattattaaaaaaaataataacttcctcctcctgtatatatgatacaaacacgactgctgttctgatccgtaggaacgtacgtacgtacgactgaaaacacgtaggtagtacgattgaaaacaaagcttaccttctgctggccaacggaaaaaatcgacggtcaatttattttttacaatatgaaaataaaatatattacttcacaactataaatatgtagttaaattaagatcgataataaaaatataaaatatcctatcaacgttctttataccaccttttattttttttaaaaaaaaattatatatccaatttattatcccgttgtattctttaaatcaaatcaaactataaaattgtaatattgaggtccttaatacatcagaacacatggggccgacatataatagtcagttatgtgataatttttcaaaaaattcacatgatatttaaatctacatatgtaaaaaatgaaaacaacacaatttagctgtgtttttcaagtatatctaagatttaattgtaatttatttgagattaagattcataaagttttttaatattttcagaactatttgattggtatttgagaagtgggcagcatacatggtatacagatatgaaaaaaaaagtcatcaataacatttccagccaatgatcttgctataattcttccaaatatttttgacacacatgaacaatgaagtaactggcacaataaactactcatattatattttcttatactacaagtgaactccaacggattagttattgtaaataagcttgaaaaaacaaatatattcttcaaattactaaaagtatctcatgtggttatgaacaataggtgttgaaaacaaactaggctttaaactatagatatctttcaaaatataaacaataatatggtgttctgaatattatcatggtgatatgtctctataactataatttttataactataatttttttaagtatcataatgattaacctcactcattttcaaaatagagtattctatctatatcatcaaaatttgagtagtaataattgacatcataaatgtcgacgtttgagatcgcgactagggtatttgcatagtatggggatcgttggtaccagggtatatgcaagattgaagtaaaagagacggaggcaaggatttttatacaggttcgagcccatcatctgataggtaatagtcctacatcctattggccgaagccgatgttgctcctttattcatctgaatcacacaagtacaataattaggataacccatctagctgtcgtcgacttggcggcatggataaccagctcgtagtcaacgatagggtagtcttcctcttcgaatacgcagtcggtgggatcagagatagtgctagatccctcttgccagcctccgtaggaaccggatgggtatgtctaggctaatctctgatgttgatatccagcggcatgtcttggcttgtattggtctatgttgatcctgtggcttgtcccctctcctcctaggggggcttgtatttatacccatagatgcccccttgtccaagtagaactaaggagaccaataagggtacaatccgggtagtccttgtcatttccatatagaactctactcatccttccttatccggaactccttctatacacgaggtttgtttccgtataatacatggtatatggtgggccctgccgagtttagtcaactactattaggtatgtggtatccataaccatggcagtagcccccaacttcaatgcaaaataacgagtccatgttctcgaccgaagacttttgaaaaactgttgtcgtgctcacttgactgttctcggtgagatcagagatagcgctagattccccttatcggccttcgcaggcactatattgggtttgtctaggtcccgatgtcgaccgagaaggtatggagcatgcgactaagtctcccgtcttgctgtaattgagaatttgaattgaagtcaagtaattccatctcgacgggtacaccatcgcttcattccatattccttgttgagctccatcaaccgttctcgagtaatcgagaaggagcaaagtctgtgacaaagcctcccaacttgactgttgtgatgcctgactttccttaaatcaatactcataactgaatactaaatagaaatagcccccaagtgaacgctcaagggtaacatgatataatatttatggaaaattgaaaataatttgaactgtgtatgacaataaaagagtactctccctagagttgccctcagcaaacgaagtttggtacccttcctagcccccagctgtttttatggaaaaactattttccaccaagacagcttgaatcttataacaaaccatgctgaagctgacaagtcctagcccctagccgtgaagttggaaaagtcaatttccgactacacggcttagttaatacgcatccattgagcactcttacatgaccatgtcttacatggtcgttcggctcttagaatctgataataccttatctgctctgggcgtcctcagccaaaattcccatgggtttcttggaggcttgtcggaacagcgtaaaggaatagtaggaccgacttcaagatgaaggcgatataagaaaagaggatcactagacaaatattgtacacataaacacttatagaagttgacatatagtgatgagacgacttccacactgggtgaagaccaagtgtatagttatacttaacaaatcgcagaggtagtgggagattcgctacattgctgatcaaagaccaattatagtcgtaactcgaccacttcagtttaaggtgcgagagatcgctacatcctactggcaaataaccagaagtgagcacctctcgaccgttttgaaatagaggtgcgaggaccgctacgttgctggtcgaagactagtcgtagtcgtacctcgacctttagaagtcgtggtacaaggaccgctacgttgctggtcaaagactagtcgtagtcatacctcaaccattagaagtcgtggtgcgaggatcgctatgttgctggttgaagatcagtcagtcgtacctcgaccacttgaagggaatccagagaaacaaatggacaacattctcgtgacctacgagaattgcctcctgatgacaacgaagacaatgaggaattatcgtagtcggaggttcggctcctagacctactacctcatcctcgggccctctaaaagtctggggatctcgagttttgtctttgtgtgatgtcgtgatgttgttaaccttgtccattgtcgctctgattctgttaatcctagacgttgtcgtcctggtgactacggcgatcctatcggttttggttgtcattgtcacgatcacattgattgttgtgttcgatgtcgagagattgctgtaaccgactggtcgaggaccaggagtaggcacatctcgattacctgaagatgaatttttaggtggtgagagatcgctacgatctactggtcgaggaccaggtgtatgcgtatctcgatcacctatatgcaattgataggcatacgaaaacaaaccgtattcgcgaaagcatctcttgttatccacgactccccttatcaatatttgccatacacacttggtcgatcccagtgtaagaccgtagagacatggagtctttgacacgatagattgagtccaacagtccacaagtgaatataaattgataggcgtcgagatgtcgctacagcagtctggtcgataaccaggagtaggcatctctcaatcacctataggggcgctagatttggttattacatgtgcatctcatgtggccagcatgactcacatacccaacttatagcatatccggatgtttgttcgcaatcatgtcgggtgatcaagccaacaacgtttgcagaggattatccgttaacaacctattcccaaatagtccagctgtagctgtcgctatacatgagataggtcgtcggttttcgttggtaggttgggtgcgacaactcagctttttttgagaatgttctcgataatggggtgtactcaaccacatcctactcgagtgctcaattgttcctgaaaaatattttcaagaagacaagatatatagcagaaaatatcgagcatgtactaaaaaactgcattaatcttctagtattattaggatataatgagcagattaagtatcaggcattatgtaaaccgtaaatgtcgtaggatctccggaccttccattataattgagagatgaaatgtataattcaagtcatcaaacaagtataatgaaatatccgacgcctcgagagaggaatattggagacattgccgggcctttagcctgccagtcaacttcagcctgagatgtacccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaaataagatgaaagcgattataaactaaatctactttagatacattggccgactggccaaaaaaaattatatagaacagcggaagcttgtctacccaatccacaagcacaccgactaggggtttaccccattaagttcaagtcctagaagaagcagtcgatcacccgcatcactcaaaggctaagtctaaaacctgcaagcaaaaggttaattccacagcaagagtcagtacattattagaaataatgttctggcaagcaccaagacaagcctaagaccctacttgcaaggcatataatcaaggaaggcataatatggttctttttagcataaagcaagttttatttgcataaaacatttctaaatcaggtttactttcaaataaatttcagcaagctagtatttgacatattgggcatcaaggtaggcattaatcatgtataaatatgcacctcattgccttccatggcagcaaggagatcattctcaaatctcatcacaatttgaagttaaatttcagcatttagaagaattaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccaatttattacccgcaacaaagcttttccaaaattcatgatttagccttacaccagcacgatacgtgttcctccatcctagtcatactggaaatatgacctagaaccgttaagtggcgggcccacgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtacacaactaatcaccatatgtgcaccacttgaggcccaaccctaaaatccatgttttccaccattttatttatcaaatacttcatttattcatatctgtccagaacttaataaaatcatttttcatgttaatatgagcccaagtgataagtaaaactattctaagcatggctaagcaatatagtgaactagtgacaatgtaactcatattccaagtagtactaggatatgattcctaaggttaggaatgagggagatggatatatatggggttaaggtgataatgcaaataataggagtttgtctaacaagtttaacaagattttaatgtattagtgtacaatcgacatgcaagatttgcaaacattttcaataacctccaaaacataggttcaaagtgatcaaagagagggaggtgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcatgatttgtgcagagagaataggtactggtataaaatgaatttaggtgaaagaatttctattttatctcattttatttgggagttatgaattttagaagtttcgtcggtatagtgtaggatttacttaggtactattgtgaaatgctgttgtaaggtgattcttattaagtttatgtttgctggggtgaagatatttgttttctaagactaacacatttggtttcataatttttagagttaatatgaattatttatgtattttacaagttttaacgtgttctaggcatatattccctatgtgtacatggctttggagatttaggtccagaacttgctctaacttgctagtgttgtataaaatgagtattttagttaactaatataatcttagtttataaaattttagtgttcagattactttacttcacattttataagctaggggatgttctatgttagaaacttaacatatcaatctagagagtattatatgagttaaggatactaagttttggtggaaggggatggatctatgccttcactggttcaacaagttttatttggatttatttggagctaccatgcatatatatatactttttcatatgtattgttttaaccactactatgtgtttagtacctattctaccaaattaaggttcagagctatggtctctaaagagggtgctataattcactctactaggttgaagtatattacttgctagttctatagaaaatttggttcacttcattttgactatagatgaattttctacaaatgttacaatttaaggtatgctccatgttgcttattccttacttaaatacttaggggttttcgttatactgtaagtatgtctttttattttataacattgaagtgcacaaccctatgattctactgaatttgggtttactcaaaaaggatctaagatgaattttatataaacttctaaagttcagcttatgtaaaactagtcattttaaaggtaatagttttagaggcattcgatgtatagtatgtatactatttcattttgctttataggagaacataagttggttgatctgtagaaactgagtttgctccaaaatgagttcaaatgaattttgtatgcattttataagtttgtgcatgctttatgtgtgatttaacttggataaattttagaggctaaatttgtactgtgagtgcaagtttttattccataacactaaagttcacaatttggtgagttcacagaaatttgtatcatcttaaaatgagctatatttaattttatatggattttacaagttttaggtacttttcttttataatttcagatttttgtttccaaggggtccactgtcagtgaaagatcaatatacaaaatgatccctgaggtttctaagaatcaacccgcagacctagcctcatatgtcagtgagttgaaaagttgcacattaaaccttatagttgtttaaattctcgaaacaaggtccctgacttcttttctcacgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatggtagacatggctggggtagctaggtttatgacggtggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgtgacagcttggcccgacttggtccagataagcgggaacggcgatgatgtcactgcggcggtgcacagagcgcgctccagagctccggtgtgcacggcagcgtttccgtcgattggctgcaccagagaggatgaaatcaaaaggagaaatattcggcatggtgaggagagtatggaacgcaagagaagaggaaacgaccgcggctcatcaacgattgcggccatcgtcttcttcgcggccggcgatggagaaccagtggagaagagcagcgaggatgctctccctcggatggatcggcactggaatggtgggtgaagagtggcgacgcgtctgggagaggcagaaatggagctcgtcatttttagggtgtcgacacgtcgtggccacgcgtcgcgcggcgtccagagccggtcggcgctcgatctctccctctcagtgtttctcggtcagctagggaagttgcacagaggaagggcaagccagagggactgacaagggggcccaggtcgaagtaaactaggtggaagagagatgtgtaggcagaaacatgggtgagcttggtttttggacgaatttccggaattattttctcctctaattttgtagcttcaatacttaatgtgttgatcagattagctagtgttgattttactggaggtaggtgtatgtacctagtttccattttctttggttgcactcaaaaattatggatagattactcacagaaattagaggaatatgggttctttggaaactagttcgaatttttaggagacctaaacagagaagataaattctggaaaaattatttttattcatgataaatgacctagtatttgaataaattattttacttatacacttttatgcagttaaatgcacttttagacaaagtatggttttagccgattaagaactacagttaatctagtttttattagtttggctgatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttctctttcctaaatgcatgtaaatgtttataaaagttatatttggactctcattaacctgaggtgatgttgatatgttagaattacagtttaccttacacatgtcataagctcctttcctatttatgcatgagtttactttagtattaaattaagagaatgcttatagagatgattaagatagaatataccctatatgatataatttatttgttcactttcatgttcatgacatgtcttcagatggatgtcaaaattagttttgtgaggcttgacattagccatgttgatattttttttaaggtgtatggtttctatgtattattttccattagttaacactaggccctaatggtttagttgtttatctagatcttagttaatattcatgagacctattatgaaatgcaaatcgaaaatccaaatgcataagaaggactcaagtcaaaatatgatttatgcaagtatgcatgctttcacttgggttgcatccaagtcctaggttaaagatgaaaaagtttttaatttgttctcaaattttattcttgcaagagttggatcaactccacctaggtttaaaatagaaattcttggtttacaaaattgaagaacttccctttcaactagttttgatggaaattccttaatcctagaattcaggtatgttacagtaaaccagcatgatacaaaagaaaatagagcgagcccccagtatttaaccgttgtcggccaaatacagggaacactcacacaatagatgtataaaaaatatgctctaggtaaacatagtagattattgatctgataatattgtagtgatctgaataatgggtacggtaaattgtatattaatagattaatatcaaaaattagtctactaaataccttaatacgtccggccggttctgggaggaggttgagaggggagcgctcactagtacaaaaaccgtcataggtgccggttgggaatcggctataagtgccggttttcgaaccggcacctattggtcggcaccaatacaagaaaccgacaccgatgtagaaaatagaaccggcacctttagctttactcgagccaaaaaaacaaaggagagccggctcaaatcgagccgaactactccccagaaaaaatcgaatccaccgtcattcctctctctcgcccagatctactccccttcttcgccggctctcagatgcgagatcaacttcaacaacaaaccgtattcatcaagaactagcgaacagtacaaaccattaaccacaagtttggaacaaaaactcaacaagtttagaactagaactcaacaagaaatcaaaaagacaaactcaagaacctatgccgccgggcgccacctcgccagcaccaccggcgtccctcaccacgctcgccgtcattgccgcatggagagggcgtcgcccaggtgcgccgcacctaccttcgttaggcagctgccggacgtggaagcccgccgcctcccctcccgctggatctggcggatgggagggtgcggccacctccgccaccgccgtctctccaggcaaccgccggtcatgggaac

SEQ ID NO: 25131 - DNA, 9437 bp, Oryza sativa
accgtaacattgggaaagttttattgttttattttcaatacgtacgtaacgttctgtatcgtatataaactctatggctgaacagtaccgtttctatgttatataatatatgaggaagttattactttttaataatagatctaatctaatggtgaaaaataacgggtctaccaatttaagtgaaaatcgacggtgagattagatagtgccacgtggtggctttagagtgtttgtaggagtgccacgtggcggcttaagagcgtttgtaggaagtttaatggacttttagtatataatagatagatagatagattttagagttttaaaatgcaagcatggtcaatcatcatcctacgtaattcaaataatatttaaatatatatttccaccattttttataatatgctatataccgatatagttcatcctcacttaattaatgttatatcacatcaattgtttttagctcatagatgattaatctaggtccaaattatctttctcgctttcttctctcgttaagccataccacctcaattgttttttgcccttagataattcatctatggtccaaattatcttcctcatcttcttctcttataaaaacacatcaccttacttttacatttggatcatcattctatatactatttaaattaccataaaccatatcaacttatgtaagcttatatcttctaactatcttatacattatttctacttattgctgtcacactaaaactcccacggcaacgcgcgggttttcacctaattaatagaagaagagagacgtccgagatgcaattacgaagaaacaacaattgaacaaagcatacaaaacagaacaaaagatagcaaacaagtcactccatcaagatcctcacaacatcctaactcttaagccttcttagccccactggtagcgagttaggggtgtagcaacttactccatttccattttccttagcatgcttctcaaactgataaatggtgcggattttacaaaatctttttacatagaagttttttttttcaaaaatcaaattaacatatttgctaaatttataataattagtactccattaatcacttgcttacagcttatctcgtttcgagagccacggaaaatcccactccaaaatcactttcaaattcagccttagctaggatcaaaatcagcggtagccccttatctcaagaatgatcagactatttaagcctttcctgatgacccattgcactaaactattagcccgactccaccaatcatcaaagatctcctacgttggtcaaaccggtagacggatccgctgcctccaccattgggagcgacagcgaaaacgtggatccgccacctttgccctcaggagccgtggcaacaggatcaggtggtgggggcaggtgaccggtgggcggatctaccgccccctaccgcgagaacggtaatggcaggctcagtcggtgggggcggttgcccgactggtggatacgctacccccgccctcaggagcaacggatcgcggtggtgaggcgatattggtgacggtggcggttgcaacgttgacacaacggtggtgacagtgacggcaacgacggcgacggtggcgactgctctagcgacgacagcggtaatggctagggcttcgggagaatcaagatgctcgcgtttcgggccattttttcgctgaaactattttcacgtgcggtcagcatatgtgactgcatgcaaaaatcccgttttcacatgcggttgcgctatctgcatggaaaaatggtgatttttgtagacacctggcctgggtgcagacgagacggccaaccgcatacgaaattctgtttcaatcggctggaagaaaacatttttttagtactgttcagctccacttttataatttacatgcggatgattacattcaactgcggaagcaaactgatgaaataattattggggctctaaaattccaacttttttccttaccattacaacattcaaaatctccagtttttgacattcttagtaccaaaacttttgtctattgtgcagtgtatctacaaagacatgttttttacttatccaataaatttgtacgagctcaatatattactcaaaattctggtatatatgttgttcactcaattagcaggttcgtgttacaacttccatttgaattattgtgaacaaaatttagatactgatatgctaagttgtttgatgacaattagtttgtacatattttcttaggcatatgaactcaatcgaagtcacatgcatgtgacaatgtgcatctatgggtttatatctcatcacattggaatgcacttttcaggttgatgaagtaggtctagaggaggtacctgatgttattcaaaattaccacttatgtatagtgaaaaatcgacttatagactcagatatcattgccaaggcaagtcagatgaaggtcattatgcaatatggtgttggaatagaaggtgattatgagtctaggtttatcttgccattttgaaaatgtagtggcataactagctactcttatactgagcatacaatggtttgcaggtgtcgatgtaaatgctgctacagaacacaaaattaaagttgcacggataaatggcagtacaacaggaaatgcggtgtcttgtgcagaaatggctatctatcttactctgggtatcctacggaagcaagtatgttttaataaatagatcaacttttgaccatttggaagtgatctttatgttttatcttttttctaaagcatgtgtactagtttgtacaaacacaatatttagacatctcaaactaggaagcatgggtatctatatatcttgatttctttatgaacgatggacgatccagtggcatccatcgtacaccaacgatgactcttttaaaccttgctttcttgtttatcagttcgtatgtatgcaggacatttattttgttctttatgatataggtcaccttcctatctttaaccatttggcagctaacttgcttgttttagttgtatatatataatctatggctgtcatttttaatgagctgcacatattttggatgtgttatacaaagcagaagatgatggatactgctgtgaaacgtaaggacctgggcagtccagttggagatacaatatttggaaaaagagtatgccttttgtgtatgagttacttgtttctttcactttacatggagagcatttcatttgtattgtaatttgtatttattgtactataaaggtccttatcttgggatttggagctattggagtagaaattgccaagaggataagaccgtttggagtaaaaattcttgccaccaaacgaaattggtcagctgaaacattgccatgtggtgagctgcagtatttgagttacttttcccagttttttttcttattttcctcctcttccaacgtattgcctgcgcagatatagatgaattggtcgataagaaaggtggaccagaagatatgtatgaatttactggagaagctgacatagttataacatgcttgctattgtcaaacgaaacagttagttcttctattggtgtatttctttatttctgttagaaagcctctacttcaatttcattactaaataatgaaatttataggttgggattgtggaccataagttcctctccacaatgaaaaaggtgtatgcattttgttcatgtcatttttgtgcatgtaacaatacttttaggttttatctcgttctccataatgagtaattgatcctacaaaagtagtgttattgttctataatttattctagcgtaaatttgctctatcatatatatattgttcttacaagataatctgcaacagtatactacgacgatgttggataataatgttataatatattcgatcaaaaagataatgttatattattgtagggatcatatctggtcaatattgcaagaggacacatactggactacgatgctgtgtttgatcacctgaaatcgggccatttaggtgggttaggcattgatgttgcttggacagaaccatatgatccagaggatccaattctgaagttctcaaatgttattataacaccacataccgctggagtcacagaatattcttttagggcggcagctaaggtttgcactaattcttcgaaatgcccatagccacttgactcatgtaattctctacttctatggttaagattgttttgacctacagctaagaatatattaacattgttttgacttagttaagaatatcacaacacgatttgcactaatatcaactttccattcttctgcaaagtatatatccctaaaagcgctgcctccatagtttaagctttgtaatatcctggtccaattagaatttggcctgtgtgacccatgagagttgtgtgtgcatgtttagtaacacattgagagctagtttagtaatagtggaaccaacttataagtgtttgtccctccaaccttatcactcacgggcaaaaccttttatacgaagcgaggatgaaagtattagtgggatgatatgtgtaagtgggcctgtccgtaggatgggttggctacatggttttggagggagggagcatggcacatgtgaactttgtgtgaggcacatggcatggcatatggcgatggcactaaacacacggatgtgtactaagaaggagtgtgttcctagacatttgcctatatgcatgtgtggctatgtgcgtaagttggatcgacggagacgtcaggtcctttgaggaggggtgacatcctggcctaattagaatttagcatgtatgacccatgagagctgtgtgcacatgtttaataacacaatgctagtttagtaagagtgggaccaacttataagtgcttgtccctccaatcatatcattcctgagttaacccttttacacgaagcgagaaacgaaagtgtaagtggggtgatatatgtaagtgggtccatcagtcggatagactggttacgcacactacatcaaatatactttggagagacattctcctaatactatagagatatttttaaaatgcctttacagtgttatagagacattttgaagagtgtctcgtaagtgccttttggtgcattgtctctacaaactaagaggcattttataatatgtctctatgcaaataggggcactttgtagaggcattaatatgttgcggcaactatagcaaatcactatgaaaaaaaaacaaaaaataaattattccttaccaatccttgaactcatgacctcttgagttgaccatctttatttatcccttagcaatccttgaactcatgacatcttgagttgaccatctttatcttcaatgcactaaccatctcaacctcatataattgcatgtaaatatgtaatttgtgttacttatatctaattacttgatgtatattaatatttggaaaaatgtctttacatcattttaaatgcctttacatttgaggcaagtttttaagtgccgaaaagatgtctctacaagataaatttaacaaagtatgataaaaatgtctctaaagtgtgtctagagtaaaaatattttaggcgattttgaaagtgtctctaaactatagagcttcaaaacttagaggcattttgaaaattgtctctacaaaagagcctctatataaggtttttgttatagtggtggttttagaggaagggttgttacaagcttgagaaaattccttatatacccctgaaaatttactcaatcccttcaatacccctgaatttgacatcatcccttatatacccctgagttttcattttgatctcctctatacccatctccgttagttgaccattagttgaccgttaaatattttaaaatgactatattacccatcctatacatatgtggtacctacccaataaattttcatatgaaaaaattaacttatacaaaatacaggcaatataatcatttaattcccaacttaaaaaataaaacttactatttttttattttttaaaaattattattaaatccatacattagtttcaccggaaaattaagagcaaaaactaaatggtatttaggtttaaatttttggaagatatatgaaaatcattacaatttgatctaaaacttatttaaaacatttaaaatttgtttttaaagttgtgataaataattacatccctttattttttcacaacgaatcttttttcactaaatatttgttgaaaagtaattttcaaattttatgcagaactttttttacaataaatcttttttattttaatgaaataatgttttatttttaaaaattcataacaaatatttagtaatttatttcttattggttttcacaattcaaataatttacacaaaacatttctagcttttaaaaatataccaaggacaataaagtattttctacaataactaactatcaaactaatggtcaactaatggaatgggtatgtaagggatcaaaataaaaactcaggggtatataagagatcaaacaaatttcaggggcgtagaagtgattgggtgaaattacatgggcatgtagggaattggccctacaagcttatacctttgtaatcctattggtagtaccttgagccaaaggtggagcgcccgcgacgcgacggcagagttggtcacttgccctagctcgacccactcttccagccagagcaacccaatgccttccaaaaagacctttaaattttatgattatgttaaaattaaatgctttcttaacatgttttgagatattttttccatttctaaaagtttttatatttctccttcacttattcaactagaacgagtttgtgtttcttggctataataagcgttcaatgataattataaccacctcaaataattggtatccagaatgattagttattttaagggggtggaatgtttgacgcgatatggataatagaccaaaccgagtgagaaaaacgacaatcagagactataaatccataatagatgtttaactgtttcattttttatgaaaaaaaacaatatttcttactaccttgccagttttgttaggacaactccaggtcgcacatacagtgatacagaagaaatatcttgaccttaagtggcacttttagcctccagagcagtttgttaatagcagaacgtacgactgacatgttatactttctcattagaccttaatttgtccgcagccagagttctctctttggatcagattattggctttctatttggatcaaattatttgctttgaccaatggcatctttggaaccatccctgagtaagaattctctgctaataaattcatcacactgaaaaaagggaacgtggacataagagaagcagaatactaatgcggcacaaatacattcatctttcagatgatagaacagcaacgaacaactgtccatgtcttaaatactatctctatttggtagcaggtaattggattcaaaacaagattagaaattgaaagttaatggccggggtatatgagatgaaatgttaggtaggcaaacattattgtgtttttttttgcggggagacatctatctattatctatctatctatctatctattatatactaaaagtccattaatctccctacaaacgctcctaagctgccatgtggcgttcctacaaacgctcctaaatcgccacatggcaattttcaatctaactgttgagtttcacttaaattgatgggcccattattttacaccattagattagatctacttgaaaagttattgctacacccataacatataagctttatacatgagaaagttttacgagaaaaattaaagtatattccgatcggatataaacccatacgtactgctcgcttaaaaaaaacaaacaaacataagtgcagctataaagccaaaaaaaagttctacattgtacattgaagccgtatataccggaaaatcatgtccatacgagtgaaaccgcttataccgaaaaatctacgtacgtacacacaattgaaaaaaaacagaaactttaggtactgtttatttaaaaaaaaacgaacgtacatatgcgaagacaaaaccaagaaaaaaatgtacttatgcgtagacaaaaaaacagatggttttttaaaatagtattttctatagtagaaaaacaaaacttattacttcacaaatatggtaaaaaaacgtacaataaaaaatatatgatttgaaaatatatgttttcagctacgcgggcattctttaaaaagttgatctaacaatatatacagtgactgactttatttatacatgcaagtgaaatggtaccggaagaaataatatatagtcacttttcttttataatttttcatatacgtttgaatgacatgcataggatagtaaatggaacatggaagaatatacatgcataggatagtaaatagaacatggaagaatatacattttatgagtgaagtagataacttacgtatgaattctaattgtttttttatcataaataacacaatggtccaaatagataaaaaaatgaaggtatgatttaaaagttaaaaattataatgagttaaaatatatttttacaaataaatatataattcagaaggttctggttatttaaaaattattgttgcaaatattttcataaagagaaaaagggagaaaatgtaatcaagaggataaacttcctacaaacgcttctaatccggacatagtaccctataaatgctcatagaccaccatgtggcactctaataaatcataaaaattgtataaaataagaaaaaatcccgaccaatcggttttcatttaatttggtggacccattattttcaactattagatctatcttaaaactacaaaataaatttatttgtaaaaaggcccatgtcgtattggcacgaccggcaaaaatacatgcatgtaggtatgtaggtattccttcttaagaaaagtacgtacctacgtagagtatgtacacaactatttctatgaacagtgcgtatacacaccgcgtcccacatccttatttttttttcttctcatcatttggattagatggaaaactaaactaataatttaaactaatatcaactatgctttgagttgtaaaaatatatgctatttcgagttgtattcaaattaggtgcatgtcatcaaaacacccataaaaaatataaataaattgaaagtatagattatgtgatagttaaattagacttacattttccaaaataaaaacaacttcaagtgtgtgtagaatttcaaaaattactcactctctcttgtaaaaaatactgatatggaaaaatgatgttataaatttatcagaaatattttttatgtattatgtgtttactctattcatatattattagaaaattgaacatcaaatatattcatttcacaccacgtcaatatcttttttctcctacttagccttcgttcgatctagctcattgact

SEQ ID NO: 25132 - DNA, 429 bp, Oryza sativa
  unsure (1)..(429): unsure at all n locations
nnnnnnnnnnnnnnnnnnnnnnnnnnnnnnnnnnnnnnnnnnnnnnnnnnnnnnnnnnnnaagacatcattgaaaaacagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacctccaaatgtttcatatgcacttagtgcaacaagccaataccaattacatccaggtgagagtcactgg

SEQ ID NO: 25133 - DNA, 716 bp, Oryza sativa
ttttttaccggttggcttttgttggggttgtgggcttgtgggcttgttagaggcctagcagcggccacctagtggcgcacggtttggtgctaggttcttccttaagggtgtgtactggtgtcgtctgcacacatggttgtcttgtgggcatggttgctcagcaagcggacctctgttagactttttctgctataaaatatagaaactccacgtgctattcgttagaaaaatgatgctagcgcagtgcgctaccagtgacacctttctttccaaaagaagaggagtgttcttttcctcacatgaatgtgtcttgctaaaaaaagatgcgcacatacactttcattaggccatcaccaatgcgtagcctcgggtcatcccctcgccgacggacgtccggctccgtttgccgtccccccacgagagagcgcgtccctcagctgggagacgcgtcccttggtcacttttggcttagggatgacatggagcgatgcgttgggggtgacgggctcctgtggacaccgtagctccaccaccaaattctcctttcacccctctcccctctctctctctccggttcccctcgaggtcgagccggaggaggcggcggctgccgcggtggaggcgtggcggtgacgccggaggcggagaggacgaggatggaggtggggcgaagagggagagagaggcggtggcgcaccagatctgggtaccgagct

SEQ ID NO: 25134 - DNA, 675 bp, Oryza sativa
  unsure (1)..(675): unsure at all n locations
ggcgaattcgagctcggtacccatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaagtataccctgaggggactcactttatgattccatggtttgagaggccaatcatttatgatgtccgtgctcgtcccaatcttgtgagccttcttcacctagcacttgccttgtgttccggcagcggagacttccagttcgcctatcatgggttcaccggcaccaacctcacgctcgacggcaacgccaccgtcatgccagatgggatccttgtgctgaccagccgcaagaccaacctaaaaggccatgcgttcttccccgcgcctctgcagttccgcacatcgcctgatggcacagctcggtccttctcggcccccttcgtgttcgccatcatctccgactacaccgatttctgtgcccacggtatggccttcatcgtgtccccgaccaagaacttcaccaccgcactgtcggttgggtacctggcccttctaacgtncagaacaacgcaacacgaccaac

SEQ ID NO: 25135 - DNA, 745 bp, Oryza sativa
ttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttgatcaagaatggaggggatcacctaagtcaaaatcaagtcattcatttaactctagacaagaccattctcacaaaagaatcgatccgatggatcaaaggtgaaaaatgtgaagaaggtgtgggtgagaaaagaagccaaa

SEQ ID NO: 25136 - DNA, 5276 bp, Oryza sativa
  unsure (1)..(5276): unsure at all n locations
nnnnnnnnnnnnnnnnnnnnnnnnnnnnnnnnaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaggngcanggtncnccaaagataacagcaaaaaagaaaggagataaaaaaagcttaatcagaatgtcagccttaaaaaattcgctccactttatagtaataagctttgtactaatggccgatgtatcaagatccttggcagtatacagaagtacaccaaggaccttgtatgtttcactttttctttcattatagtacattatactgtaaaaatactcaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccgatgcctgtttatagacacatgcatgcagcaaatgattccaccgtatattgaatttattaatgattgataaataagcagcattcaagcattagtgtttgctttacaggaggaagaaaaactgaaggagttgaccaccccagcagtaaatgtagatcaaccaactccctacttcccagctaataataattgactcactccaaggggaggagcagcaagaaaaaagattaaaaatgggaattatgagatcaagaaatggatccgatcgatcatgctcgccaacctccaaaagatgaggcatgaaaaggggagcagactcgccacccacaaaacgataaaataactgatgatctctgacatgcaagtgaaaatattcaggaacagattggaaagaagcggctggtaattttgggagcctgaaaggatggaaatgatgcggaattttgggctggaaatcagccattgattaactagcggcaatgcaggatgaattcgcgactgaaatcgagaggggatcagaaagaacagcagaattgggatcagagggatggaagcaactgaacatgcagggacgcatacctggtgactcccctgtagatagaactcctcttgccgccgccgccgccattggaagaaggatcagccacctccttgctctccttcttgggcctcttggccttgccggtgctcttctccgtcctcggcctcgccctcctcttgcagggcatcgacatgggcgaagaggaatcctcggaggaagaggaggaaggagacgacggcgaggatgatgcagatggagaagatgatgcaggatcaggagacgatctcttcgccatgatctctcgcgttggtgcaggtgcaggtgaggaggaggaggagaggcagcgaagtggagcccctgaagttttgtaatttatagcggagggggggaacgaaaggaagtgcagcgcagagatgggttttttgggttgctaatcaccatcatcagcattaactgaagatgacacctctgttttttttgtatttttgtgcgtcagggcctcaagctggccaccatacgagtcaattttgatacacttattcattattttttttcatttcagatatttcctctgtttttatacattattattgatgtaagtgcgcattccgtttgtgcacaagtagtggtcgtattcagatttctttctctttctttatttttgcagatttcggtatacgtgcagacgctcatatacatacgtgtatactcaccttctataaatgcatatgctatctctatgaacacctttgaagattaggcaaggatattggcgtttctgaatagacataattttcaaaggaagcacaccggtaataatatctttgagatttgcgaagatacaggacaattttacatagcatagcagatgacgcactggcaaattaactcaagataacaccttgttttttgtatttttgcgcgtcagggctctgctggacaccgaagattagcaatcaatttcgttgcacttattttaattggtttctttttgagagatttcctctgttttaattatattattaacgagtctccaccaaaaccctggtatatcaaacaggcacaacattgagaacatttcttatgagccttgaaatttggtggggattgttagaataattgggttaggcccaacttataatattaaatctcaaaggcccataataagtgttgaggataataataccacctcaggatttaagcgagaaatatctcaacctaaatagggagttattggaggctccctgttgaccagttgaggtgggggtcggaatgccacacgcgcgcacgcgcgcgcgccgggccgggccgtgggcgagggcgagggcgtggctggcttttgcagccactaacccacgttcccacgattccctccgcaacagcgctttcacgttcttttctcctgatagataaggaggccgcgagtccgatccgatatcatcgcttctttcccggtgttagtttctccttctccgcgcctgagttgctctcgcttcctcgcttctgatctcttacgcgcacgagagattggaaggagcagtgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtgaacgacaacaacaacggaggcaattctgcctcaccatccagcggagggccattctcagggtataatcttctcctcctgctactattgttagcgctatcgctatactatgtgcgctatgttcttgttcctgttctacatgatgcctctagcatgttatcgcgttactgttatgttcctgttcctgacattcatgatgtgcatagtatgctactggttatgtgaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtacgtcatggagcagttctatgactacaagatggtcgatgaccattctgtagtggaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagataggaagtctgccaacatggtcattagcgaggggggaggaacatcggggtacggtaaaatgttacctacagttctctctgtttatcattcacctgattggtgggtggacactggtgctaatattcatatatgtgctgacatttctctgttttcttctaatcaggtcgggagaggttcctccttgttgatgggaaacgggtcgcttgcggctgttcatggtgttggtacggtcgatctgaagtttacttcgggaaagaccgtgcagcttaagaacgtgcagcatgtccctttaataaagaagaatctagttagcggctctctattgtgtagagaaggttttagacttgtgtttgagtccaataaatgtgtcgtatctaaatatgggacttttgttggaaaatgttatgacagcggaggcttgttccgcttttctttgaatgacatgtgtaataatcataatgctgtgaaccatattagcgagaatg

SEQ ID NO: 25137 - DNA, 867 bp, Oryza sativa
gaaaatcaaacggttaaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaataggaaaggaagaaataaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtggttgagcgtccatatgggtgcaagcccgtaggatgcaaatgggtt

SEQ ID NO: 25138 - DNA, 656 bp, Oryza sativa
cctaccatgcaggaaagaagagaagcacatcataataatgagcccttttcaagggtctcttctctcagtcacacaatagtttgtttcaccatccaaattcacgggatctccgatcacaatggacaggtttccactattatgcaaccttaggtgggtatcaagcccatttccctcgatgcactgtctatcacattacgtggtagccccttggtaaactgatatgccagatttctagccgtttggacatagtccaatgctatcaccccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgttagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccata

SEQ ID NO: 25139 - DNA, 598 bp, Oryza sativa
  unsure (1)..(598): unsure at all n locations
nnnnnnnnnnnnnnnnnnnnnnnnnnnnnnnnnnnnnnnnnnnnnnnnnnnnnnntctcccttatctttgaaaaccggtgcaaataaactccttcaatggttttgcaagcggttttatcctacgtggctcttatgggacccacatatcagtaagagcaaaatgaaaaaaaaaacatctcatcctttttttcctcacctctcccgttctctatttgccggcggagtagtggtcggcgagctcctttgtctacgcgcgccacggcaggcggctccttccctcacgcgcagccggttggtgttctcttctccgcacacgccgtagccgcccaggtcctctccacgtgcgtgatcggctgcagcgtgggcgcgataacgtcgtggaacaagtcggccctctcatgcttctacctcttcctcctccggttcttcttcttgaaatagactctatgcacaaatagactccaccctgtcgtccccacagcaccagcaacccatcacattggagctcctccccgcacggaatgacgccgtggagacgagccaaggagcaaagaaagacgttgcggtggctaacgcgtcctcccacccatcggtccct

SEQ ID NO: 25140 - DNA, 677 bp, Oryza sativa
tggtagttgttatttgaagccttgaggttctatttgttcctttagcaaccaacttctgctccagttttgtccaattcgacgcaccagaaaccctgcaacaatataattctttcaactaatgggaatgggcagacatccttgttctcctgtcccagtattgagagcaaaggcactgacggtatggtacttgaagccagattttgcgacccatcagaacttgtcaaggaaactgtcaactccacagtttctggtgatttaacatacatcactaaattgtaggtctttccatcttctatgttctgcaggttgatatgacaattaagggcgatcaaagcattggaaaggaagcattgcaaaagttaggaaagcaaatgtttaccatattttgcccaacacaagtgcacgaaagaaatatcgctacatgaaaatttgaaacagaacgtgtggaggtccatgatttactaggtaatttcatgagaaaatacagcaaaatggtagcagtactatgaggaaaacaaactaaagaacaacaatacataaacccataccatgccccagaatcctgggttataaatgccaacaccaccagctgggcaattgtcacagagaacctccatccttagagcaacagtattccgactgaaacatgacgttcgatcagtcgccacaaatatgga

SEQ ID NO: 25141 - DNA, 788 bp, Oryza sativa
  unsure (1)..(788): unsure at all n locations
ctggaccggcgtgcacgcccggaaggaggagctccgtcgtctgctgtaaaacagaacaatggagaagggggaggaaggtcgtcggccccggtgacctggtgcaccatcggccggaagtttgccgggtcggcgctgatgtaggtggtggaaaggcgccgcgacgggcgcggtcggcgcttggcgatgcggcgccggccggggccggcggcgccggcgcgtaagtggtggtgaagagtgccgtcggcggccggcgtcgtcggcgggggaggcataaggtcgggaggaagccaaggggaggaggaggtggaggagtcgagcatgtgcatggcggcggtgagcatcgacgatgggtggatgctctgctgcgagtgttgcgcgcggcgaacttgactggggatggacggacacttcaggggagacgagggggtggcctatatatggacaactttttttgttatttttatttatttttcaaataaatttagaaataaccccttgatatttttcttcttaagaaatgaatcttttaggtatggtttggataccaatatcagtgttcaataaattaatataaatataatgataaattatgtcatcaaagtttcatatgcaaatagatttagaaaataatagtaattagagagaaaaaaatgattatcatgaaaaaaaaactcatctgtctttactctttcttacatgaaaatgatacatgtaaaaaaaaaaacttgcaaannnnnnnnnnnnnnnnnnnnnnnnnnnnnnnnnnnnnnnnnnnnnnnnnnnnnnnn

SEQ ID NO: 25142 - DNA, 14084 bp, Oryza sativa
gtgttgaggataataataccacctcaggatttaagcgagaaatatcttaacctaaatagggagttattggaggttccctgttgaccagttgaggtgggggtcggaatgccacacgcgcgcgcgccgggccaggccgtgggcgtgggcgtgggcgtggcgtggctggctggcggcgagcatgcgtcacgtggctatgcttttgcagccactaacccacgttcccacgattccctccgcaacagcgcttccacgttctttctcctgatagataaggaggccgcgagtccgatccgatatcatcgcttctttcccggtgttagtttctccttctccgcgcctgagttgctcttgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgccaccgccactgctggcggaggtggtacgccgctgacaggagctcgatccggagctggtgcgccaggaggtgccgtgaacgacaacaacaacggaggcaattctgcctcaccatccagcggagggccattctcagggtataatcttctcctcatgctactgttgttagcgctatcgctatactatgtgcgctatgtgcgcgctatgttcttgttcctgttctacatgatgcctctagcatgttatcgcgttactgttatgttcctgttcctgacattcatgatgcgcataatatgctactggttatgttaagatcaccctacactgcttatgccatgatcattgctttaactttttggattaaaatatgccgattaatgactatatttccaacatggtacacacctgagattctttctggaaggacacaatttccacggagactacaccgagtcactggcaatatttgccgatgttgaactgccttttgcccaagctacacttcatttttacatagcagggtacactaggaagtaaacaagctcataaatgactgcaaattaaacgttactggagatgaaattttttgtctatattgttactgcaagagctttcacctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccatacctgactgccaaattatttgttttgtagtagatcatactcaccaaaatggtttatcacgagtctgttttctgaccacatttttgtctagacagtctgctgcaagacggtagttgcccagataattaggccatgtttagtttctaaaaactttttcctaaaaccatccaatcgaatcttgacatatacatgtaatattaaatatagataaatttaaaaactaattgcacagttagggagaaaccgcgagacgaatctttggtgcctaattagtccatgattagccataagtgctacagtaacccacatttgctaatgattgattaattaggctcaaaatattcttctcacggtttctagataagttatgaaattagttttttcattcgtgtctaaaatcccttccgacatctgatcaaacgtccgatgtgacactcaaaaaaaaatttcttttcggcccaacctgactgactgtcgattagaccgactgacgtcttctgtcaccaccatgatgtccgtccagcttgttcacattcctcagcagacagacatgcaatcacaacaattaacactaggtttatgtaccatatagtggtccatgatgcaaaaatattaatattctcaactctaaattctactacaaaaaaaaagagtgacatgttgcttgtagtacaggcagtacggtttggttgttaaccacgtttctcatctactttgcctgcatttgaggtgctagagtgaagataaatcctaggttgccagattattcaaatattcaatcaagataaaagaaattccaagcttttccatctaacatctccctcattagaccagaaacatgcttgcttgcaagctactccctccgtattttaatatatgacgccgttgactttttgacaaacgtttaaccttttgttttattcaaaaaatttatgtaattatattttattttattgtaacttgatttatcatcaaatgttttttaagcatgacataagtatttttatatttacataaaatttttgaataagacgagtggtcaaacgttgattaaaaagtcaacggcgtcatacattaaaatacggagggagtacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttagaaaggatgaaatgtgcaaagatattgcaaatagaaatggatattgtagaatcaaatgcgaactgtttcagagctgtccacaagaatagatataatatttctttataatactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctgatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataacaataggaatatgaaaatagctacaagatgccaattaatggagagcaaagactgtactatttctgaaccacatagtaaaaaaatttaaatgtttaaaagaatgttgatggaggttgttgggtacttcggttgatattcctaaaaagtacttcatatctcaaaacctcagtgaagtgaaccagcattgatttgctaacctcattatgccaatgacgatcagttggatagtgggtttctgcaatgcttgatccacctttgtcaaaagatgtatttctgttcttttgtgggatgttcacaactgagtttatttgagggtcctccagtgatgagaaatcagtgctatccaatgtcgagatcgatacacattcctcaaaataattcattgcctcttcagccaaatgcttcgatactttcagtcgttctacactactctggtaccacaacatggaaacaaaggtcaattcaaatacaaagaccatctatatttatgagcaactgcacttatcgtatctttaaatttcagaaaactacaactttaatgataaaaccatctatatttactgtagcagcatactccctctgtcccataaagaagtaattcctagattcccaatgcaaaactaaagagatagataaatgaccaaaataccccttattaatagcatattagtattgatggttaggtaggtaaggagtattgaagaaataaactttttcgatttgtgaaccaagtgtgaatgagaaggtagaagttgatttattttgtgacaaagtttgaattccagaagttgatttattttgggacagaacgagtataacgtaaaagttgtagttttgtgataatttttcacgttattgttgcagcaaactgatacttttatcactaaagttacagttttcggaaatttactcttctttaaaactacccttaaaacaagcattgaaaaccaaattcatggtggataacagaatgaccatgtagaaatacacaataccatactttcttatacttataagtcaaaatttaaattttcagctttaaatttggagttgattttagggttttttttcattatagtttattttccagatttttcttttagatcgctagaaacacatatataaaacttttattcatgaattatattccgtttaccaatatgccgtttggccaaacgatggccccgtttacctatagccatggctctagccgatgtcgttgaaatgtgggatgggaccaagctgtcagtcactgtcactaaagacgcttctacctccgttctaaaataagtatagccgtgaaaatccgtgtctaacgtttgaccatccgtcttatttaaaaaatttataagaaaattaaaataagttagtcacacataaagtattattcatgttttatcatctaataacaataaaaatgttaatcataaaaaaaattcaaataagacgaacggtcaaacgtgagacataaacagtgtaaaactccacttattttaggacggagggactactactaaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacatcccctttgatgtttgaaatgaaactaagaaaatcattatgaatagatgtttacttgagcaacagcaaactgtttagtcgcattcggatattcatcaaaaattgctgttctcgttcagaataaagggaacattcaacaaaaatgtttctgctttaacgcaacacaaatggccaagtgaaagtgcatctcatgtttaggctgagtccatcaatcgtgtgtttctaggctcgtggatcaccaatagttctctaggctggccggagtattctagattcgaatttaaacatcaaatttaaatttttacagttgttttactacttcctccatttcacaatgtaagtcattctaacatttcttacattcatatttatgttaatgaatctagacatcaatatgaatatgaaaaatgttagaataacttacattgtgaaacggagggagtaatatattgtagctgcattttctttttttgtaattgtagccggtggtttcggaaaaaaataaccggttattggcaggtaaccatcattgatctgaactcaaatatttagtttgaaagtttgtccgataaaggtttggataaatgatgttcccaaacgccaaatacttattactccctccgtttcaggttctaggacgttttgactttagttaaagtcaaattgctttaagtttgaccaagtttgtagaaaaaaacaatactctctctatttctaaatatttgacgccattgacttttttaaatatgtttaaccgttcgtcttatttaaaaaatttaagtaattattaattcttttcatatcatttgattcattgttaaatatacttatatgtatgcatatagttttacatatttcacaaaaattttgaataaaacgaatggtcaaacatgtgctaaaaagttgacggtgtcaaatatttagaaacggagggagtaacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaatgaagtgtgaggttgggcctacacatgtgtccgtgctgggcttgaggtccagcaagcaacacgacggcccaaacaagtcgctgacacctcacgctgtggagtggatccactcaatctgggccacacaagccttatccgacggtagcccagagacccaagggggctcggagtctaaaactccgaaccccctttgtgttttgaggcgcagcggattagcttatctctggctgaatatcatcaaaatttgtatattttccaagactaaagtatctttgtttctagacatgaacacgaaaacaccatgtatgcattagttacaggaatcatgtaaaagaaacatatttgtttgatatttattccctgaaccttcctaaatgataggtgtttcatcatattccagtattccacttgtacaagattggcctatttctaaccacatgcgcatgatctgtgagactgagaccgtatgaacttactgtcggttgcttttctgcatataaattcagtacgtctcctgccgaatgtctagcgttttttcttctagcttgtcaagactctgatgacatatattgttcttatcagtcttcagcttgtctcaaaaacgattcttgccacaaaatgtgtatccatggtgcaaattgtgtaggtaatcataaagctccttgctgacctttagaacattccaattttaagttcagagaccgcagatggttctattcatttcagaaggcccttttgcagtcatacaatgagcatgtgacacaattagaaatgtagacaagttgatttccactcttctaatgtcccatgttccatatgccatctactatggaagtccaagaatgttagaatgattgacaggggctagaaccaacttggaagttaaacctgacaaatggctgatcaaatctgtggacttacgtggattgaagagaggagttggtagtggctgaactttgctagtcaaaaaacgaaaaaacaaaaaagatagtatttgaacatatttaaaacattaacaatagttgctacctcattgtcaaagtttgtggtacagttgcctgtgggaaactttgaaactatgaaaactgcaatgacataataataatagtcatgtactcaagctgtcttcagattcaggtatttggtatgcattgatgtttttttggaatatgaagaaatgcattatccatgtgattccatattgccatctacaatcacagtcaagtagaagcggccatgaacttcgcaatgattgaagagggagcaatgcaaaggctcagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggggttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggactaacaataagatctggctatgcaaacaaaagtaaagtctaactaacttcacataatcaagaagagttgaacaaactcctcagaccaaaaggaacagttgtacatcacataagccgcaagcctatcctacaaatcctcccaattcataagcattaatcctgcttcacgatgcaggactcgccaactatcagatcaatcctcagggattattgtttaatatacaaagttagcacaaggtgcttcctttatagcccaacaattgttgtagaatcatcattgccgttgggcagatggagattgctgaacctgcactggtgggaagaacccagcacctggtggttgaaaaaatccagtcgaggtcggcgattgctgtggtgcctgtggagactgctgctgctggggctggctctggttctgagattgtgtaggcagaggcagaggtggaggcacacttagtcttggaaaacctgctgacataatgttgggcaatgggggtggaggtggcgcagagccactcaccatcccaaaaggtcccattccaaacattcctccagtattttgaacaaattgtggcataagtggtaatggaggtggaggtggtggaaatgaaccagctgcttggtttgcttgggttggtggctgtgtgcctccaagagcagctgttgctccaatctgtggttgcacctgcggcagttgcccaaagaatgggggagcactcatgtcactagcatgaatggggttgtcaagcctaggcttcttattgctctcaaagcctggaggtcctgcagaaagatctccagaagtcgaaccactattccttgcttgttcagcagcaagggaagagaaaatggaggagagcaccttctcaggagctgacaaagatgcaagcttatctgccatagctgctgcagtttttttgggctcatcaccaacagcactggatgtggcaggaagtgaggttgctggatgcagtggttgaaactggggaaatatcggcattgctgctgaattctgcatcatggcagctgtttgtcctggtggaagtgtaaccatcagtggactagaactagatcctgcaccattgttcaaggcactaccaagtcgttgttttagttgcatggcatgttcagcctttgctcgagccacctgttaattaaatcagggttagccaaaaatcaatctaaataatttcttgagtagctgctaaaccaccccttcagtggcaggaaagatgctgtggttttaactgagatggtagatagcaatgttaacaaaagccagcggagatggatactacatagggaacagaaatatgtgattggaaatttctaacttaagatgcaatgacacatgtttgcaccatggagttagcaggttagctacatagaacctaggttacaattaataacaatgcatgcgcatgggtatatcactgcaggcatatctttatattagctcgtgcaagggccaccttaaccgtatagcttatgctgtagagatagtcagacctcccaatgtgctggacctaattctcttgaaacagataaagagagaaatgtcatatataagcaaacataagttggaattgagaagcagtctaacaagtaggaaatgacatgttgccttgttatccagagtaggcctcagggttgccatggtaacttttaagaggcaggtttgtgcttgaagcaggatactagatgagccagacatcatctgtgctgcccaagctgaccatggttagtctactacttccatcatagagctgaattgtacagcagattcagcaactatccagtttagaggcttctcttcgtgtcagagcatacaatgtgcatcttatgtgttctcatttttgcttttgtatttcctagctctactcatcctgaacatgtgtgatataaattcatgaatgaatgtcgttgacaaagcaaaactctggttgtgctcacatgccatggactcatggggtcttaggctaggcatcaagaatagagtctagctcaaagcaaatacaaaagcatatggatccatgaaaatgctcagcataattttgaccctaactttccattataattgagtaataacagacatggcataagaaatagaatgatctaacatgtgattctgcagtgaaagatgaagtaatatgcataaaaaaatatatcctacaagcaactgattgcgaagaagctctgactttgcttcctgttataaagaaagaaaaaacataaagctttatgactgtaatagtatgccgtcaaggtagaacatttggaagaaaatataaaaggtgctcaagacctgttcgccgagggcttttcttagtttattgattagggttattctagccatgttgacactttcaagttgctcaatgcact

SEQ ID NO: 25143 - DNA, 9805 bp, Oryza sativa
cgtaaatgtgcaattttcaagtttacggacctaagtaataccaacgctctagtttaaagacccgccatgtattttactctttcagatcattagagctaggagcatttttaataggaaactttgcactacagtattttttactctgtaactcattaaaatatttagtcaaatttgaagtcagcaattgtcaataatcatggcctacaggcctagtgtgcactataaaggactcaaggaactatcacaatgtaaaataattaagctgctggatgtgctccacagaataaggatatgtatgctagaccaccacctatgaaaacaaatgccagaaaattgattttcttccctttatatgccaatgcatgctacaatcacatcattatagtttttttaacataattataaaattatgtacagcaattttctttgtcaacatgctagatcatatttatgtatttgagatgtttgtttagtctagaatttacatggcagatcaacaaaaaaccggaaatactatgtaaattccttttttctcaagtcaagtacatgatggaactagaagtaaaatagcgctggaacaatcatgatgcaatacaggccaaggtatcagaatgcattaagtgccaatctttcgacggtacatatccataacataacagacctattgaagtgagaaaaatgctttaccttgagtacaagcatcatctacatctttatccatcctatccaaaacactaacagcattattgcatttgtttaaagctgtgtcttcatcaaaatgttgatcaagcactgactgatatgctgttacaatcttttctggcatcccgccaacagtaagtttctacatcaaaagacaaaacaacaaaaatatctctatcaaattcatgacaatatactgcatccatccttagcacaagaaaatattttttagcaggtcaagatctggcaacttactcttgttactgtaccagaatctttccgcgcagctttggaaactgaagaggggttagggcttggatttgagctattgacattgttacccattgtatgagtgctaccaccaagaatgtcatttttcagactttcaatacgggttccaaagaccttccgctcatcccaaatatctatctgtaattttaaaaataaagttttttttttactttttgggctatggccttgtgatagagaaaatgaagtaaatagacttttccaatgtaacggaattaagaataacttactaatcttccaactactttctttccatcttctcccccattgacataaaagtctttcaataatccaggaagaaccctccaaaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcatgctattgtaatctagatgctattgttaaaaatatgctgtgggaatttggtatcatgactgtgtaaatgatttttacggcattgacatcaaacacaggaaagcaagtggtaagactcgttcagaagatattacatagggattcgagttgctaatatgtaagcaaacggacatgacacaaccatcacataatcccccaccccctttgtagcgtgaatttatggatgcaaatggataaatgctatatatatccttcttcaaatgccaaaaatttgcaatttgcgacttgttttttttacaaccatagggaatctgttatttgtttaattgatgacagtatatgataagccctgacctaactgcttaactgatttagaaatgaagataaatggtcataaaagaatcgaaaaggttgtttattcatttgccagtactacctccgttcaagaatataagaaattttagggttggacacggttattaagaaagtaggtagaattaaatggaggaagattgtgattggatgagaagtggaactaggtgggaaaattgaatggatgattgtgattggttggaaagagaatgttagtgaagaagttgttatatttaatcattcctttgtaattttgtattttctccctctcttccttttgtaaatcttttcttattaattatttaatatagcgcagtaggagcccctcctgctgttccacgtcaaaaaaaaaaaagaagttgttgtattttgggacaaattctgaaggctagaaattgttatattttgggacggatggagtacaacattagtgcaaccaaatattaccacattgtatttcgaacatagattaatggataccatcgtaaaaagcagttccacaaagattgtacaagaagccatcaagagaccaaaaaaagtagaactagcatatcagtaccctgatagcagcaaccaaaaggaaacaaagtatgtgatatatgattgattctacccattagtttgtaaattgaacaggaaaacagctatattcaaatccacaagagaacactactacaatgtgatacaaacctaacgctccttatcattactccctctgtttcatattataagtcgtttgacttttttcttagttaaacttctttatatttgaccaaatttatagtaaaaatgagcaacattgaaaacacctaactagtttaattaaatttaacattgagtatattgagtatattttcataatttgttgttttgtattaaaaatgttagtatatttttttataaacttggtcaaatttaaagaagtttgactaagaaaaaaagtcaaatgacttataatatgaaatggagggagtattagtcaatttcaaaatataatcatcctcaaaagacatagaaaaacataatttttcacaacaaacaaaaaattattacacatcaaacagaagaatagaagatattactaattgtaacacaacagcttaacaaatcgtgccattatttgtcatttttcaaaagataatcatcctcaaaagacagtgaaaacttattttcccaagaaacaaaaacaaaaggaaagcatgtattgatagtaagaacacatcaagccaaaattgtaatataaatttgattgccaatagcccaatacaccgtaatgctgataagaactacaaatattttagcgaggttaatttatatatacagctataattgaaaataatataggaaaatatgcccaaaagaatgatccagaagctagagaaaaaatggccacactaagttatatttgtatcatcgtacacatcaataagtattgataagtaaaacattagatgcagtctaactctagcagcaataagcacagctaggaacaggtgaaggtgaatattaaccaaacaaacagtgcaagagccaatatatggaacgccaaggagataagctgtgtcagttgtactaatccacattgcaatttagggttctattcaacttgaacagtaaatcaatcaaaactaccagacagataatataagcaaccaaagtaagtactatcctaatagcactagcataccactacgctaatagcaccaaccaaaaggaaccaaagtatgtggcaatatgatcagttatgctcattaatttgcaaattgaacaggtaaaatattccattctaatgtacaagaaacctgtataagtactaagtagaccacctagaaaatattagtaaaatgtaacacaaagcctgaatgttccttatcatcatttttcggtttctagacacagtcatcctcaataggcattgaaaaacattgtatttctcaataaacaaaagatcattacatatcaaacagaaagatactactccatcaaaaaaaacgaattccaagctacgaacctggacacacaggtgtccaggttcgtaggtaggattggtcttttttttaggacagagggggtactattcacataatacctaacagttcatgccattacttgtcatttttgtaaagataatcatcctcaaaggatggtgaaaaacatattttcccaagaaacaaaaaagaatggaaagcatgtatacagtaagaatgcatcaaacagaaattattatacaaattttcattgctgatacaccataatgctgataagaaatccaaatcttgtagccatgcacatctatatacacttatacagctataactcaaaacagtatatcaaaatatgcccaaaagaatgatccggaagctacagaaacaattgccacactaagttatatccatatgcatcaatacataaaccacgagatgctgtctaacagtaataagcacagttaggaacataagaaggtgaatactaaccaaacaaacagcgcaagaaccaatatatggaacggcaaggagatatcctaggtcagttgtactaatccacattgcaattagggttctattcatctggaacagtaaatcaatcaaaaccacgagacagataaggtacgagcgctaccaaatttgcaagcgcacaagaaataaacaaccggaagaaaggatactctggatcctagtcgccgtgttgttgagcttgttaagcttctcaacaaacgcctgctcgctgaacgagccagagccgccgccgccgccgccgatagtttccgcctttgcctccgccttggtgtccgccatcacgaaggcgaaggctccaccaccgaactcctccccctcgcgaacaagctaatcccccgaagaaacttgtacttcttggccggccaagatcgaaccaatcctaaatccccccctaaaaaaggcgagaaaatcaggaatttggaggcgagagattgaagcttggggaggttttgggagggagagtgacgcgtaccccggtggcgagctcgtcagcttgaattcgccgccggtgaacgacgggaagggggcggcaaggccggggtgggcggggaaggggaggacgagagggtttggtttttttttcccctttccgtgctgcgtgtgttcgctgcaacctgcaagcctcttgggttcaacaagcaagggtgagggtttttcacatcagaacatgagagggtgaaaaaaaactgaagataatgttattggattggaattttatcaaagatagctataaaaataaattaaatatataatactattggttttattcatgtgagatttgaaaacgtgtatacaaatatgctatacttttttctattaatatacatacgttaaaacgtgttatttgtttagcgtacaatgcgggctatattaaatatagccataacatttatcgcttgaattatacatatcgcttttggtgatatccttacacatttaatgttatgataagcctcgttcatttattttttccaaataatactcgctacatccctccgttccaaaatataaggtatttgggctggatcggacacattctaatactataaatctgaatttaagattcatagtcatagaatgtatcacatccaatcaaaatcctttatatgttgggacggagagaatatattttagcaacatattaggttgcactttagccctaatgcttatgtataatcacatccaatctctccctcagtaatgatgtaacttgcacgtaaataggagagatcgtcctcatgaggttgttgatgtgccacaaagagagtttgaatagtccaaagtgtaacaaaacaaaaaaaatagatgatccaaagtgaaaaaaaaatcagataaaagtgctccaaagtgaaacttcgataacataggggactaaagtgaaattcactcaataaaaccatgatcacataacatgtgcattaaaaaatatctttacactttttacaaatattataatcaaatgtattagtaaaatggacgatatactcgtagctagaatagtatgaaacattttaccccgaaacatggagggcatgaaaataaattgtaaaatttaggattttgtgttacagatggctcaagacctcacgttttatgaaatttactcattttataatttgaggtactttaaatataacatatttctactatgtttttaagatggatggtcaaccgttatgctaagtgtaatatcatcgtatattaagaggatgtacataaaaaattaaagggaaagaaaagggaaaccaatggtactacagtccatttaactccattcctcatttcccaagtacagaaaactacaatttggtaccaagcggatccgaagagataaactttttatctactactaccgttttataatataagtcattctagcattttccacattcatattcatgttaatgaatttagacatatatatctatctagatttattaatatcaatgtgaatataaaaaatgctagaatgacttacattgtgaaatggaggaagtagatagatacagaaaagaaaaaaaaagaaactaaatatactcgcttgtacattgaagcgctgctagatgttgctccgtagcgctcaatgtggggagcttcaccctgacgagtcgtgaagaagcagagaagattatggttggaacgccatctccatctccatctgcaccagttgctgtttcaaggcggtacagcttctggccagcggcgaagttgccaagcagctggtaggaggtcgcggagccatccatggtgaggcagagatcgtcggtgcacgccgcgagctccttttgtgtgcggtagatgaagttgagcgccgcggcgacctcctcctcgaagcgggagaaggggctcgtggtgtcgtcgtcgtcgtcgaggcgcagcttgcggagcttgcagaggccttccccgagctccatcatggcgccacggtggttctgtgtttgtgcacgatcatgtctaatcacgaattttacagaagtgtttactgattactatgcatagttaaatgtggaaataatgagacgatgaaaatatatatacttggttgaagaggtggtggaaggcgacggcgcactggaggatggcgtggagcagcgtccgggtgggctcctcggcggtgtaccagagctcctccaccacgtcgtggcacgcgtggaactcgccgccgttgaacagcgccaccgccgcgtcgaagctcccacctatgacttccgactcctcctcctcatctccttcttcatcggcatagttctcgtagaagtcgtagtcaccccgcgctgtgaggaggcggcggcggcagcggaggtcacgacgagaggaggatcggcgctgcgggtggtggagcggtggctgtgggcggagcaagaggccgcccgccggcaacagtatccgcggtgcggtgggcgtgcgctgctgcggcagtagccgggcggcgtgcagcgaagcggcggagcggcagggcgccagcgccggcgccataggaattcaacggagattgctctgcttttgtccggtgaacgaatcgcgcgcgtgtgatgtagtagcgtaggaggacgtgtggactcaaccagaggtgagccgttgagacactcgtgcatgcagaaccaatcaatggagtgagtcaaagtgtcaaacccacaaaaatatctaactacaggcccaataagcaacagcccatctggcctagccagttttcccagcgtttcgggtttggaataagtctattctaaacccttcttgcgggcaatttaattggacgtcctaaaccaccggaccccaaatttttcttccttaacttttccaaaccatttggattaaattcctataacaatatggaggattgttttagcttatgtggcaccctagtcaaaaaaaaaaagtagaacccacatgcaagtggccttcaacctccacacatccctcaattccctatccgtccacctcttccctcttttcaccagagcgactgccagggaaagagggtgatggctggtgcacccgtccgtgaaggcggcagcaacggtgggaaggaaattggcgatgagggccggcctttgatgggcgaccggtgggcagtcacgccgagcgtgaagcccttccttgcctcctccaacgccgacgaaaagggagatggcgttgtggtgacaacaccaacgatggtggatctgcctcctcgcccacccatgtcttagcttccattttcccgcactatcagagctcgggccgtctccgccgctagagagatagaaagatagaggtaggagagacccttgcctcatgcaacattgctgaacaaggagatggcggcggcggtagcgacggcgacgagatgatggcggatccacctccctgcccacccacatcttgcttccgtctccctgtgctgcagggagctcagtcaaatgtacgcacgtgctaggggaagcgtgtacggtccactctcgctgcactcgatggcctcaacctcgatctccgccctcaatacccccacttcctcactgtgtgtacccctgggacattgagagcaccacgacacggtgagttcaagggaaaagtaagatgccacacaccatagtctgcttcactgtcaactctctgtctattggcctacctccaccaccaccgttaccatgaaaccaagagctatatcgctcgttgacctcctagatgatatcgtcgtcgacatcctcacccggttccccgaccacttatgcctgtgccgcgccatgtgcagatcctagcgcaccctcatctccaagttgtgctgataagtgggtctggatatttgccatataagcgaaaacaaaggaaaaaaaaggtctatactgttatgggatgtaagttatatagtttaggggtaaagatttatgggtatgggaataagggatgccaatcaacttgacgtaaagttaagggatggttggacttatttctttcgcgttttccttgggtttgacaatgggctacattgcaaatactcgggccgacccacccaacaagatctgccggtaatatacatgggcttaattctcaccaacagcgacgggtgggctcgatttcgtgggccttgtatttggcccgcacacaccaacctgtcctgtcctgccgtcctgcgccgttgcgctgccaatctcttcttctcttcccgcgtctccttcgcctcttcccgccaatcgccaaatttcccccatctcacctcgctccgtagccttctatcccaaaacttccttctgctcttgctaggctagggtttcttccttcctctacctctcatccacagattacgagatcgatccagcagcaggggcaagtcagtcgagtggagagcgatggcgccgctctcgtggcgccaccacacgctgttgcaggcgctgctctcccgcgggcccctctcggagcgcgacttccacgccctcttctccgccatcttcggcggcaagaaccccggtatatgcttctgcctgctccgcttgctactctcatctttcttcttgctgtcgccaacgcttgtctcattactcgtagcacaggtgttcgacgtaatgcccctttaggaattactatcatctcaaatggaaacaatcttagtttgtcccaatcttctctcagattcagataatttctgcttcatttcaccattgacgcctggttttattacctaatattgctcacaaatcataaaaatactatgcgtgattttatataatttccggcctaaggggtgttaatattcccataattgaacaaaatggtttgcgaccattcatgttctgtatcactgcttgcaaccactcatcggcatctgttcaatgatacactcctcaagatcaacaaggagctcgcatacttgcagtttgagttaagagcaggcataaaccagtatgatggtactgtgtattatg

SEQ ID NO: 25144 - DNA, 8041 bp, Oryza sativa
  unsure (1)..(8041): unsure at all n locations
nnnnnnnnnnnnnnnnnnnnnnnnnnnnnnnnnnnnnnnnnnnnnnnnnnnnnnnnnnnnnnnnnnnnnnnnnatatcgatgctcttaacacacggattgnnnnnnnnnnnnnnnnnnnnnnnnnnnnnnnnnnnnnnnatacccagtcactatgagagcttttgtttctgtttaagcaaatgttttatatttgtattgttgcaaacttttatggtagtgtgacgaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcatacgatcatttcttgatctccgaagttggttacgtagtaatgatatcccatcatgtgaggtctgcaatgaagcttgcataaaggtgcagatatgtgattacgaattacgattctacatttgcatttatcttgttacccatggtcatatactccactaatgtcattccctgtatttctattacttatttaaaacaggcatcatcttgtcctaatgagggatgcaatgtaaggattcacgtgtactgtttgaagaagaaattttctcagagaaaggtagttacctatttttaattccactttacacatatgaacaggagtggctttctaaattgtttgtgtatgtaggcctcgagagcttgtggttgtggtactgaatggcctcggttggagggtgaagatgacggtgctgaggatgttaacgaacctgaggaagatcaggtcccatcagccaaccagcattcgaggactagacgcagaggagtcaaatctgaactggtggaagaaaatgaaagagcaggcccatcagcgaggatgacaaggaggagtttgagaagctctaaagcggaagcagttgaggctgctcaagaggtgccatctgcagcaggaccttcgcagtcaaccagggcatctaagagaagaaagaactaatgagattgatttgtgcttgctagtgatatatccaggttccttttgtcatgtacagacagtagcagtaggtaatccttttgaagtggcaggcaaaattgcaacttctagttggagaggaatatatagctttaggatgctcttgttactaactcttagaacgtattagaagcttaatgctttcatttggcaaagcaagcctgcttgtgacagcccagttaactgtttgaatagctctcttgcttggtgatgctagtttcatgcatgctgtttttatcctctatgttgcttgtttctttcggccccatcttttcggttatgcttatgcttatcagccaaaaattgaattttcaaccttaaatttggagttgattttggggtttttctcatcaaagtttatttttcagcatttgcttttagatcagaacacatatataaaagttttattcacaaattatttttcgtttgcaaatatgccgtttcgcttattggggacttttgtgtctcttattaaaagggacaatttaaagctcagcacagccagcattgtgtggttgctgactggtataaacactgaatggaaggttgcctaggagtcaggaggaaaacccaaaaatagagaaaaaaaacagagtggatccggcaaaaaagagaaaaaactgagtgaggttagtttcagggttgagaatatcctgaacaagggcagccaagtcacaagtatttttgtttatatcattatatgagtgtgaagatgaagatgatcctcacccagctgacttaactatagatgatggagaacagcttgttgagtcctggacttacttgcttgacgtattctacttgttcttttcatttttctctttttgagggcgtattctgcttgctgatgcagctatggtactctattcgcgaacataggcagcttgcatgaggtacggtccaactcggagaaaagaaagaaaaatagaagaagaaaagatggctgctattattttactagatgtgtgtttcttgcatgcatcattcaggtcctgcagatttaccatattactatatagctaaccaccccgctggaaattcctagtatgttgacatgcacacagctagttgcacgaacaaactgaagttgggcagtcgccatctagacaaaatcaggggatgactgagttcaggcgaaagcaaccatggcgacaattggtgaaaacacgtacgcgctgcaattagttattgaaacgttcaactcttgatttgattgatggccccagatgagctgagccttaagaactaagatacatactttgctaaactagtatatactccgttttaaattatttatgattctagcttttatcgtaagttaaatatttgtattttttgactattaattcttaaaacttcatgtggtttagcattttagaatcaacataagaaacactttcataatatagcatccgcatgttgttaaactatccgaattttaaaaaattgatggtcaaagatacaaatgtataatttaggataaaactaaaactacatgtaatttgaatcggatggagtatatttcttgcggtttgagtaagatcataccgtttaattagatagaagagaaaaggaagaaacacccaagagcctagtatatcctaaggcacaaagctacagctataaattactcgtcatgcagacctacatttccctaagtttcattctttcccgcttacccagcacacgttcatggacagccgctccgccactagcccactatactttgcatcctaattaatcctcttgtcataattaactaaaccaggtcacgacagctcaatatcataatcattatgctactgcctacttatacatgaccagggatcttcagaaagcgttcaaggatacgatttatttcctttgaaataatgtataccccttaaaaaaattttgaaaagagatgaatgaccacagctagaacataaccttggagtaggacaatcaaacaaagtttcagactgcttgctaacgtttggtgaataaaattataaaagagacgggggcagaaaactctcagcaacctcgttggacgatttcgtttttgtcgtcagcacaattgcactgcgtcaattaatggacaaatgaagaaagcgaaggtacacggacgactaggcaagttgatagcacaccagttaaaacgaaagctaacagcacaagcacacgacttgactgacttactattaactacaggcaaggtcaccgaccaacggcaactgaaacttacttacattgttcttttctgattaactacactggccatgttcgaatcaaattttatctcggttttcattagcatatttttcaaactattgagcggtacgtttcgtgcgaaaattttctatatagaaattactttagaatatcaaatacacctatttatcaagtttataataattaaaatttaattaatcatgtgctaatggctttctcgttttacccaacttcatcttcatcactgatgcaggggaggtgccattttggtagagcaagatcaaagatatgatcaaatttacgcttattttgtacaataataacagacacttatctgtaaccacaacttcatcagttacatctgaaactgagtaaatatccgattaattcattcttcattcgcacaaacagaaaacagagaaaaccatctgtatttcaccaattacatctgcaactgcaagtatgcaaaatgctacactggtggtaatccactaatcccctcatcaacagcttgaaatgcaccccaaaattggacactaattatgaaattaattcaattcacaggtataataagtactgtaatatctctctgttcaatgcacagctgttactagctatactaggctgtagccgttaatgtactacccatccaaccatcagcggcggcgccgccgccgccggcgatcaccaccaccaccagagcggccggaccttgaccatgcaccccctgttcgccggcgccgccgccagcttgttcaccgtcacctcgcacctcgccttcacgtccaccgtccacgtccggagcaccttcccgaacctcaacctcaccggcacgatcgcgtccacagccaggggcaccgcgccggcggcctgatccgcggcgagctgcttcctctgctcctccgtgaggctcacgcctcctccggccaacgccgtcgagaacaccgtcacgttcctcggcgcctggtggaacgcgggccacgggccggcggcgagccgctcgccggagtaggagacggtcacctcccgccgccgcggtagtcgatgccggtcttcttgttggccccgttgtcggcgcgcacggcggcgtcgatctgcggagttaacgacaacacggcgagggcgtcgagccccgaatgaaaagggaggcnacgganaaggacggcgcgagtgggcggtaacaaggtagtcgacccctacaaagcggcgggcgagnaggagcagnagaaggaccccgcagaaaggcgccgcagcacgcgtgncggacccgccgtcggcgtgcggnccgcnccncnagcttcttgtancggcgcgcgcggtccggcggcggaacgcggaggacctggtccttggggatttggatgatgtacgtgcccggagacggcggcggcgcgccgcggaagctgggatgcagcggcgtggtctccgtggcggcggcggcgtcgtgtcccgcggaggggaggaggacggcggcggtggagcgggcatggggtggacgcggtcggccatggggggtggttgtgaggcaaggtgttcgacgaaatgaagagtgaccgagtggcgtggcgtgcgagtgggagtggtcgcttgcttgccggatatatatgctgcccgcgtagcgtagaacgcgtgagaagagaacaaacagacaaacacgcgggaaacggtcatctgacggtattctttttattttttttcttttataaagataaatctcacgatatcctgttcatactctggtactattaaataatttcactatctttttttctattgatagttagtactctttttttatgtatgccaccgttgctttttcgtataacgtttgactatattaaaagttttagtgtaaatatgtaaaattagaagttaagatttctttggtgacaaaacaaatcataacaaatatttacataatttttttaataataagaatggtcaaacgtcatgtcaaaaatcaacgacatcagacattaaaaaaagagagagaatagtactccctacgtcctaaaatatgagtatttttaggttgtttagaaaatcttataaaggttaagtaaaaagatttcctttccattaaagtagtggtaaaatattaaattatttagattctcctcccaagcatttgattggttgaaaatgcatgaatttttatgcattggtacatagtgacgtaagcgggatgtaaaagttgccacatcagatttgtacttacgtgaagaagggaggacagaagaaaaaagaaaagcggactagatttgtagccaactacacgactggcttcaataaactatgtgacggagatggatggattatgtattattgatgtaatatatattacaattatgtagtatatgagttggtagatgatgtttcaatttttgaagctaatagttgattatattattaaacttactgcaaaggacacatatttttagtttatttagtaaagagtaagctaaaggataaatattccctctcagttgtctcattggttgattttgtgaattgcttagccccccttcctaattacctaagtgactaaaaatacttagctttccgtgtatctgaattctgaagtagtacctggaaatgcttatattgtatatgaaatttaaatagtagaaatacttatattctaaaataaagaaagtatattgtggtacaaattttaaatactaaaaatgcttagggtccttttaatttggaggaaaaacataagaactttggaggatttcaaccatatagaaaaatttcctatgaatgcttttgaaacaaaatattaaatcatatcctatcatatccttttaaattcctatgaaatggataatctcttggaaatttttctttgagtctatctctctcatccaattcctgtatttttctagctgtccaatcaacggttatttctatgcttttcctgtgttttcgatcacttgctttgcacttgcattactattagaatccagactttttttctatttctccgtttattcatttatgagattcaaaggtggagtagtattattttaagacaaggtgctactttatttacttatgtcctgcaggagttggtgtgataatttgatcaaggaaatgaatagcgtgggttcgatgatgaatgtgaatgaaagagtcaaatattatgggggtttactacggaattaggtacaagctactccgtagattgtaatcatctgaaagagaacgttccgttctagcactgatttttctcaaggtgcctcatactgtacctaatttttatatgatcctgtctgaatgtgcttgttatcttgcacttctctgcgtaagatgagatgtttatctattctagtattctactatatccaacttaagatatccgcatattcgaggaagtaattatttttcttatatgcattgctagtctaaacaatcatgtgttgtacatgtgtgaaaactgaagctttttgtgtctgtgaagaatacttccatagtaatcaattatttcctactatgtaatatactagtagttcaaaactatccacatgtgtttgcacaaaactacattaaaaaaaactcgatcttggggaaagaaaaaatagtcccttgggggacggagattaaaactcccaaccccttggcatcctttgaattgaagcttaaaaaaaatggtccatgggttggagattaaaactcattgtaacatatgaatagtgcatactttctcaagtagtttaatgtttagcacaaacttcagccacactttaaaaattttggcaatctattttacaccagaataagtttatataatccaataagtttataatattatgagacaaatctacgtatatcattttgaaaactaagcatttgacaaattattgatgtctagatttttaaaaatgcaactaaatatggtcctaaatgtcaaacatttttaatcggaagggatacatactaatataatcgtattgaacagtgaaccacaactcttgcagtaccgaataatctctgtaaactctgttaaaaaaaaacttaatcctagttactagtgccttgaaggaacaacactttaaccttgtgactgttgtttgctactgtacggagtataagttacagaattgtgagtacaccatccatatcttctggaacaagcttctcattgcctcctcgcgcccaaaacatccatccaaccgatatctcccttttcggtcgatgatcatttgctccaatattaacgcatttctgagaatgtattttgctagctccacctggcctgtgttgccacaaaatccaaatatgcacaccatcttgagatgatagtgaggctgatccacgatgtcatccaaatccaaagggcacctgttcaagctacaatacatctgcaagaaatttatgtcatcattaacaaggagcaaagctaacacgtaataattagggaaaagaagatcaaagattcatgatcgaggaagagaaggagaaggatagcctgtatatcttgtcaaaacaaatgcgggggatggaattctgagattttgttagaaaaaagaagcttttgctctgtttggatacgaatatattcaatcaaggaaacacatggctaatcggtttccaaacatattatcaccttgattcatactatttggtatcttgtacagtgcataaatatggtgatgtgatgatcagggtaaacagtgatatcgatatagcaaaagcttctacagatggcccaaattattatgattaaaatttacaaag

SEQ ID NO: 25145 - DNA, 3213 bp, Oryza sativa
caatgtgtatacaataacattgcatttggagtgaaaactaaacaagagaacacaaactaaatattagcctatctccaaagtcttgatgatatcgtcgaagtgtgccaattcttggatgatggagaagaaaagatgtatcccctcctcaatgaagtggaccttggagccttcacaaactgttcttcggccctcgataccttgaagccttcacgaaccgttcttcggctcttcattgattcagagatgttgttgatgatgatgacaatagaccttcacaaattgttcttcggtcctttgactgatgatgagacattgatgttgatgaaggcccttcacaaactgttcttcggaccttcactgattgatgatgatgatgagaagctccgatgtggagatgatgaagtgacaatgaaggccagctccgacggggagctgatgatgatgaggaccagctccgacagggagatgatccatagatgggtttctagctttctgctgctttgctcacgaaggactctcccgaagcctcatgcggctgggcgacaagcagacaaccacaacggccatgctgcccagcaatggagacgagcagcgatgacctcggtgcaaggacgcccggccaaaactggagccgttgcggacgacggcggcggcttgccgccggcagctaggacacgctccgcgacctgaagaatggtggggacgagcggcgtggataagcgacgcgacgggcgtggcagcgagagtggatggtggaaaagcgggcgcggcgccgcaacggacggcggctgcgaccggcgaatgggaacgcggtgacgacgacgagccgcgggcttgctgcttggagacgaagacgacgactgactgatggacgaggatgaacgacgacaacgatggctcgccggcgatttggcagctagggtttggagagaggctctgataccatgtgaattctataatgaaattggggattaaactgttcatccattgagttggccctaagggctaatatgttgagaagagtacaacgcaaaaagacagaaataccccttaacacatacacactaatacatatattcttaacacaaatgatatagctacttacatccaaataaagatcctccaaaaatggagctgctacgaaaagataagccaactggagactgaatttctatcgaatgaacctctctcaaaagttatttccaaagttacacttcaattgagtgaacttgagaggcgattgtgtaaatccagacatctggagggtgaccaggccacacataggttcaaacaacaagatgtgaaacagaaaatcaaatagaattaaatgtatatagagagtacaagaataatcagacctgagttttgacattaacttcaacgtataacgtttcaacatgaggtaatacacttggaattccagttaatatattttggagggttttctcatcaaaaagtctgatggttgatgctttgatattggagcattcattgagcgttaccaatgccagggaaccgtcgtactcaaatgttgtgagattcggagcatgtaactccattctttgtaaatgacaaccctgaattgacaaacattgcagacggcataatggttccgacacatgtaaattatgcagctggttacatgattggatgcttaaccactctagaacatggcatttcgatattaactgctctaaatgttgcaacctaacattgtcaagagcaagcagtttaaggtttgcaaatccgcagaaatctagaggtggattcaaagtaacactgtcaagccgaagagcctcaaggtaagatccattatgtttgtcgaaaatatgacaaggaaagtcatagttgttttcatgtgatttccaatctggggagaagtcaagaatgataacccttgcctttgatgcaatagcaaacgcaacccagccattgacatggttagcatgctcatttgacaaaccaaacttaacagcaaacttatttaccattgttccacaatgtttttccagaatagcatcaacccttttaatgaacttgttagcacttgatattctacagttcagatcagagcttgttccttttctcttggcattatttccaaggactgttttaataccaaagtacagattaggatggaatgtccaagcctgtctccagtttgttgacacaacactcaaccgagcgacttcctttaatgttaattttgatattacccttagtacaatatcctgacaatgcattttgaacaagcatcagaatacagcctcctagtcctagcacaaaaggagttgagagtttcatgacttcatgtcatgatatgacatacctcgggaagagactgaaaattaagcagacatggtcttgtcctctgtaaattaagctgcccccgacttatcttctgaaaattatgttgtgttcttctcctcttactaatacgttgtccgcaaattatacaattccttttggctgttgtgctcttactcctgaaaccaacaatcagcatgctctgccagtatgcaatgatacttctttcagaagttttaagtagcacacagaattgacttcttgaaactttttttttagcaaaataacacatatgtcagagggtattttgcattattattagtagtaacagtacacaaataaatgaatataagcatataatgtgatggaattctgccatgtaaggatgcctttctttagattctctatttatttattttttgcgggggcctttgtttagattccatatcgtattaaaatcacaagcaaataaagaaaaaggtgcatgagttgggagtcaccttccatggattttcgaggagacaagaacgttgtcctccattgttggacgtggaggcagtggatcagggacaagagaaaccctgaatccctccaccgcaggtccgcagcccaatccaatcagcagactcctgatcccagcaaggtagccatgaagggggatggaatgatttatgattctgagacagggagaggctatttagggctggagccgctcgatcgcgaggcgcagcatcaaggagtcgaccggaggttagggatgaaggctcatcttttatgggccttaccggtagatggccgtacggcccatatacaggcccataaatcagcccatatcgattttgactgctagtagtagtatttatttgagaggatataagaatcgtattctttttcttcaatacgaat

SEQ ID NO: 25146 - DNA, 6061 bp, Oryza sativa
  unsure (1)..(6061): unsure at all n locations
ggatttgttgccgcaaaaatcaaaataaaacccgggtgtgttgaggagggagaagatgaagcaaacgagagagatcgagcttgaggccgggtggaatcgcgaggggatgtcatggcgaagcggcgggcagagtccgagcttgagctggtggaggcggaagcggaagcggaggcggaggcggaggcggagaagaatgggaggcgagcagcaggtagtcaggacggggtgaatcgcgcgttcatcctcgagtgcagcaaacatagcgatggatcgatctacagcggcgacgatttttggcacagattttacaaggtcgccgatacccgagagagtaagttttaacttttaacttcttgcaaaccctagctttttcccctctccaccatgcatcacctaccatcctctcatctccttaattagttccttttcaattttaactttgcatcatctacaatcctctcatctgcccttaattagttccctttcaatttagcttcacttggtagcacctcagatcgatgctatttaattcatgctcttttaacttcaattttatactatattgctgtgtcacctaatttgttccccaggaggcgggcagcctcttgggtgcaatcaaagaagaggtcgcaatctggaaggaagcaggagtctttaaagaatagagatgcaatcccttttattttggttttgggagggcgctccggcatactccattcagtttcgacatcttcttgttggaattctaaacttgtaaatttgtacatcgtaaggaaatttggactgaggggtctttggtcagcacggcaaaataataataataataataaaatctaatttgttcttgtgtatgctcagtactatggaactgatgtcaaattaaaccctttttttcataacatatctgtctagcttgatgtcaaatttagacctttcataacataatctagttctaagtaacactagatattccttaagtactacttcaaaaaactcttaaaggcaccatctaggatatggtatatcttgctttgggtccatgatagtgtggagtttgctgttttaaaccttattcgtatctatttgtttctttcctgctcatttcaatattggggttaacaatctaacttctaatcatccactgatgtgtatggctgttcagctcgtatggaggcaatgatgctgtcaaacccaaccaattgccggccacacatgtgggcttgcaaggcgcacagtgtgcaattcatgatgcagatattctcgctcaagctatccaatatcactgctgctgttgatggcccagttcacttgtatggatactttgctgtccgggatcatttggacccgctacgcaactacatcttcaaccgcaccagggatgaccctttcatcatggggcaagacaatggcgttgattcggataattcattgataccaatgtcaggccccaagagaggcattggaaaccaagttcgtgtgctcatcgagttcgacatgaagatcaagaacggagagacacaagacgatgattttcagctcatcgatggtgccattatctgcagcgaattcgtgcttcccgatagagtgtttacgcaacggattgagggtgattgtggtgcggtcgacattagtcgagccctttttcacgaagcagtggaggccacaatacaagttagcatatcacaagtgcatgtcaatggcttgagcttatctttatattcttataccagtcgaatccctgaaaagattcggctctttgatggtgtcatttccaagccatgtgacctgaatagggtagttgctgtggtggagaatacacctttgtttttaatcttcagggctgttcatagggatggctcggattatgatatccctaaatactgtccattggtcttcaaggttgatcagggggatggctcgtatcgtgtctctgaatattgtccattcaaagctagaagacatggatatgacatgaaagagcttaaacttggtggcgcccgtgtactgttgaaggtgtcttggtcaactttgaagtgattttgaatattcctggggtatacataatctatgctaagcagaaatagcgatatttctgtgtattgactagtaggcaaatgtttgggccttattttgagtacatatttaagttttttatttgttgtagaagttcgacaggtgaaggatgccacactcttatctgttcttatttattgcatattaatgcagattaaatttggtattgctacctgaatttaccaaatgttttggatgcaactcttgtggaattctaatgtttaacttacacaatatactcttgcaagagtgccgaagagaaaagggatcatccattaatttgttccgtcattgtgtctgcgtgtgaaatagtgatgcttatgttaggtaatactgatctgcttctggggcgcgttttgttgggaaaattgaagatatgctactcccctggaatcattttcaggacgtcactccttcagcttgactttgctaaaatggattgtttgcatgataataaataatagatgaatcttcggtgtagcatcgcattgatgaataaaacttttttttgccatctgtttgtaatgatatttttttcctctttgtattttggtcggccaagtgtccgaacagtttggcatcttgtaactaaacaagttctactccttaatacaaagacgtgtgaacctttcgcatgttacctaaaacaaaaatgagtccaccaacaacattacaaaaatgagaccaccaacagcattacagcaagcagataatgagcatgagggggtgtagaaaagaaaaaaaaagaatttatgaaagcatcgcttgattactgaattattgccaggacaaccgttgaagaagcaaaccgcagaagctgcaactccagtccagcggtttactaacaggcaacagacatccaatcatcttatgtttactgaaatagtagtaaagtggtgagggattgccaatgccaatctgccagacaataaaaactgacagggacagagactggagttactaagtgttcagctcagtttactgaaccagctatctaagagattaagcaaggctaagtcagagaggaactgtgtaatgaatgagatagcgctatctaatcagtttactgtctgctgctgctgctgctgctaggccaagacgaggagggggttgtgtctccttgcttaatgagctccaagttgatcttttgggccaagttgagtctcatggctgcgacgctctcagcacttacttgatccatcaccgactcaaaccagcagggcgccgcttcttctgtccttggatgcttcttccaccaccggcagatggccagggcaactgccaacaggtagacgccgcaatcgtacccattgctctgctgcggtgtcgggcctgagatgggcggtccctgcggtggcgccgggagcagtggccggagcgcgtcggcgaggcgggttgccgccggcagattggcgccgtccatactgtcgtggtggacgaagcggccggtgatgttgtccagcacaagaagactccagtgtgacccatcgtcggccttgtccaacctctcgctgttgttcaccgggaataacaccatcctgcgagatgccagtaacagtgcctgggctgtatcagcgacagtctcaggctcatagtcttgcaagttcgccagcagagaagccacggatggcgacaccaggagaaggctctcatcacccaactcggttgtcatgtgcgccatcacaaagttaatcacgccatctaataggaagtttggggcagcaaggctcgcgacatcggagctgaacagagttgcgtcacggtgactcattacgctctttcctcttgtcctcgtcgtcgtcgtcgtcggagacttatgcagggattgtttcttcacagtgagggcgaggaactgcaactgatgttccactgtatcacattgctgctcctgcaaagtacaaaaccatgtattaacaacctagttagtttgataagtaatcaaccgacatggagattagtgaactttcctcagtattaatcaaagagacagagatggactgcaatacatacacataacaataacagtctgcctttcttcaaaaacaaaaacagtctgcaagcgatcaaaaaggacaagtattcacattactcgcattgcgcaaaagaagataaatccaaaattttggcctcttacaattcattaggcatgatgaatttgtagttaagtaaatacaagttacaaatactatggactgtaaatttggagtataagcacagtaagaaattatgaattaggagaaacatccatttctcctacaccattccatctctctaaacttccaatgaaagtgacagtgacctattcttgtgccctctctgtcaaacatgagcagaccttcaaaatgacaaagagcaaacaaaaacactaagagaaagcaatgcgttgacctctcaaatcctcagaaatctccaaaccgagaaaacattagtcaatgtgaacaaacattggatatatgagatgactaaagaagttgggaatgggggaagcaacagacaatgatacatttgcatgattgcacgcacaacgaattgcacacatgggagatttaagacctagtacaaatctaaatgtgatctagagtgtttacgcaacggattgagggtgattgtggtgcggtcgacattagtcgagcccttttccacgaagcagtggaggccacaatacaagttagcatatcacaagtgcatggcaatggcttcagcttatctttatattcctatattggtcaaattcctgaaaagattcggctctttgatggtgtcatttccaagccatgtgacctgaataggtttgtagttgctgtggtggagaatacacctttgtttttaatcttcaaggctgttcatagggatggctcggattatgatatccctgaatactgtccattggtcttcaaggttgatcagggagatggctcgtatcgtgtctctgaaaattgtccattcaaagctagaagacatggatatgacatgaaagagcttaagcttggtggcccccgtgtactgctgaaggtgtcttggtcaactttgaagtgattttgaaaataatgatattcctgtgtgttggctagttgtcaaatgtttgaccctatgttcagtacatatttaatttttttatttgtttaacagaataacagtcgaagaatgccacgctctcatctgtaagatatggttctataaacagatgaaaaaaaaatagatttattcatcaatgcgattctacaccaaagattcatgtattttttagtatcatgcaaacaatccattttagcaaagtcaagctaaaggagtgatttcctgaaaaaggttcctggggagtagcgtatcttcaattttcccaacaaaacacgcctcagatccagatcggtatacccaacataaacatcatgcatgtaatgtaatgtaatgaactatgaattttttttaactaaggaactgtgattttcttaacgaaaccacaaacaacaagcagataagcatgaggaggtaaatctatggaagcattacttgattacttaattactgactggataactgttgaaggagcaaactgcagaagctgcaactccagtccagcggtttaccatcaggggttgccaatgccagtctggcagacaagaaaaactatgccataggcagcgacagaaagatcgtcttgactaactggatatcacaccgcaactgcaactggtgtttcatatcaatatcatctactctcatagctaacctattagcgcaaaagcgaaaccaaataagcataaacaaaagagaagaaacaagcagaaaccatatggacatccattgttccttggatatttctgacattacggacttcctgagaaaagttttttgaagaaaaacagcatgattgctgcacattttgtattaagaagaggaaaagttaaatccagacgccatagagcaagttggaannnnnnnnnnnnnnnnnnnnnnnnnnnnnnnnnnnnnnnnnnnnnnnnnnnnnnnn

SEQ ID NO: 25147 - DNA, 3979 bp, Oryza sativa
ttaaatccagacgccatagagcaagttggaacaaaggggggcaagaaacctgttcagagagctaatactggactatctatgctttacagatctctctgagaaattggctgtttggccttgttttaggcccttgtctcatcattcagtgacctgtagcatcaataacctgcacttgaatctcagaactatctgcagtctgtggatctcctgattttaacagttcatttggcagttctgaataatcttcgtttcctgccagtaatgcttcacttgatttctcttcaattgactcattacgacatgttgcgttagaagtagaagataccagtgcttcatcattgagctgtgcaaatcgtggatccgaatcttcaactgaactcccgtcaatgaaatgtgtcccagtcccagaatctggagataatggttcactcaattcatcttcaagtttaactgtcaagggttgactgatactggactttgagatggattgcactagtacttcctccatacgacacttaaacaatgagttaaattcatcaatggagtctgcttcaacaatatgtgcctcaaaattatttaccttgtaaggggaacacgatgttaattgctcaatacctgcatgacatcaacttcagttgagttatcatttccagtaggaaaattgcaatacataacttagggttaaaaaacagttttacctgcatgtactgtatccttagcttcgaaagtgctttgtctaggcttctggaaaggagatgaactgatatcatcactgaaatcagcattttggttactgctaaccattccagaatttacttctaatacacccacctctgaaattgccatgcctaatattttgatttcttcgcctatatgtgcttccagtgaaccaaataacgtgctgttgttcctttcttgcttggcatcaccgtctgactgactattatgggatttatgggcatcattttcacttatttcatctttctccagtttgaagctattgtgatgcaggctagtagagtgcctaacatataagtttccatgctttctatgccgtcttgctgaaaagtacgaaagaggagtccaagtttcttgcaatggactatcatgggccatattttggttgactgcaagatcaaatagatttttccgtggaaggagacaagacggtgctgaatcaggaacatgtggtaactcgattatttcatctgagccatttgaagaatcaaatgggttctgccttccagtggaaatggagggaacctgcacacggaagcgtgatgcctcctccattttctgtactgcatcagctgcttgcaagtccattaacctcttgtcaagttcaaatttcagaatgttctttgctctttgcagatccatcataccctccagcttgctattattgtccatatccaagtaatttagatcaataacatccttccagttagcaaaatcatctattttcccttccaattgattttcatctgtgctagcatcctcctcctcaagatcatcttcatcatcatccgaagaagtattcaagttgtctctggagaccaatgaagggtggccagtttgcaagtctattaatgggtgcaactcttcaagcattggaataatgtcagtcattgatgcatcaggagaactctcagtaagatcagattcagaatcagaacaagcatcctgtggctcctgtctcataacaggttcccaacatgaactcataaactcacctaactgatattgatattgtactttattgttatcactttcaggattgatgcttccaagttcttgcagctcatcattcttcttgctgttctccccaacgtcttcagtttccacagttacaccactgtaggcaaaacttgaaggcgccacacaaggaacagtatcaatttccactgatgtgataccttttccttcacggtgggtatcctgcaaatcataatcagaagttccatccttcgtatgtatttcctcatttagagcagtatcaactgtcatgtaggtgccatttttctcttcccagtgagtgtcatgtatattaccctcaaaatttctttccctgacatatacttcattactggtagttgttttatccaagtgctcctcgacagcaacagtctcaaccttgtcaatcgaacagtcagtaatggaaatcttggatttaaaggacaaagtttgttgattctctccaagaacaagaacagcaggttcaccataactcaaaagtgctccaagcagaagtgcagttaacaggaagactggagatgaagacagcaagaagttgaatagagaagggcaaagcctgtgtagaaacagcaacaaaacgccagcagctagtactatagggtaatcacaagcaaattgatatccaattctgacagatgaatacattagtctcttgatatgcaacacaatgtcatttgcaccaaaagccatatatatcttcttgaattttaccctcagataaaacgttggcctggaaataggaaagagagaagcaattcatcactataacattatggtgaatattcaaacaagtaaagatttatacttgaacaatagcggccgtacagctcttagcctccatggcagctgtaattgttgtactagtttgaacctcttcccaatcttaataaacttcagccgcgtatcttacgccagcccggcgaaaaaaaaaaagatttatacttgaaacacaagtttaataatgtgcaatacaatcaaactgctcaaataaggtgacattccagcttccttagttagagatctatagaaattgcatgttcaaaaaaaaaaatcatctgcaatggtttaacattcaacaggtaggtggaaaagcaccatctctttaaatgttcagtcagttatcacaatgaagatctctgaattcaacagtatttttgggctataattgtatactatcaacccataaaagagaggaaagtaacaaagaaataaacaaaataatctaatcagaccaaaatcaaagcgaatttacagatcatttagaaaaagattggacgatcagattcacacaagaagctaaattaggagccacctatgaccacacaagaggctaatagtggagcttagcacaagaccagattagcagtagaacgcaaaaatgcacagaatgccaagctcacctgtagcgacaacaccgagaagccaaagccctcagtagcctgaagcaagtgttggtagaagagtggaaaagggaagggggcaataggaaggcaacctcagcaacaagaagcaatggaagaccaaataaaggagataggaagctgcagtgctgtgcttgcgccctttttttctaggattctttgctttggagtaccgccatgagagagaagttttgtagggaaagtggagagcaatcttggtatctttagctgtcactctcacttttaagtttcacctcattcgttgcacacagtcttcactccctctagaatctggctattttaccagacctgtcaaagctattactgtgcctgaaacaagttagatgtcagtatttccccatcggtggaaatgcttggatagcagtcactgaaatcgtagaagctccctctgtacccgtagaagctcatccatcttgttttcagcttccaagctgaatttacaggcgcaagcttagctcttcctttgaacatgttctcataagcacgggacaagtacaatgatagcacataatgtgctcaacttttttctgtggggagaaagcctgtatggatcaatgcatgcgactgctataattttcttaaaaaaagcacaagtgaatagtgataaagaaagaaaaagggacaacacaactcagctcattttagtgatcagctgtacaataaagaaagcacgtttatggaccacaaaagttgtaagtaaacaatttgtcgtacatctgtactatgtgggttcactttgtggactccaaacattgacacaccttatgcaggtcaaagaaaca

SEQ ID NO: 25148 - DNA, 5227 bp, Oryza sativa
  unsure (1)..(5227): unsure at all n locations
nnnnnnnnnnnnnnnnnnnnnnnnnnnnnnnnnnnnnnnnnnnnnnnnnnnnnnnnnatttgcgcattttgccagtgttactgaacccaatcttgctgccatggaaacacctgcgaaattgtgaccaaaacctgtaaattcggcagtgaattcatgcgatttcagtcgggtggcactaggagaatctgacgagccaaagcatcatgtcaaaaaaaaaaaactgaaccaaagcagcagcacatggcggagcgagggactcactgagtcactggagccaccgaattttggaactttaccggaactgaatctagtgccctcctcagtgtcctaatttcctcaataaatcccacgagcaactcaagtgcggaacgcctattgtcaaatctatggtacattggaaccgagaggcggaggaagaggaggagaaagaagagtctttacctgatgcgcggcaggggcactccaatggaagcaaccagcagaggggcggaaatctcgggtcgaggagaggggagaatcgagatgaaacttctccttgacctcctcgcattacgtttccgttgaatccatccacgtgcggcgtccacctccgtggctccgcccgcaccgtcttcgccgccggagttgcgccggccgccggagttgagagcgaaggcggcggcgccgccgctcgcttgttgggtagccagtttgggtcgggcccacagcatatgacccgtttcgcaaagttggcccgtttaaacattcagattaaggcccaaaagcccataaatatgggtcgggctgcccagattttgaaggcccaaaaaaagaagtgatacgaaggagtgtctctaatctgtgccgcatattcttaatcggacgtctcacggagatcctaaggagttcggagttttcttctccgaacccctctgtttatcaattccatcatgtttgatcgccgccacaagacgtctccgctttgagaggatttcacaggcacccgaggattctgaattctgatttctatcgtgctacttgcgaactatatatatccgcgctctgccttctgaattcgatgttctggatcttgtttcttgcaggtcaggtggcagtgacagtttattacagacatatccattgatattcagaaatattcagactctggaagaaatttggagtctcggaccatgaaagtcacttggaacggctgcaacttgtagtgcccgattagcttatggtcagacacaatttgccggtgctgtgtgtgcttcatgagctagactaagcaggtgtgtggaaattgaaagtggactactcctgttacgcagtggatcagtaagcctaacaaggacaatcaactagacttcttatgtatggtctctctcatctcatctgctattcagttggggggaccaattcattcatagcttcagtaccaatgtgattcagaacttgctctgtatcctgacagaaacacaaacagcaagggatggaacaagtacagtcacacactactgttcataacagaaacaggtagagtgattgcattacgttttggcaaagcaacgcgaaaacggaatgcatcttgaagcaaattgtccacgtaatgctagctgctaattaatgatcatgcatgtgtgccatcttgaatcatggagaagtgaaagagacatccgaaccaatcgatcaaaacaggcaggaaccggccatttgactcacgtattagttgactctcttcacttgagacagtagcgtgttgtatggtgagctcaggaagctgacggcctaacaaagacatttttttacttgacttcaccagttgatacacgtacgtacgtggctccgtttttgcttcagatttcagcaggtgcagcactgcagtgcagaccatttgtcctcgcacttcctcgcactacacgttcgagatgtagtatactactaccaactgttgaatttcctctctgaatactgtatgctagactagagtcaggttcttccataattttgatcaatgattccagccagtattccaagttgcctgaacctcaattttgattagcattacatcatcatcattctagacagtcaagacagtactgatgtagcagaaagaacttttaaagtttcagaaaatgcatgcctccagtcaaattttcagaaaaagaaggatcaatctagacagacaagacagaaagaactctttaggctctgttcgttatgaggagataggggagattgattatcgttttccacgtgcacgcttttcaaactactaaacggtgcgttttttgcaaaaaatttctataggaaagttgctttaaaaatcatattaatccatttttgaaatttaaaatagttaatactcaattaatcatgagttaatgactcacctcgttttgcgtatctccccaatctcctcaatccccttctcctcaaacacaccttaatcagctgactgatgtagcactagagcgtcatcaccattctaaaggtcggcaccatgaaattttctctggttttgactgtttgactccaaaagcaaaaggggctcattgatcgatcgcgttcttaatttccttgtccattggattactgaagaaacggcaacatatatgatcgaccaaacacccgtctgacatgtataacagtgaaagtccagccacaatctcttgcatgcatttggagcatgccactgtttcagcacaaccgaatgattcagaacatacactagctgtggcatatttgctactagtaagactatgctatcgaaattaaattatagtgtttgcaacaactctgcccaaggaagtggccaggaagaacacaacttgaaattaagctagcgattacaaatcgataaatccaagcagaattaaagaaaaaaggatgaaggagaagaacgctgtaattaacggtaatgcatgacttaagcagtccaaaacgatttgaggatactactcacatgtgtgcgtgacttgacgatgtaggagtagtattgtccaacagcacgagctattcaaaactcaaaagaggagtcaagcaagccgcaaagccaacagcctgcaagtacctgacattgacctggtgatgaaaagtctcagcttacacccaaccattttcacatttgccaacaacataaacaacgcaaagaaatgagcttgctaaaccttcctttgttggtttctgtacaggaaaaatgatggattaatgttacataatttgatttcgaaatattgctgaaactgaaagcgtccatttcattctttttctgcgcttactctgattcatgccaggtcaagatttaattaggttaattgcatgtatgagatgtactagttagtactggccgttatatataaacacggtcaaaattaacctaattaattaaacagttgaattgggaaaatatatataatgtaatgaatcaatgtttgaattgaacgaaatatcatatcaccatgtactctgtacgtagtttagaacaggggcacgcgattctgatctgacgacacatcaaaactatgggcacgagcgtgcgttagtcagttagttagcgttgagaaaattagttgaaatctctagcactagcttcttagcttgcatgcacgcgagatcacacctagtttaattggtcaattttgattcgcaaattctgtacgtctacgtgtacgtacgtacgtaagcacatgttcttaatttgtttgtattgtcgttcaatggtacatgtgtattctccaatcaaattgacctcatatatgcacattgtacgcagttgatgatccgtccatattgtactatctgaggagcgattagatcgtgtttgaaattcctgaaacgattagtataggactagctaggatttcagttcattaataattagtaattattaagttaggtacaaataagcatgtacgtagtactatatttgtaggcaactaaggacacatatcatcgatcactctctcttttcactcgttaattagctggtgatatcagagctgaatgcaatcatatcgttgttgtcatgttgtggattagtccaacaacataccaaactcttgtaatatgatcacttgtggttgaagcaaaattaaatcacgtttcaacacctaatgaggcaaccaaaagattgttttgcttcagaaacaaataatttgatgccaaatccccatctatatatgaatttcatttttaaaagtttgtctttctacgagtaatatatatattgattcttaaacttgggtggagttgtcacttaggtcaactaaaattaaaatttcaaaattgcacgtttaaatgcatcagcttggtttaatgaaccacaacaagtccaaacctcgtttgacgggaactcactgttgacatggcgctccacgcaaacaacaattttgcattcgctctcctccgtgtcatagcgtggccccctccacatatagtactaccccaaagcaccccaaaccctctaaatctctacctccatcaccttctccccgatggttagagttttgacggcgagggtaatgtcgcccacccacttgccactctcccttgcaaccttcgcttcgggggagaatgggagggatttggggggattccgtgtaggggtctaaaagcaaaattaccgtcacgccatgacatggaggagggtggatgcaaaattattgcctacatggagtgctacatcatcgatcaacttggttcaaacggggtttggattgttgtggttcattaaaccaagatggtggaattgaacatacaatttttatgtttaggcacctctgctcaattttaaatactggccatgtatctctcttttcctaaataaggttaaaccctaataattttaaggaaaagtaaggttatatatactttttttttcaaaactcttacaaaggaagatctcaaccatctgatctagccgattggtagttaataaaagtcaaaatgaagtcacaatttgccacgtagtttttataaagagtttgcaagtttttttttttacatgtatcattttcatgtaagaaagagtaaagacagatgagtttttttttcatgataatcatttttttctctctaattactattattttctaaatctatttgcatatgaaactttgatgacataatttatcattatatttatattaatttattgaacactgatattggtatccaaaccatacctaaaagattcatttcttaagaagaaaaatatcaaggggttatttctaaatttatttgaaaa

SEQ ID NO: 25149 - DNA, 13112 bp, Oryza sativa
  unsure (1)..(13112): unsure at all n locations
ccctccccctcctccatcgctctctctacagcagacgacggagctcctcctcccggccgtgcacgccgctccagcgggctcgcccggcgctgcaggcgcgctgatgcttcccacgctcgacacctcggcgttcctgctcgaccgccgcgcggagccggcggccgcggcgccgccgtgcgacgagtcggtggcgttggtaagaggaggagcgggtaattacggcagcaacaacaatagcattagcagcagtagcagcagcggcaactgtggtggtggcttccccaccttggactcatgggatctcctgtaaatctagatcatatattgtcgatttctatcgatttctgattcttcatggctgtaattaactaagacgagatcaatgaacaggttggagcatctatctacctgattctctgttcgtgtccttgttaattttaagcttatgcctcgtatacacatggatgattttttttatcagtagtgttattttattgatcttacttaatttagagttccttttcttttaattattaagtgcgactgttaagttcgttttgatcttccttctgctgattccagcatcactgcatcagcctcaaggttcttaatttatgcaggatttttgttcttgtgaaactcttttgctttgtttgattagttggctcttgcttttctattgattttgagtctttgatgaatcctccttccaacagtagagctgctccagcaccatctcactgaacatgtggtttctgatcatttggtgaacaaaatgtaacaaaagatgtttttttatattagtacattttagagaggtgcttagtgcattaattcagctttagctatataattaattaattaatgcaccaaaccactgtggggggcagtagcatgtaaatgctgcttagacagtaagatacgttaggatgaagctaacagttcaattggagcagagcagggttgagaatcagtacttggaaaagattgattgtgagatacaacaataataatatcgtaatcatcgagccaggtttttttagaaaaataaagtattgcaatcatatatgcacacgcatactaagactgagtttagatccaaaagtttttcttcaaacttctaacttttttatcacatcaaaacttttttacatggctgtgtttagtttctgaaatcggggagaagtttggggaaagttggtagtttggaaaaaaaattttgagagtttatgtgtaggaaagttttggatgtgatggaaagttgaaagtttaggggaagtttggtgtgaactaaacaggaccatacataaattttcaacttttctgtcacatcgttcaaatttcaaccaaactttcaattttgacgtgaactaaacacaacttaaggttcagcggaagagtaactttttttaaaaaaacctaaggcggaactttgttccacttttatatttagaagaagataattgacccagtttataaaaaaaatcggacccgaaaactacacaactgtcacggttaattacagaaaaaccagctaaaaaccaccgttacacaactaactttacattgatctaccagtaacatcgttagtagaagtgatattaacataattgtactattaataattgatgtgatagtataaatagatataattcattgtaaagagtactataaaacaccgcagggcggaaaatgaaaggaaaaaaaaagaaacaaattgggtgtggaatcaacatgcatgcttaatgggaagaaaaaacaaatatgaagtgtatttgttaaacacatatgtaggcttgatctagagctgagctgtttggtgcttacaagtaactacctctagattgcccctaaaatacaatgcaaaaagggaagttgacaaggaaaggactatatcaacggagaggaagaatcagaggcacgagctgttgactactgagtctgcgtgtgatttctttctcctcaatttgcagtgtacgtgtgctgtgccatcaacaagtgtggctctggctagcacttagcagcccctggtcctgatgagatgatggtcaggcagtcggtccaaaccgccaaaagtctgggtccgttcctggacgatgttaacacataggagtacaatacaaaccaacggctgtcctaattacttatcgatgtcgtttaccgtactactaataacttactaataatagtagaattagcatattttttttaaaattaacaaggaggagaattcatggtccagcactccagcatgccgctgttagtcaaaattcgcggctcctcttatgggttcgtagttcatattttcgtacgtactaccccttcccaaaatatgtgtaaatatgtgtagccatgagtaaccgtgcctaacgtttcatcatccgtcttatttaaaatatttttaaaaaaaatcacacataaaataatatttatgttttatcatctaataaaaattttaggacgaatggagtatatggctacgcagtgagagcgacaaagggatggatgttggccgccggccggccacgcaggaggggacaccaccattgcacttgcaacgatcgatgcaattgactgcttggtttgcctcctctccggtctccgctgccgtcctcatcaatcacttctcatttgtttgtttggacccagcatcccttacctctacactgcatgtgattcctcacagcccacctgacctgacctccctcccggccccaatgcttacaccatcattgcgtcatgctcatgtcataaatgaacatttttacacatcgctgcaacatcttcagaaaacggaaggcaatactgtgttgttcatgctaaacacatcactgtcggctcagctggatcaacagcgacccttgcttacacaacggagacaggaaggatgcaagcccaagcgaaaacaggcaccgactgtgtttgccgcagacagataagcagggtcagctggcgcacagcaccactgatcacgccgcgttggcaggatgaaacagtacaccactgcttcagataatgacagtttgaacctactcacttgacctctacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagttatgctcgccgggcatggaggtggagctcatactttagtaaactgcagctgggaaacagaggcaggctaaactgatggcgaagagtttgaagacggcgatggaactggaaaccagtgttttgatgcttgaaatgccaatggagatacccttcctttctccnnnnnnnnnnnnnnnnnnnnnnnnnnnnnnnnnnctgcagctgcgacaagccactacgtacacttctccatgtcgccaactataaatccgaatctgcctaaacctagaacgaatgcaaagagcaaaaattagtactgataaatgataaatctaatcaatgagtgagtgagaaatgctggaacatttaaacacaacaagaaaatcagattctaatccaggctgggggtttattgatttattttgctactagctatgtagaattacaagaaagaacagtctcatttgactttatccatttcttttgcctccagagacactactggttgttcctcatgagtaacaaaagaacaaacggcacctttagcaccaatcaacatcattttaaattgcaaaaggtacaaaaaggtggtttgtgtggctttggggaagtcaagctacaacaattccataacaagtccacatggttgttttcaggggtggcagcaaataagtccgggaataagagacactggcaaagagttattgtgcaaggttacaagaacaagtcaaagtgtctcacatggctggtgaaattgaaaacaacaggaaataaaagtatgctcagagatgttcataatgcctacaactacgtgtaatgaaatgtagttgatatcacctatatataaataaggaaataagttatatatatgcactatcaccaacgtacccttgttggaaaagttattatatcagacacccgcctcaacaaattaatatgagagcctgaagtaaggatatcatataacatatccatatatatataccatcccagattacctatttcacagtaacttctttgtgagctttaaatgatagaatcacgttccacgcaagggctacaaaattagcagcaagaacctggaaaaattagcagtatactaggtgagaacaacattcagtcatgctaaagcagacagaaagaagcaaattcagctccagagtacagtattgcactctaaaatatttcatgaaatgaaaatgtgaaagatttcaaagacctgaaatttttgtgggacaaagtaaaaattcaagaactgaaaaggtatccacaattgccaatttgcaatcactgatgataaccactcctgtaaaattacaactgaaaattagctagcagtaaatgagtgcacacacatattatcagggagatgagagaatcaatcagaagaggttcatgtcacctgcttgagctttggaactacaagagaaggctttccctccaaggtgacgagtaaactcataaacactccaatgaaaatgggagagaaaatgaactgaaaggaggagataaaaaaatatcaaaaaataaatacataaatgcataaaagagctagaacagaacaagcagcaacactctctctttgggggcagaagggaaaggaaaaggatatgcatatacctgatcaagtaagaggcgagcaattgcacctgacgcaccattgatcatcactaatttactcaagtacaagtacctgcatgtggcaacaagtaatgaaacaaacagcactgggcagagaacacatgctatcctctataaacattggttgttcagcataaataagattaccagacatgcaatgttggccccaccaggacgagtcccaaaaatgtgaatacaaacgttctcttcaaatctagctttggcactttatcaattgcgagctggagcagtaccaaacaatggcaacagtaaatatctcgtaagaaaccttaacaagataccacaataacaagaacaggtgaaatatcaaatattttgcccaatccatggatgcaacccagttggaatagacattgttttttaataatggaataggacactgttgctggagtaaagtccgttgaggaatcaaataatatgagttacagattagcataggctaaagaccgacacagttgagtaaagacaatatattcagattatggttgacacaggattggataaaaagatatggacctgaaatttgataagaccgtaacagcctagccagttaagagtttcacatcatgtcatatttagaaaacaaggaaactaaaagagtgcagctagggcagaaaagaaccataactcagtaaattgatttccaagtggtattagcaatggataacatttcaatgttgttttgaaggaaaattggtatgatttgaccatttgatgctaatgcccatctaagcacgcctggctatgtgctattgcagagtaataggaagccctctacaacaagagagggagactactggttcattgttcgtcaaccaattaagtagtactaagtaggctgcaatgtatggatgtgaaaatgcggcaaatagaaaacaactgcaagtcacctggcagatgaggtctccggtcagggttaggacggcagaggtaacagccttagtggtgatgggatgcttatcaagagccagcaggtacctgcaaatcatggcgcatttcagtaattttgcatttagataagagtattgcaaaaagcgaggcacaagaccatgtcagtgcttggccgcaggaggcaccgggaatcaggaagaggcggaattggatttaccaagccagcaggagacgccaatccatttctccttttgctccaccaccaccacctcctcctccggcggcgactccggcggcggaggcggaatcgcagcaggaggcggcatggagcttcgagaggcggacgcccttgcgcgggtggacgacggcggttgtcgccgggagcgaggcggggcggggagggagggcaaggcggcgggagtggaggagcggcggcgcggtgggcctcggagtcggaggggtggagcggtgcacgaggaggagcgggagggtggaggccatcgccatgggtggtgcttgcactgatgctgcaactgcaatggtgtgaggaggagcttgggttttgggtcgcactggactagggttctactagtagttgcaattttggggagaaaatgatgaggtagacgaagatgctagcaatggatgatgggctttgcatatttgggctctcggcttccttgttgggctcttggcccacctacatttatctatctatctattatattatattattaaaacagctttaaaagaggcaccacgtttgctgtgggggataaaaattctcacattaatcggagaaaaaggaaaaaaaagaaaaggagagtccaagtagaaatacaatataaaaatagatgaaattcggaattaaaaataattaatattgaaagaagtttccatataagtacccaatacgagaataatcaaaattcgaaataaaaataaaataaaatccaaaattagaaaagaaaaggataatccaggtaggaatataattttaaaatagctgaaattcggaattaaaaataagaaatattaaaagaagagtctatataagaacacaatacgagattaatcaaaattcagaataaaaataaagtaaaatctaaaattagaaaagaaaatgagagttcaagtagaaatacaatttaaaaatagctgaaattcgaaattaaaaataagcaatattgaaagaagtttccatacaagaacccaatacgagattaatcaaaattcaaaataaaaataaaataaatctaaaattagaaaaataaaatgatagtccaagtaggaatacaattttaagatagctgaaattcggaattaaaaataaaaaatattaaaagaagagtccatataagaatccaatacgtaatcaaaattcggagtaaaaataaaaataaagtccgaaattagaaaaaaaaaagaagagttcaagtaggaatacaatttaaaattagctacaattcggaattgaaaataagcaatattgaaagaagaattcatataagaatccaatacgagattaattaaaattcagaataaaaaataaaataatattcaaaattagagaaaattaaaagagagttcaagtaggaataaaattttgaaacaactgaaattaaaaataaaaaataaaaatattaaaagaacacgatacggtattaattaaaatttggaaaaaaattctgaaattataaaaagaaaaataagatttcaattaggaatataatttataaataactcatttgggataaaaataacgactattgagagaaaagaccatctaaaacacatgaccaaataaattaagtaacatgcttataaaggagtagagtggtggcggttgatacgatatataaaaactgttaataaaacaccaaatagaatcctaatgacaattaaaaggagggacgacaggcaggccgtcaaacaaacaagcaggcagttgccgggacttctataaagttaaaaaaaaccattgataatcaacgacaataaaaagaagaaggagcgagcggggtgtatagagtatagttgcagagccgccgatggttgacgggtcttctagaaaataaaaaatgaatttcaacgatagttatgttcgatttttagaatcacaatgacaataaagagtaggcggcaaacgggtcatagaggagcatagtgatattgtttgacgggacttctaaaaattataaaaaatggaacccaacaagacaataaactctaaaaactataaggtctaatttttaaaggttcggaacttctaaaaagtaaaaaaaaccaatgataatcatgttcaattttaaaatctcaatggcaataaagaagggagggagcgggcgagccgtaaaggagtacaatggcaaagccgctaacggtttggcgagacttcttgaaaagtaggaagtaaaaatgaacccaaacgataattatgttcgaattttaaatctcaatgacaataaagaggggagacggtggacgggccgtagaggagtataatggcaacgtttgacgagacatctagaaattataaaaacgaaacccaacgtgactataaactttaaaaactataagatctaatttttaaaggttacaagaagaatgaatagaaatagcggtagatcaagcaagtaaataaagaaggagatgacataaggggtagtagctggtgtgacttttaaaaactactccatccgtttcaaaatgtttgacaccgttgattttttagaacgtgtttgaccattcgtcttattcaaaaaatttaagtaattatttattattttcatatcatttgattcattgttaaatatacttttatatacacatatagttttacatatttcataaatttttttaataagacgaacggttaaacatttgctaaaaagttaatggtgtcaaatattttaaaacggatggagtatataattagaaacatatagatgataaggtttggtctttcgaaatcttaagaaaatgaggtagctatttaataaattttaagtaaaatcatagtaaaaaatatatgttttgtttaggtgctagtttaggtctaacctaactgtgcccatctcgccggcgccgcctccattcttctcatcctctccactgcggcgcggcggcgcggcctcttagcgccatttcctcctccacttggaagcagcagaagcggaagcccgtcgcccgcctggctcgagctcaaggccatggagtagtaagtaccaatcccttgctgtccattgctacctacctgtattttagtttgcccctgtatttctgtctctgtacatgtctgattgattgattagcgaagattttcatgtgttctgtcccagtgatgagcagtttagtaatctgagcacttgattcagttcagttggtgctccctccactgcaatatgctgtgaggttgaaggaaccgatcgatcgataattccatgtgcactgttgagaataggcattctgagggacagacatgattcagtttagtttgcttcttcgtattttagattagtgttttaatcttccttttcatttcagtgtgattcttggtgttaaatacttttgctggtggaatggagttggagcctcagtccaggctttggttttccctgatcagatccagtcctaattgcttgtttgtttatcagttatgatcagtcacttgctctgacgattcggagggaggatgaatagcggatcacaaaacgagatgattgattcatgtgagatccaagcacccatcttgagctgtattttctttagagttcttgacggtctggaatcctaatgtgttctctttccatggaaaatttttgggcatttcagtttcagagcggcaaggagccaaggatgcagcagcactagggtcctagtccaaattgtcagctgggggatcaatggcaatggcggagacggtgaggctgcccgaacagcagcgtcgcaggcctctcaccattgccagcctccctgaagaaattatgtcggagattctgctcctgctgccgccaaaatccatcctccagtgccgtgccgtctgcaaggcctggcgggacgtcacctccgaccgcgccttcctcctcacccaccaccgccgccagcctccacagcgcctcctcaccttcatccgcgacgtgggcagtcaccacgatgacctggatatcctggactactgtgttgaagccgttgacttccgcacacaccagttccagtctctggcccggttcactggccaagattacgactgctcactcgaagacagcccattcaccgtccacgcttcttgcgatggtctcctgctcatgtcctacaacaactatttgcatctctgcaaccccactacacgtcaatggctttgggtctcccccccggcgcttcaacatgacaaggtcgtggggctctatgcacatggacatccttccgaataccgagtattgtactatcgagaatttggtttgggacgtacattctacatcaccactgttggctccaggaaggagaggcgcatttggccacattcatcatcagaatccctgagaaagtggttgacaaaagggacagaggatactgaattcaacaagcctttcctgtttcatggaaacctgcactggttgccacagtcaggtcgacaaaacaagatagtggtgttcgatacactggatgaggcgtttcggtggttgcatgtacctttcaagatgcacaatgtgtcctcattactcgagattgagggtagccttgccatgtcaaacagccatattggatcatcaaaggtggatctttggcttctgcaagattataagcatatggtatgggtccacaagtatcgaattgaattgccagtgatagagattcgccgtttagtagaagatgatgtttggtttcttcatattgtttcccaagagggtgatgtcttggttgatggatcttattggcagtttcactacgacatgaagggtaatttgctggagaaatttcaatgtagtggccgcatgctgaacattactccacatattctccaagaaagtctcgttccacacgaagtgttccaaattctagataatgaaagtagacatgcaccacatttcttcagggggttgtagagcatactttctgtactgtgaggctatttcacacttttgggcgtctattcattggatactgcaattttagcgatggaacttaattttgtagtgaatggtcaatgatctgttgttgcaaagggcagcattcactctgatcagtatttctgtacctccacatgttcatctttaacatcgagggtatcatttcagtactgtacgtgggaaatttaaatgcctgagactgttttttcctggtttgtggaagtctgagactgaacagttgattatgctcgttgtttatttcaacatcgcaagatggttacttccttcgtttcacaatgtaagccattctagcatttctcacattcatattgatgttaataaatctaaatagatatatatgtctagattcattaacatcagtatgaaagtgaaaaatactaaaatgacttgcattgtgaaacggagggagtactttttattggcttcttgcaacttaattttgccactctggtattgaaaggtcattgtctacttgtgttggtgatgcgtatgtctgatgagatccttagtgccatttattttgagtttgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctggtcgaatcgcctccttcaatagcaaaaccgggtataatgactccctcatctttgaaaaccggtgcaaatcgactcttttggtggtttcagaagcggttttatcctacgtgacacttgtgggacccacatatcggtgaaaaaataaaaaaataaacaaccccacatgtcagtcatcctaatctcaaccttttttttttctcaccactctctctttcgtgttctctctctcttgtcggtggagaagaagctcgactactacagcggagaggggcgcccgccgcaacagcaggagggggggaggaggggcgcgacacagagcaagcagtttccgaggaggaggacgcgaaaccgcgtgagcacatggcaggggagggaccgatgggtgggaggacgcggtcgccaccgcaacgtccttctctgctccttggctcgtctccacggcgtcattccgtgcggggaggagctccaatgtgatgggttgctggtgctgtggggacgacagggtggagtctatttgtgcatagagtctatttcaagaagaagaaccggaggaggaagaggtagaagcatgagagggccgacttgttccacgacgttatcgcgcccacgctgcagccgatcacgcacgtggagaggacctgggcggctacggcgtgtgcggagaagagaacaccaaccggctgcgcgtgagggaaggagccgcctgccgtggcgcgcgtagacaaaggagctcgccgaccactactccgccggcaaatagagaacgggagaggtgaggaaaaaaaggatgagatgttttttttttcattttgctcttactgatatgtgggtcccataagagccacgtaggataaacccgcttgcaaaaccattgaaggagtttatttgcaccggttttcaaagataagggagatgttatacccggctttacgattaagggagacgattcaacaaagggtaagagatgagggaggcaaaataggcttattccatgacgaannnnnnnnnnnnnnnnnnnnnnnnnnnnnnnnnnnnnnnnnnnnnnnnnnnnnnnnn

SEQ ID NO: 25150 - DNA, 846 bp, Oryza sativa
ccagtggaaaccatgtcctgatttcaaacttctatgcgagaacgaaccgatgggaggatgccaagaaggcgaggaaggagatgaagtccatgggcattgacaagaaccctggatcaagccttgtagacatcaatggagttctccatgagttcttggtgggtgacaagacacaccctgcctcaaaggagatatacaccatggttgaggagatagaaaccaggttaatcgagtgcggacgccggtcgagcacctcgtctgcgttgtttgatgtccaggaggaggacaaggcggatacactgtcctaccacagcgagaggctcgccattgcctttgctctgatcgcttccaatccaggagctcccattaggatcatcaagaatctccgggtgtgtgccgattgccatgagagcgcaaagcttgtatctcgggtgtatggtagagagattgtcatgagggaccgtacccggttccatcacttcagagacggggtgtgttcttgtggagatttctggtaaatactcgttgtgttgtattgtacattatacagtgtaatgtgctgtagatttctctcataattctgtggtaatgggatgtgctgtactggtctcacacatttgctcgagatcacaggctgtgtttagttccacgctaaaattgaaagtttgaagaaattagaacgatgtgacagaaaagttggaagtttgaagaaaaaagttggaatctaaatagggccacagttcattcggttgtagtttgcatggttcaatatcagtttttttttacaatcattttattgatgacggatcaagtgttacatggcaagtggtcaaagaactgaaatgaaat

SEQ ID NO: 25151 - DNA, 5856 bp, Oryza sativa
ccgcctgccctcgcacgcacgccgccgtgtgccgcccgccgctccacttgtgcccgtgcgtcgtgacgatgatgatgagagagagaggggaagatgggaagatgaggtcttacaggtgggccccaccattttaaaaaaagaaaatgctgattggatttcaacctcagcgccacgtgtatgccacgaaagattcataccgcttcagattgagtgaggggggtaatttgtccggttttaatagtttgaggtttaatatgtctggttttgtggtttgaggaggtaattcggacgatcgcgatagtttacaggtaattcgtaccttttccgagattgaatgattttgtcaaataaacgtgaactggttaaataggcgagcacagtcagctaagacagcaagtctgggtggtgtagttggttatcacgttagtctcacacactaaaggtccccagttcgaacctgggctcagacacaaacatgttttttccattttttttcaacaatatgaatatttttcttaataacaacagcataattacatgcaaaaaatatttctccataacaataaccatttttttcaacaatttgaatatttttcttaataacaacaacataattacatgcaaaaaatatttttttccatttttttcaacaatttgaatatttttcttaataacaacagcataattacatgcaaaaaatatttctccgtaacaattaccatttttttttcaacaatttgaatatttttcttaataaaaacagcataattacatgcaaaaaatatttctccataacaataacataaaaacttgataaccacatgcacatgattttttttttcaaaaattcgaatatttctcaataacaacagcataattacatgcaaaaaatatttctccataacaataacataaacacttgataaccacatgcacatgattttttttttcaaaaattcgaatatttctcaataacaacatcatacttacatgcaaaaaatatttctccataacaataacataaacacatgcacatgcacatgcacatgcacatgatctttcttttattttaaaaaattcaaatatttctcaataacaacagcataaccacatgcacatgatctttttttttaaaaaaaataaccctccatatcatcgagcaactttaacagcataaccttttctttttcaaatatttcctccataccaacagcataaccacatccacatgatatattttttttcaaaaaaaaaatcttcatatcatcaagcagcagtataagctgcaaaaccatatgcacatgaagtcaaatatttcctatacgacctatatagcatcttagcagcacaaccatttgcagtaatgcagatgatctcattcagagagttaacagggtttagtgctacagcttcacatccatatgatctcatccactaagttaacagagctttaattctaccacagcaactagcaaaagatatagtaattgcattggtggctacaggcctacgacatcggcaatgtacagcacaaaatgtgagggtctcatctcatgccacacaaagcagcagtccttgctacatttccactaacccaccaccacaaatacagagagcccctttatcactttatgctaccattcatagagtagcttaatatcctgcaaatgtaggatggaagcattaggcagtcacaagagaaatagagttgccatagtttcagatctaattgttcagtttgtcaatatcgtatacattcttgaataaatatatggcatgctaagcttaagttgaaaatatatgcttatgtaccaaagcatgaaaatcaccacgtaggtgcctcaggcgactgtaaccacataaagttgttttgagagttcttgacttacatgaatggagtgatgaatcagctacttctaaaagagattattcagttgcataaataggttggaagaatgcatttcccatgaagaagcagtttttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgggggtagctgtcatcgccatggtcatactgtacagcttgccaaaggagattaggagaacagctatggttcagaaaacgagccacattcccttcattgtttgctcttatgatgattggtagcttcttaaagttcttggttgtcacagccgtacttttttcttcaagtaattctgctcccaaattccagcttaaagccttatcgccgggacatgaagcgcaaaaggtatatttgtcttcctcaacatctatgtccatcttagtttcatcaatgacttcaccggcgtactcacaaatgaatgtgccagcacggataggatcccaagaccgcaggccccagccacggtctccagtccagaatacctcaaagttcagttttatacccttctgtgtgatcctgtttcgacaattatgagaacactgacagttagaggagcactcataaaccattggagtgtgctttgccagcaatcccgttgcgctgtaaggaagatcaccaccattctgttgcgcacacgaacaattagggtcaccaggcaagcaaacactaggacatttgcaacattgtaatggttttgtcttcctaagaggtctcaaatacttcactccagcaacataattgaagtgacttggccctttttcatcatcaacatcattaacaaggcacacaggtaggtgttcaacctttgatgataaatccaacaatatagccttttctcttgtggcaggatttgctttccacttctcagtcatcttccaaagtgaaattccatcaggctgtcctgggtcccttctcagcttgtacttgaaaacattaaatccgttctttgccgtgtctgtccaagtgtcttcgatacgataaagcccatcataaatatatattttgcctgagttacaaaaggggtcttgtgcgctgcgcacaaccctgatctgattcttcttgatcttgctgttcatgagagcaaggttacctctctcaagcttctgatcatgcttctccttgtgacgactattgcctccctgtcctgtgtagaccaaaatgtcagtgtcatcatcgtcattctcatagcctccagatgaaatgatgcagacagccagagtctcatctttgttcttagaagagatgtaatcaatgccacccatggctggtgcatgcaaaccaatgatgcacatttcaatcctaaagaagaagatatcgccgacttcaacaccaggcacatgccctatcatcttatgattgttgattctgaggttgttctgcatcatgagggtgccagctttcaggtcagcccgcctgcttgcatcctccttttcatccaactgcagtacacggcgccgaagggaatcaaacatcatcaggattccttccaccgattcctttgggttgtctgatgaggatgaacacaagttgaactcgttgtccaggctcctccttattgatctgcgcttgatgttggcatcattagatttctcagcttgctggggcctcttggctctctttggcagcgttggttttttctgcctgcaaaagggcttgtaatcttgatctgatgattcatcttcatgttgcggtgttggaaatgccgctgagattggtgtagcttttataggaactggtgactttggtaagggcagagaaaatgaagctggggcttcttgaggctgttgtgatgaatggtgtggcataaactaacaatggattggttgattgagtttccacatcatatcccaaaatagtaggaaactttggcgctaatgagcgcaatggctccaattccaagggtagtttgccattctctgcttcatcttcagagttctccatggtgaactcttggagaaattctggcagcagcaaaagcagaagtcaataaatagtctgagcatgatacttgtatgtatcagcagatgaatgatgtctcagaacttgatatgttaagaataagtacgcgagataaatataaagaaaacatcgttcagtgcaaatacaacgtagagcaaagaaattgaataaaaagaaaatagatctgcaaaatcagaaagctgcatcaacttctgaacaatcagaaacagaacaatctgcatattttggccattgatcggtcggctgagcactgatggctcacttaaagataaaaatgtgtcaatgcgaagtctctgtggcatatgaatcatggatgttctgtccggaatctatttggctcacataagcattaacatttcaaagttctacttgttccccccttacaaattaaccaaaacaaatgcaggcactagaatgacgaagatggaaacaaaatgcattgcaacttccaggcgctcatctggggaacccaaatacagtgcgtccatttgttcaacaaacccatagttaaactccaggcaaccatttgcagtacacacagacaataacactaacaatcacacgaacttgctacaatcaaaaagatgatcaggaactaggacttgcagaaaattagttagaattctaggaaaaaaaaacaatggagagaaagctgatcaagaagcatcagatgaggagtggtgtaccttgaggatgtcgccttgctggggagtgtgaaggggcacaggacagcagttccactatcggagacccctagaccaaaccgtcaaatgtatacatgtatgtggacacaggcaatcgtgtcagtgtggcactaagcactagctttacaccatctaccgtcggataatctcgagatgcgcgcctctggaattggctggaatatactgagtgagatacttaatggtgattacttaaacataaatttagaacagcggtgtacttcatctactgtaaaaaaaaaaggaacagcggtgtagttacagtcattcatggcaggacactggaagtgttcaatttctgataaactcatttcactttcattatctaaaaaagcaccaccttattttctccaaggacacagacacttcattaacacatttgctgctccagcctatgagcttgtctctgattcttttcaggtcaaaagtagtcaaagtacagtagcgtttttaatctccttgcaagagcaaaacttgcaatcttttcactgaacgtatagcaggaaaaacaccaaaactgacaaaatgtagcaaaaagcaagtgatgccccttaggtatagtttctagcatcaactatagtagattctacattctcgacgcaggaaagacctatgcgaattttcacctagggctgctaactcgttgcatggtgagcatcttcagttcgagaaagcgttttgcgcagttggacagacacgaggcttcgctgttgctgaagctgcttccaatgctcccagtgatgcatttgtcccagcaaacatcagtcagcttcgccacgaactcgtttgccattgccttcctcttctcctcctgaagagggaaagaaaaacaaaaatgtcagtaacatttctgtgagtaacaagcaccgcggttctgcaattgaataggggatcttgaaaatgaacacatggcttaattatccattgtccaaagaacagagtacacaaaataatttcttgtgcataaagggaagcaagcaacttctgccattctcattacatatcagaaacccaggacaaaaaggtcctagcagcatactagatgtaaaaaggca

SEQ ID NO: 25152 - DNA, 35446 bp, Oryza sativa
  unsure (1)..(35446): unsure at all n locations
ccctttttgcttaagtcgtttaatttgcagactgatgacctttctatgtcagtatttcctttcacataagagtatatcggtatgtcaccgggaaaacatctttggttccttgcaacgtgtcagaatacccagcactatcattttctaacataacaaagctggtagcaaatcaaatttaataaaacacctcactgcgctatatgcattagcggctagcacacttgggatttgggactactgcaatttaagaaactactgcatgaaaataaataatttgttggatatcatgagagagaattgtaacttctattagtaatgagtgaacagccataatccttaaatacagagcaccacaaaagcaattgggaatgacagaatatcacctcagttgaagcgttagaaacttttcaagctatggctattttttaggaaagacttcatgaaccaccaggaccattctgatggtgcctaaaactagactctatccaaattagtttggttcacagtcagggttactgggtacttgggtgatagtcacaaccacaaggagccccaagaacataccctagttctccgcaaggaattgatcaaaagccacaaccacaagctggattaactccagttatgctatggatttgggaccctatcaacaacagaaccggctatgagatttgaggccaaacaatccttggatataagataccgcaattgctctgagcacttgatatactttaaaataaaattgctatgatactagatacctaagtaacacaactaggattcgaataccgatctccacctgaactgcaactcccaggacatctgttaaaccccaaaattagggcacaaccttactcttagctagaaaaaccagtcgtgatgcctaggaattcctgcagactgaagaatattgctaaaacaactgaacaaaataaataaaatgcatacataataagctaatggttggaaggaacagggcaaaaacttggcacaaatcagcaaaatttcgcccaaagctcagcctttttcacgaatcttcgagtagatctaaaaaggacaaaaaattaatcgcgagcgtagcaacaaacagatgggctgatgggatcaaaagaagggggctgctaattaatctccgtgttagggttccataggtcgggtactcgagtgtgcggctcatctctaaatctccctaatacattatgggtttattattacctctagcatggcctgcagccgcgggttgctgagcgctgaagcatccatggctcctctcctccttctcttccgctcttcttcttcttcttctctctcctctgcgattttctctctccttctctctctctagtggtggtagacttgtgcttgcctcgtcggcggcttgcagaggaggaagaaaggagagaagaggccgtgggctcttttcgttaatgggctatgggcttttttagaaatcagatcgataaaaatgggctatggacttttttttacattctggcccaataccgtttgcgaaagcggccctcaaccgcatccaattgcctttccccgtgtcactgtcaaccggagccaacctaagcaaagtgaagagattaaagatttttattagggaataataccagaaattaaagatctatagaagagtgagaaatcaagagtagagtagtggaactggaatgaacacttgtgcattatattctccaggacagatgtgacgattactgtcgcatatatatcttgcaagcaatgcaacttcttcttcaattcgtggatatcaatcatatctcgagtgcaaacggacacgcaagagagcatcagatatatatatatatatatatatatatatatatatatatatatatatatatatcgagaaatcataaatgagctgctagtattattatatatgcaacattcaaactcaagctagatatatctgtcgatcgatccatggatgaatcaatatgtttgtgttgcagtgcacgcatgcgcatgcatttcagtgatttctgtcgatcagaatcagatcagatcagcggtaaatgagtcacatcgctatcgcgcatgtatgatcgatcgatgttccttcacgtttagacccaagcaaggcaacgccattatattccatcaatcattacgcatgaacgttattttcatgcatgcccggtcaatatagttcctcaatttgacggcacataatctgggaaatttgtttcacttgctgtcctgcatggctacatcttactaggttcttaactaatcaccacttttctttaatcaatttcattctagccatgaatgatcagaattgcaacgttgtcgatgagggactacctacgaagtggatgactaattagaggtcctaatttttttcatatcttaatttatgccaatttgttttaatatgtttaaagatctttcactctctttttttcttttttgaaaaaaaagtactcttactttttttattaatgactagaatgagtttgtttcttcagctttggtaagtagtactactaattatggccaccttaaagaggcgataacgatacgaacatatgtttcaggcattacaaattccatttttccacataacaaaaaaaaataaatcactacatcacaccacaattctttttctaaaatctatttcttttaaaaaaaaattcttccgacttagttagagtaccaccatcaatttattcttttgtttcttggcatttttctaaatatcaatttatgattcgtatcggggactcagattattaggtacggccccacggaattgtaaaacaaaacacactactcctctgtttcatattactcatcattctagcacttttttttaaaagacaaaacatgaaggtatggtaaattactgaactatcctattaataacagcaatatttgtacttcatattggagttaaatgggtattttatacaagcacaatagttgagggggtacaatgaacttaataaaatgtctaaatataacagtgttgtaccttttttttccttctttctgtatgcaagaacatgcgctgttacctagtactatgtagaatgaacatgacaatcttcactgccacactgctcaccaaatcctaggagagagctacttgtaattttagtcttgttgaaatgatcaattgattagaggctatgtgcattatctcatactttggtagtactaatacaaactttgtttttgcgaggaagtactaatacaaactttgacggaggcgcaactgcctcatcccttgtgatagcaaggaaccatgaagaaccgatcctcttttgtattggtgtgctctgtgtatgatttcgtatgtgatcgatagctgaaatcgctccctaccgtttccattgataactctagtcgttaacgttattgccaaaaaccgatgaaagtcagataaatttggttagaaagtttcatttttttaatctttggccaattatggttaaatacagccagctcaataggaaccatgacatatatcgtatttgaatccaggctctgctctgttgagatatttttgttttcttttggacaccaatcatgtactctctacatccccattttaagtgcagccatagttttccgcgtccaactttgacgattcgtcttatttgaaaatttttaaaagaattttaaaaatataagtcacgagtaaaatactatttatattttatcatctcataataaccaaaacactaattataaattttttttaaataaaacagatgatcaaagttaggcgcggtaatggatggttgcacttaaatgaaaaagagagggagtagattagatagagtcaggcagtgtgggccacggagatgtctgagagccatagacagatgatccatttcattcgataattaaatacagtactgtagctagggataatcaatccctcgtgtctgtcggtgggccccgcgcacccaaccgccgcgccgaaccccgccgcagcaagcaactgctacccgtgccgccgcccgtctccggcgtccgatcaccatcaggcggccgcgcgacctcctctgcttgcgttgcgtgcctccccacgaggtcgaggtacacttcccttcaaagccactgtctctctctcctcctctcctctacttaacaccaaagcctcgcgctctgtccgtcctgctcctaatcctcgcggcagcttgcttggcgctcgcctccctcggccgcacttctttcttcctgattcctgacgtcttggatggtgcgctttattatggtgagaaattttgacgaaaatcgtttactgctattcctgcttgtcttctttggttatgcggacgacctgttcgacgaaatgactgatacaagggaattgattggtctttgtgttgtttagcctcttccgctctcctaatccttaacaagttgactgtttcattttgttgtctggtgtcaacgcttttatgattttctaaaaattgtagttgagcaaatgatgcaagtgttgttatattgtagacatggttttggacatatcactgtcttctctatgtttggcctttcgtttcttctaatggtatcgctgttttgatgccatctagtaatagcatctgcttgtccgatgcctatctttcttagttgacttctcatgcatactgtatcatcttctggccttatttgttcaacagacacacgacctgcactagtgtttacagctccaagtatgggttccagagaacccttcctgagtgccatcttcttcttcttcttcttgcttttgttctgcctcggctgcaagtgtatagcttcagagttacacttacacacgacccagactgcggtcctcaaggttgatgcctcactgcaacatgctcgacagatccccgacacgctatttggaatattttttgaggtaaaccgtaagatacatatagtaattttgttttgcacaattgcattatatcactttgtcctttcctctggcactttgttagcatgtctagaataagtcaggtagactacatgtttcactatgtcctgatggcaatttcttggctaatattgtaggaaatcaaccatgcaggagctggtggaatatgggctgaacttgttagtaacagaggtacttcaattattctttaatgcaagatatgcacttattttgttccatcgtccagataaaacataatttgcttctggatgaacatgaataacttattctgcaatccgatggaacacaaacacatggctttaaaaaaatccttttgttatttttttttgctgggccggcaaaaaccggcagagttgtatattaagaagaaaagaaagttttacaagtacaccctaagccaggggtggcttaggctacagtgaatcgtctcagcgatttagcctacagacaaacttaggctacagtgaatcgtctcagcgatttagccagcatcgatcgcgctcaacaggccggcggccttccatgtttcccactcatcagcgatggtagcacagaggtgtaccgccgatgtggtttttccatcaaacgcgtgcatttcgttccttccaaactaaccacgttaccaggataaccccggcgtcgaaggtcttccgatccgtcttatgaaccgatttgtgcgcctcgcaccaccagcacagtaggaaatccttttgttattgtctttactcgaaaattctccctactatcttattaactaaattatgtttttcccatgaacttaaaaaaagagtttaattttttttagcataactgtaattctgtaaacttggaacacaaaactttgattaggagcataaactggatgggatgcaaaataatatgccctttcatggaagctatattgacatgtagggcttagtataaccagcttatgagttttatgcacaggttttgaagctggaggccctcataccccatcaaacattgatccatggtccataattggagatgactcttccatatttgtggcgactgatcgaacgtcatgtttcagtcggaatactgttgctctaaggatggaggttctctgtgacaattgcccagctggtggtgttggcatttataacccaggattctggggcatggtatgggtttatgtattgttgttctttagtttgttttcctcatagtactgctaccattttgctgtattttctcatgaaattacctagtaaatcatggacctccacacgttctgtttcaaattttcatgtagcgatatttctttcgtgcacttgtgttgggcaaaatatggtaaacatttgctttcctaacttttgcaatgcttcctttccaatgctttgatcgcccttaattgtcatatcaacctgcagaacatagaagatggaaagacctacaatttagtgatgtatgttaaatcaccagaaactgtggagttgacagtttccttgacaagttctgatgggtcgcaaaatctggcttcaagtaccataccgtcagtgcctttgctctcaatactgggacaggagaacaaggatgtctgcccattcccattagttgaaagaattatattgttgcagggtttctggtgcgtcgaattggacaaaactggagcagaagttggttgctaaaggaacaaatagaacctcaaggcttcaaataacaactaccaagaagggagttgtatggtttgatcaagtctctctcatgtctgcagacacttacaaggtacattatattttgttatcaaacttcgttactggaaaaggaaaacgatatcatggactttttcatgctatctctatatagtgtatgataccacttaaatcttcatgggctttttctactgcttccaacatttcttttacacattcagggacatggttttcgcacagaactaatatctatgatgttggacttaaaaccacgattcttgagattccctggtatgagctatattttccaattgaaaatcaagttcttgatatctgcacatatatgtcagacgtgtctgggataattgacttgatttccattcaaacaattgtaggaggttgcttcgtggagggtgaatggttaagaaacgcattcaggtggagggaatctattggtccatgggaagagaggcctggacactttggggatgtttggcattactggactgatgatggccttggatattatgagtttctccaggtaccagtttagttgacattatttccgcccttcattttcttatcactccctaatcatatattgcctttgaattctatttttttttctaatgaaaaatttgaactctacatcaaagctttctgaggacctgggcgctgccccaatctgggtgtttaacaatggtaataattgccatattttttatatctttatcgccacagctgacctccttaattgctactaaactcttttatatatcaggaatcagccataatgatgaagttgatactgctgcaattgctccttttgtaaaagtatgttctgaactccctggtttattttctgttaagtcagatgcaccttgattcgctaaattgtttccactttaaaatttacctgcaacatcctagctatgactgggcattactatggatatggaatgtgagaaaattgatactatcttcactaccatcgtagtagtgttccatcttttatctttgtatatctaaatattaaggatcttcgttgtgcagatcctaagaatgcaactgcatatgatgtgtctcattgactgatgctaaaactcttgccttgttttctcatgattgaaatagagctgattttctgtgtaaaataaaggatggtttgggcttgttcttttacactattagttcagagagttctttaaaaaattttcacaaagttcacaagcagtgatgatgtttaacctgaatttgcattctgatctacttttcctgaattgagacggtaacgtacctatccaagaaaataccaaatatcttttccttaattgagactatggtagttatcataacaccacttttgttttgggaacgtctcctgtctctctacaggacgtattggacagtctagaatttgcaagggggagtgcagattcgacatggggttctgttagagctgcaatggggcaccctgaaccattccctgtcaaatacgttgcaattggaaatgaagattgtgggaaaaaattttaccgcggtatattcctcatccaatttcatattttatccacttgaccatataactgcataagttgaagaggcttgtctggataattaagaaggtgtatgatcgaggaaaaggatatgcacatgaaccatgctaattatgtaaaatatattttatgaatttagtcactcaactcactctctatccactttcaatactgggctttgattttgtgattggacgtgtatttcaaataatattagctcaataaaataaatctctacatgaaccagagggaaatatagtccacaacttctttatgatgctgtttctgtttcctgagaagtcgttcattaatttagtcacataaaatctccatagaaaaaccttacaaggtgacatttgtttcttacactatttcaattagtatataatattaatttttttatgtcatatgttctttttcctcttttatactcacagtaatatacgttgttattttttatcgttgcaaataaagtaggattagtaatacataaaaacaagtcctgaaagcaaaaactactaaaatgtggttattttcattattttttaaaaaaattgggatgcaatttttttatgtttgatcataatccccaatggtactgcacaagttttacttgaactgtgtggagagcaactgttgagttctccttttaggtatatgcatgatgttctcttatccgttatacaggtaattacctcaagttttataatgctataagggaggcctatccggacattcaaatgatttcaaattgtgatgcttcatcaagaccacttgaccatcctgctgatttatatgacttccatgtaaactactcatcctctggagttctgttatgcagtacttctcattctgtcaccaatgtcaaggtttttcccatttattaaattctaataattcctttttctctaggtctatactgattctaagactttgttttcgatgaagagtgcatttgatagatcatctcgtaatgggcccaaggtatgttgtatacctggactttcattgctgtgtgaaccttttcatttatggagatgcttgtaaaacagcactgtgaatctcccatctttcatttatattttacattaataatccaggacttctcttggtatattcgtaggatgaccttggccatctatgttttaacaacaattcagtaacatccacagttcatctatgtcacgtgtgatgattttttccatgttttggataattttggaatctcattgcttctcttgcttattcacttctatctttacagatgtgctgcctatttatctcttctcatccctattggccattaaatatatttcttcatatatgttttggttgcaggcttttgtcagtgaatatgctgtttggagaagtgatgcaggtagaggaagtctacttgcttcattggcagaagctgctttccttactggactggagaagaataggttatctttccttgaaacaatcttttctttccgggtcgtgtgacagatcacatttgagctttcctgcgtagggctttattaagatctactaacaaatgcaatgagatatttactgtaacttcttgttggttctttgcagtgatgttgttcagatggcaagttatgcaccactgttcgtgaacaacaatgatcaaacgttagttttgatggctccatgggttctttatttgggtttttggttatttaacaagtactgtaataatgcttcaatcaaacaatcaggtggaacccagacgccattgtatttaactcctggcaacaatacggaactcctagttactggatgcagactcttttccgtgaatctagcggtgctatgtttcatccaattacaatcacttccagctactctggttctctggcagcatctgcaattacttggcaggattctgaaaatagcttcttaagagtaaaggcaagaaattttgttataaacctactctacatctgtaggagaattgcgtacctcatggattgatcttgaaatctcctgtgcagaatataaactttgggtctgatccagtgagcctcacgatctctgcaactgggcttaaggcccgtgttaacgcactgggatcaactgccactgttatcacatccagcaatgtgatgaattagacttcttttagtaacccgaataaggtaaaccaacatttctgatttcttactgaatgtaaagcacaaatcaatgtctagtagagtttggggttttggtcattttaaaccaaagctttgctcatgataaccaatgcaggttgttcctgtcaaaagccagctttccaatgcagcagagcagatgcaagtcacgcttgctcctcactctttctcctcattcgatcttgggcttgcccagtccaaactcgtggcagaaatgtgaagcaggaacacaaggttagcgacagaaacacaagaaatactcgagatgtgatatgcgaataccagaatgcagtccatatatgtgcatgtatcttgaagcactactgtatagtgtaatacacaggaaatgatgaataaaattcactccaggcttactttcttcttttcgtttcgtttcttttcttttttttttcttttttttgctttctccatatttgtatcggatgagactagatggcgcattgccaccgtgttgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcatagatgagaactgtgtcagtaaccccggataaggtaagcaactgttttctacttttatctctggatgtaatgcacaagtcaatgtgtggtagaataggtggttttggccatctcaagccatagcttcgatgcaggagcagatgcaagtgtcacttggtcctcattcgatcttggtctgggccggtccaaagtggtggcagagatgtgcagctgcaacgcgcacggggttagcaatagaaatgcttgtgcttattcgtcttcctcgatatatttctgtcgaatgaatcaagatgagcagataaagaagaggaaaatggaagaaaatatgcatgggctggctgtacattntttgctggaacccatgtgaacttgtgaagtgaactagtaacttgttggcaattttagcaagttgactgactctgtctaactaaagcattttccagtagtagatcgtgcaacctcgaataatcattttggatcgtttcgtgtaactcaagtagtgtagttcatgttacactaactgaagcctccatctggcagaggaatttctgtgaaatgaatcaagatgagcagataaagaagaggaaaaaaggaagaaaacatgggctatggctgtacatttttactggaacccatgtgaatgaactactacttgttggcaattttagcgacttactgtatctaactagagcaatttccagcagtagatatcgagcaacctcgaataatcaggttggatcgtgtcgtctaatacactactacaccagctagcagcctagcaagtagtgtagttcatatcaatatatcatactaactcaagcctccctctagcaagtagcaacacaatccaatccattgtcatcgcagtcgcagaatgatgagagtgtggccgccggcgacgacgagcatgctgtccaggcaagccattgtcgtcgtcgtcgtcttcctcgttctgttcttcgtcggcggcggcagcagcagatgcgaagccgagacgttggagacggcgtctctccatgtggattactctgtcgctcgaagaatgccggacactttgttcggcctcttcttcgaggtgagactagctacgtctcttttctttcttttccatttcttctcctgtggatgcttgcttttcttttctttatcaaaatctgcattattattatttgtgcaggagattaaccacgctggaagtggtggcctttgggctgaactcgtcagtaacagaggtaacaccacattatagtactactccctcctttcctaaatatttgacgccgttaatttttttaaatatgtttgactgttcgtcttattcaaaaacttttgtaaaatgtataaaactagacgtatacataaaagtatatttaacaataaatcaaatgataggaaaagaattaacaattacttaaattttttgaataagacgaacggtcaaacatttttaaaaaagtcaacggcgtcaaacattttgggatggaggtagtattttatttggcttccgagctgaaattgaccattaaattaaagaagagagcagtggagtggtatcagccgttggatgtccattcaacggctgattggtcttcaacctccagttcattgacacgatttgtctctctttttatcttctctctatttttttttctctttgagaactcttctctggtgaagttgaacattaaatcaagagttaatttcactttggactatatttttttaaaaaaattattttggatcaccctttgtttccaattttttcactttggactaagtaactttaccttttgttgtataatagatactccaatccacatcttcagcacttcaatgactctgagcaaatcgttaacgatatgctggcgaattttcatacctatacgcatgccatatctttgccaaaggaaacaatagacatggctagcaaatagagttagggtggttcattatgcaacaaaggtaaaagtacctattcaaagtaaagagattgggtatatggtgttgcaaattgaaattttggcgataaaacatggcactaagtttaattcactcttaaattaaagaagaagagagcagtggagtgctgtcagccgttggatggccatccaacggttgatggatcgtcttcaacctccagctcatggctactctctctctctctctctctcctcttgaacgattccctcctgcctcctccctccccgcacctgcacctgcaccatctccggcgtctctcgcggccggatccgccgcctcctcacccaccgcccaaggcctcccctccctgtatacgaagccccgatgaactgctcctccctccacaacccctctataccccgccagatccactccacggccccaccccaacccaatatcctaatccattcgccctctctcgccggggaagaaagccaaaaggaggaggaggaggctcatcggcgcagggatgctcgggattcaccggccagctcgacctcgttttggtgggggtggtgtgtgtaagagtaagtaaccaaggcttgaggttgaagaagcaacatggatggttgggatttgtgatctactgccaagaatatttggggagaaatcaatcacctcatgtatggcaaatgcaaggatttttgaggagaaatcaaccggctgatgtatagcaatgttgaataagaaaacattttcccccctcaataaataaataaataataatatttggagtttaactttaactgattttttgtctaatttcttgctttaggttttgaagctggagccaacacatcaaacattgacccatggtccatcattggagatgaatcctctgttcacgtgacaactgatcgctcatcctgtttcagtcaaaatcctgttgctgtaaggatagaggttgtctgtgacgattgtccagccggtggtgttggaatttacaatccaggattttggggcatggtatgagttctatccatttttataagtgcattcctatatgaataatatgcaaaatagagcttgtaattgaaagtagtatcctttttttttacgacagtttacaataaacagtgctgccacagaaagaaactatagcaaagttatttattctgttcgaaatggtgaagaaaacaaataattaagctaacctattttttgtttgatttcaatttgcatttatcttttccttgcataatgctggttttttatcagattgttgtgcattgctcttggaaaagtgtaatctatagcttttcttcgaaccgttttcattttaccttctcatattttaatgggattttaccttctggttttgtgacgaatatgatcatttcaattttcagaatgtagaagaaggaaaggcatataatctggtcatgcatatcagatcattagaatcggtggagttgacagcttcactcacatgctcaaatggatcgcaaaatcttgcatcaaattctgttcggtatatattttttccgtaacactgagataaaaaaggtttttcaatctctctcgctcgttcgctcgctaaccgaaaggattgtacatcaaatttctgcagagaaactaatttgtcaacttggacaaagatagagctacagttactagctcaagggacatgcagaacttcaagacttgaactaacaactaggaaaaggggagtaatatggcttgatcaggtgtcacttatgccttcagaaacatacaaggtgcactgtcttttacttttttattgctactgtcatcatagcttgatctggaatccggtatcatcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagggccatggttttcgcaaggaactcatgtacatgcttttggacttaaaaccacggtttctacggtttcctggtatttcgaatgttttccaactggcaatcaatttcggttgccctgtaatttaatcgctcgcattacatttggcagggggttgctttgtcgaaggcaattggttaaaaaatgcattcaggtggaaggaaactattggtccatgggaagagagacctggacactatggagatgtctggcactactggacggatgatggccttgggtattatgagttactcgaggtatgggttgattaatgtgaaatgggttttttcttttggtctcggcatatctcaccatttgtttacttcaaaatgttcatgaaagcttgctgaagacttgggtgctaaccctgtatgggtgctcaacattggtaaatatcgtgtctatttgtcttgttcaatgtatttttaatctttgcacaaaccaacgaactgctcagggttttttatcttgtaattagggatgagtcaccatgatgcagttaatggaactatgctcgcaccttttataaaggtatgttttcgatgccctacattttttgaagtatggatgagatgaagatggacttctcatgatgtaacagaaaacagttgtaacatgtgaatattaacataaggccttgcatttattgtgatcccatgtttcttatttcgagatgctttgattttcttgctacaggatgcaactgacagtcttgagtttgcaaaggggagtgacaaatcaacatggggctctgttagagccacgatggggcaccctgaaccattcccactgaagtatgttgcactagggaatgaagattgtgctccattcaagctgatataccgaggtaaattttgcataataaacaaatagtattgtccttcgtgttaatgctgcgatgattggctaaattcatcattctgttttttatcgatctgcaagggtaatagcactattttatttaacttcaccctttttagtactatctgattgcataatggagatattttggagaaataatagatgaaaaaattggctgcatgccttgtggcagaggccagggatgtaaaatatttccattataaaaaaaataatagatgaaaagaaaaacaagaagttaatttaccagtctgctgttatgtttcgaaacagactttaccagtttctagaaggttcattagttttacatttgattgaggccaaattggctacgacgtataatgctgtttcagtacatttaaatgggctactactatcataaatatcctaattttcccttgatatcatataaccatgtaattctgttgaacagaaaattatcccaagttctacaacgccataaaagaggcttatcctgacatccaaataatttcaaactgtgatggctcgtctgggccacttgatcatcctgccgatctctatgactaccatgtaaacaactcactgagactaatttatttctatcattctccctatttttaaattctgtcttgctggtttttttcagacttggttatgtgatcattttctccatagatttctgagaatgttacatttattctgtagatatatgaaaatgcatccactgtgtttttcaagaagaatgaatttgataggacatcacgtaatggtccaaaggtaatgaatttgatataaagtggcttcttttgggaaattaagttcttttttttattttttttagagaagggtattttttacccggcctctacatccaaccggatatatgcggccattgaaatagggaacttagccccacaaacaacccaatctgaaattcgctccataggagatttgaactcaggaccttgggtactaggagattcgctccataggaaattaagttcttagattagatcagtcttacaaaggcagcttctctcatgcgccattatcctcgacattttcttgaatgaaatatgcttctagttatttcgaaaaaaaagtgtttctaggtattagtttcttccatcttcttccatgactgagactgaatctataagatcagaatatatgataacttgaataatatcccaaactagagcaatctactagtacttcataacttgaactccagatcgcttctagagcaatctgctgtggtattgattgacaacaagcatagttagtaattatgacaacaagcatgttcttcttcttctcttccttttcccatgagaagaagcctaactatcgaatagcaaaacgtaagacgctgttcttccttttcccatgtttgttggatggtttggaaggaaagaaatgcgcgtgtgtttcagaaccagcggcgctcagccggtttcctgtttggttcaatcaaagaggaagtggcgatttggaaggaagctggggttttcagaaatataggagagtagtcccttagtgtaatcttttgcttttgggaggttgctccggtgacaacttccattacttcgacagcttcttgttgaagttataactttgtatatttgtatatattcttcaatcttaagtaaatttggttggcctttcttggccggcccggcaatttattcatctcattaccctttgatgttggatagacagaatataagtgagcaggaaccactgactatgcaattgtttcactgcaggtatttgtaagtgagtatgctgttaatggtgaggatgctggcaatggaagccttcttgcatcattggcagaagctgctttcctaattggtttagagaaaaataggtgatccctctggggatactctcttaattctttatcttgggttcagagtaaatataaaatcatgcgcagagttgtctacttgtatccagaccatgcatgaatataagagatcgttcaatgggattcctggataaattgttgatttttgtttgacaactactacctcatctttgtacttctccacaaggaaaatattttgagtaaatgtataatttgtaaaaatttacattgagcaacagtaattccttattgcaagttattgaattggctctcatcatgcatgcttctttgcagtgatgtcgttcagatggcatgttatgcaccactcttcgtgaatgacaacgatcgcgtgttagtatacatggtcttatactttctttgttcaaggattctagcatctgtttcctctctgactattgctaatgtataaatgtgataaccagctggaacccagatgcgattgtcttcaactcctggcaacagtatggaactcctagttattggatgcagacatatttccgtgaatcaagcggtgctatgattcatccaattatgatcagttccagctactctgatttattggctgcctctgcaatcacctggcaagacgctgagaatacctttctgagagtgaaggtaaaccatccattccagtttcttctaaacttatatgcatttggttcaattcattagacatgcgccttattgtttggaatgatttagttacaacgatacaaaattgattcagccaatgcatacttgcataacatgcatctgtctttatatgtattactgctggagtaatatgtttggatcttagaacatcctgatcttcaaatgatcttccacagatagtaaacttcgggccaaatgctgtgaacctcacaatatcttcaagtggacttcaagctggtgtagatacggcaaaatcaactgtgactgttctcacatccagcaacttgctggatgaaaattcatttagtgaaccaaacaaggtatgaccaattttgctttgatcagtaattattggtttcagactttcattactatgcacagaatttagaagagggtaacttctccattacaaaaatctggtctgttacaattagacatgcaggtggtatgcctcgcatttgtcaagtagtgcgtgctacataaacacctttgtagatatatccctactctgccttttattttgtcatgtctggattatttccttgtctttctaaagaacacagagaatctattgtaacacacgatatctcagggtacgcaagttggtctaacatacaagtttcttgtgaacacgcattgcaggtcgtgccagttgccagcgagttgccgaatgcagcagaacagatgcaagtcttacattttccttactcaatttgttcgtttgatcttgctctggtttagccgtttaattagcacaagtttatcaggctaacatgttgggacgctgtttctgtccttaatgacatcccaggatttcatagtgatcaaaagctaattattccactgtatcagagcccattaggccaaggatggttttaattaaagcttagtttgaacaactcgctttatttataatatatccctttattgcttctaagaaatcatcgagttgtttgtttggatattagtaatgatatgggaattattaagttgaccagataaaaatgtagaatgcatcaaaaaggaacttggtatcaatgagatcacgtctcctttttgtttgatagccatggatatgatgtttctataatatggggatggtgatgagtctctcttttgttttcttgcggtaatgcagctctgttaatttctctattacggtttggcaagatggccggtgtctccggatgtgattttttttgagtaaatttcactttggacctgttttattgaccaaagtttcaccatgaactatgtctaactcgaccttttcagttaacaccaggtatgattaccttcttttgcaatttggaccgggttttaagacttcgggccaccacgctggcttgatctgagcctagtgaactcagttcagggaagagaaattatcgacggaaactagcgcatgggagaggaagatagtgccgtggaggcgcggaggcggattttctcaacgcctcggtctccaccctcaccactggtggctcctgcgcctgcggagcggcacgatgcggcggcggcgtggcacgacgcggcggccgtgtgcacgtctctggctctggcgaggcatggcgcaacggccgcgcgtgctcttcttcggctccggcgcggcagggcggcggcatgcatgctcttctcctgctcgaccgcggtgccggcaacgggggtgcacgcactgctccttcagctcacggcagaatggaggccaaaagcctcaccaagttagagtaggatttattagctctgtgtactgtagataagtaccactaaagagaaggcactgggaagggaaattatcagaaatgccatgttgtgccgataattcattgtacctcaccatcaggtacatgtacatatggaacttggaacctctctgcttgtttttagtggcaaaatggacagctccatcttacttgcacactcattcagaaacaaacattgattcattccgccagcactacactggagctgaagagcgcgccgccatgccaattcggagccagaaaagagcacgccgccgccgcgccatgccgctccggagacacggccgtgagccaccggttgcgagggtggagatcgaggcattgagcaagtccacctccacgacactatcttcctcctttcccgtgcgctagtctccctcgataactctctgccctgaactgagttcaccagctcaagccaacgtgctggcccaaaagtattggtacccggtccaaactatataagaaggtaatcatacctggtgctaactgaaaaagtagagttagacttggttcatggtaaaactttggccaaaaaatcaggcccaaagtgaaatttactctttttttttttgataaaatgtaacttccattacccagctctcgggagaaagccaaacaggaataaacagggtgttatacaaagctcataaactaaccaagagcattcatctccggtaacggacacgctacagcgctaatatgttgttgcctcccatgcggcgcagtccacaccaaaacgaccagacctctaaccccacaaaagaaagagtttagacctaatagggacggtaacaacttgctaggtaatttggctctcaagaaatgatgtggtttttataggaaaactgtttcttctcctttgcaggttattttcttaattacacattggctctacattggctctgatcatgggttattctcgagaagcccaatttgtagggttttgtcacttcgacttgtctatatttaaagcaagtgtcaatgagttttatacctcggtatataggtgacgacctattatttgggttgtagccttgtagggtcttgatcttgcaagctgtttttttctcttcttttgagtgtgttggctgtgtgcactatcgtagtgcagaggctgggagtgttatcaaaacttttgagtgaaatcaataaagcttccattatcttaaaaagaaagaacccaacagactgacacatactaatcccagcaaaaacttttgagtgagatcaataaagcttccattatcttaaaaagaaagaacccaacagattgacacataataatcccagcagaaaggaaactacgatatactccctccatcccataaaaagaggattcctagcatcccaaggcaaatttagtgagaagtaaaatgactaaaatgaccctcatcaatagaaaaggtagtactggtgataggtaggtaaagattatttaagagataaaacttctcgttttatgtgttgaagataggtaggatggtagaagttggttttttgtgggataaaatttaaactctagaagttaagttttttttttgggatggagagagtatcaggcaaggtctccggttcctgcagcttgtccatcagctccttatgccacttgtctgggcaatctccttccatttgtagcagtttccatctttgcacccacgccagggctttgtagactacctgcaaaggtgatttagcaattttattttcaaaaacccactcatttctatttaaccaaatcccccaacagaaccaagcaacgaacacaattgtgaggtttgtttttagtttcttctttagcatcctcaagccatcctcaaaatcatttggtatttctgacagacccagagtttctctcaacacacaccatctaaatttggcaacagagaaattaacgggatatcgattctacagatccgatatctgatatcggaatcattgattggagatgatcgatcaggtcattgaatgccatgcaaaatgctgtacttatgtaattgacacgcaagggcatccagaaaaccatctcattcaacatcatcttacagagaaggtccaagatcaaatccacaaccacaatggcgtcatcctccaatgttaacaatggcgtcagtgttctcttcctcttcgctgttctcctaattgctgcgtctcagctcgccgccggcaccaactcgttcctgtacggtgcatgcaagaccatcgccggcggcagcgagctcctcagcgtcacgttctgcatcgacgcgctcagctccgacaaccggagcagcaacatcagcagctacaaggaattcgcggtgatcgccgtcgacctcctcacggccaacgcgacgagcaccaagtctgagatagacggcaagctccggaacggcagcggcgacgccgctgcgacgcggtgcctctagtcatgccagtcggtgtacggcggcatactgtaatctcaggccgccgtcggcgcgacggtgaaggcaggcatgttccaggaggcgatctcatcgctggagaaatcggcgagcgcggtgaaggaatgccaggacgggttcggcaagagcaatgtgacgtcgccgctctccgcggagaacgacgatgccttccagcttgccgagctcatcgttttgctcatccgtgacgaacagatcaacaatgtttcgccttaattgctttttttataagggcagtcccaacccataacactggatatggtttccatagaaactagtactagacactactcttccaatgcaaacaccactattccatacttcaatttaatgctactttatctcacatgatgtcttagatgttgtgtagaaaccatgtctcgtgtaagacatggtttccttctctttcctcatttattcacttgccacatcattttttttcctaggtgacaacttatttaatgctatggacaccatcctagtcattgggttgggaatgccctaatgcatgttttccccgggttctcaataatatagggggctgtttacttcccaaaacaaaaacttttcacccaccacatcaaatgtttggacatgtgtatggagtattaaatgtggaaaagaaaaactaattacacagtttgtgtgcaaattacgagacgaatattttaagcctaattgcgccatgatttgacaatgtggtgctacagtaaatatttgctaatgtcggcttaattaggcttaataaattcgtctcgcagtttcctggcggaatctgtaatttgttttgtcaatacttcaaatgtgtgtccgtatatgtgatatgacaaccaaacctaaaaatttttcccaactaaacaaggcctaagtgatgataaaggtaatgatactacctgcgtttctttttcagatagagcattttatggcactgattctttccagtaataaacagcagaaaagaaatgcacacaaattatttttccaaatgtaacatatgcatccaaatatcaagatatgcatgtaaacgatcttgattaaaagcttcatccattttaattttaattgtttgatattaggtcacgttttttttttatcaaaagcttccatagtcaatgttcaatgaatttggtggaagtattaattcaatggtggaaatttcgtattcatttatttgatgtacaatacttattttgcccttgtttttagaccctatttttagggttttgttttccctccttttttaaaaaaacgaaaccaagttttgctctattttagatgaacaagttaacgatgttaaattttggcaaaaagacattcataccttattattgcccatattttatacatgcaacttgcaattttgaaaaactacaatttcaacaaaaaaaatgtttcaaaacttacattcttttgccacatttgataattttgggcacaattttacgctactaaaaatttgggcacaattttttttacacagttatgaccacctttacgcaccgagccctcaccgcctccctgtaagttcaagtgccttaatttggtttcggtgattaatgacaaatctaattatatgagactaacgtttttatgagtctttctttgactagtattatttggatataaaagtaaaaatgatgggaggtatgtattaaacttcacatattctaacttggtctctcttgtggatccaaaatatagtgtgagctccctcattgatcttgattgattatgtgcatatgcattccttcatatccatatgtatgcacatcttgagggggagcttattctatattttgttcattataagatctctaccttgatttgaaattatctttcatctcatctctttgtattgtttatatcggattattatctatcacagaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattctttggtgatggaccttaatcatgacaagaatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaagatatgtgtttttttgtttatcttcatcattactacatatgccttctctatgtgtataggataaacccccattggttcttctttacttatgcatacacttgtctctcttgtatatttctttggatgcatatacttagggggagcaaatcctatacatttattgtgcatgttttagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttaagactaatgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttagtgtttggtgtagaccggatttgctagataggcgccgtactatcaagaggggtctatgaagcgagcttgtggatgatcttgtgccatattagttcatatgcatgtaggtgtatttggtgggcttgtctagccaagtgtggtgagttttttcaagtcctaaacaaagagagatgtgggcaaatcctataggtttgggcagcctcatgtggttatgtccggtggagtatcctttagagtgtgagccctttctccctgagaaaagttgtgtttcttggatggattgttcatgggttggatagccctttgaataagctttccataaagtccaagaacgccaaattccgagacccgagtcaagagatatcgtcgttttactaacgttcggttgagctgaaaagtgacatgcgatatgaccgtgggccttaggccggtctgaccgggcctgttagcaggtctgaccgacgtggtaaggccggtctgaccagccccactggtctgttgcactggtctggtttttggtggcgatacagagccgctagagctgcaaccggtcagaccgagccgacggcggtctgaccgagccgtggacggtctgaccggccactacactgcggtcagaccggccaggttgagtgggctcaatgattgccctgtaacggctagttttctagccattacaaagtagtccggtctgaccggcctcacaacggcggtctgaccgacagagcacaaagttggggatttcggttccaacggttagttttggtggttaggggtatatatacccactccccagcagcaagggtgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccacgtgcgctcgctgccgctgacaagtggggcccacctatcaggcctgtcgtctacctccggccggccgccgcccgaaccctagcgccgcgccgccgtcgtctctttccaaattcggccgcccctttccttttccggtgaaatcaatagaggggaaatgatcttcgggatctcctctaccttttctcttttggaatcgtcggctaaaatcgtttggaaatctgtggattcgatctcgaatcggattcgtctctctccccgaaccctagaccttccttcgccgtcgccggtcgccgtgggccttcgccgccgcctccttgcccctataaaaggacccccaagcccgccgctacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgtcggagcaccgccgtcgtcgtcaagccgaaggttgccgccgctttttcctcgacgccgtcgccgtccgttgatcttccgccgccgttttggtcaccggtgagttcgccgcgtcattctctacgtgctggtgcccttcgttcgcgtcgtcgcgccgtcgttcgccggcgagcttgtgcgcccgagccgctgccggtggtgacgtcaccgctaacgtcatcgttgccgtccgtcgtggtccgcccgtggaccggttgatctcgcccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagatcccaaacaaccctttgaacatgtttatcccgtttaaagctattgtttctattcaactattgcatttattttcgaatgccattgggtggaattaacctattgtttgttatagtccttttgttcttgattactttattccttgataccttggattattataacttgactagttgagctttatatattggttcagctagatattagatatgattgcttagccatgcttagaaatattagcacacaattgggataactaatgtttcactattacttaatgatggatatttaatgatagctcatgatggttaatcatgattggttaattaattaaattgccaactaaaacttgataatggtgggttgtgagcacatggttttgagagtcgtgctcatgacaatttaggaccggttcacgagtttcggttgtgaaacattaaccgtgccaaccacaagccagcgtgggcaacggctttaccttttgtatagcatggttcattgcggagcaccagactgagaagtggcggagataagcccatgggggtcgctggggagtctatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgtgcacttgcatatttgctacgtggcttgctgagtatgtcatatactcaccttgcaatcattcatcagaggaggagttctacagtgatgctgatggtgtggatgattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagggtaaggttttggcactccattgcattatcttgaacccttgcaagagctctcacacccttgtgcacttagtttatctagtgaggtgttagagagtgagttaagccaatccaagtgcattgcttcattgttttagctagtgtggcacttgatcatcctcggcaagcatcctagacttgttactcttggaggttgccgcctcctagacggcttgtataggtgttgcccggtgacctctccgagaagattgtggaggaggcccggcaccgtttgtgagtggtttggagttcaccaccttcggagtgaaggaagaactaccccgagtgatcgaggcttggatagtcctctccgtgggtcggctcccgccttgcccaccccttgacgaagggggcgtgcggtggcttcgtgattgagcggtggagttgggctcgcctcaacggggattaggaaaccggcgagtttccgaacctcggtgaaaaatttcttgtctcttgtctcatttatttgttgtatttacatttgtgctatttacattcatagagacatatttgagcctataacacataggtttgcaaaacttaacttagttgcttagttaaccttgtaccttaccttgcctagcaacttaggttagttttgtttaagtgccattaaattttaaaaccgcctattcacccccctctagtcggcctgcttgatcctacactccctgcgctgagtcgctattgcatcgcctactcatagcagccaccccgcgccgaatcgccgtcgcttgccctactcgccatcacctccccacaccaagccgccgccatctcatcgcactgacctgccgtcttcctgcgttgaactctagctaggccactgactcctccttatgcagagtcgtcaccaccgtcacccctccctacaaggagccgccgccgcctagccaggctatcaccgattcctcctccctgtgaggagctgccactgccattgcctggttgggccaccactgtcgcctcctccctacaaggagcagctgcctggctgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttgtggtaacttccattcgaaattaatttactagctgaatttgattgcattaattacgaactctatacttatacaagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgaccaatagagggagcggtaactattctctcaacgaaatgtgcaaaggaattgatttccttccagtagcacagaaggaatttatccatacaaatatcatcatagagaaaagcagtacaaaatgatacacattgccatcagctgctataagagcttgaatatatagatgaaagtatggttatactatttctgcagccaaaataaaaaccttaatgataccaacacaaaatacaatggaattgtggaataaaaatatgcggcaactttaaaacagccatctactcctggtgacaaacagccatctacatctggagtatgtagcaagagacgagtatgatcacgagtttactttgtctgtacagcacagataagtgacacctggtgagcaatgccatcgggtgaacacagaagtcagcagctgacttcatttagatgttaacattttagtggtaataaaataaagagctcattttgattcctgcatcctgaagtttttgcccatgttctatcgccactgtcccttggtgagacaaatgaaaacaatggaaggttaataatctggaatagatgcaaaggtataccctggtgctcctctcgaggaatagtaagcaactcgagtctcataaaaacctacaaaacaatgtcagaacaatataatccttctcgctaaatggatacaatagtagagatgtctgtctactatctacaataataacaaaggacataattttacactaatgcacatttaaatagatttcatatccaaagagattctgtttccagtatgacactccctccgttccatattataaggcgttttgggtttgtcctaagtcaaacttcttcaaatttgaccaagtttataaaaaaatgtagcaacatttccaacaaactacactaaaataaatacttttgaacaaagtcatggaaaatgatcaataaataattggggaaaatttttcattgagaagatgaaaaaatttccataataacgtgaaaatgtaaggtaagaacattaacataccaggaaggaaggcaaggatgcccaggaacaagagaccatatgcctgagagttatccccctccatgtgacctgtgaatataaaatatgacaggaagagaagcgaacatcctaggaggaggaggaatagtgccagggcaattgacttccacgggattttcctgagggattttggggtgtaagtgaaccgaaggtcaacatcatcagtaagattgctgtcatccctgtcctctgtaggaaggggagcatacccccgaacattgcgtctagacgccatagtgcagtgtctgcatttgaaacacatactgtaaaatacatgtagaaaatgacatggtaatacacagtaagatctaagagttcaattgacaaagaaaagttgaaatccacagttgctgctaatgataataaaaaattacaagctttgaaaaaataaggtgcaccaaacagtaacagagatgatatgacaaccaaaactaaggttgtggttgccgtcgcatgtgccatgccaagggccttaatggactgcatgtgacatgggcatcacaaatttcatgtgaatcattctcagaaaagaactaatagtttttatagaatgattagcaaaatataagaaaaaattttctgtaatgcgacatgtaatttgaagccaactcaaagaacagaatcaaagacaagaacaggatggcataccagacagattttttctctaggttgttgcatatatcaaataaaaccttatgcaacaagatgcgtattaaaagctttgatcatctacaatcatctgcacgaactaaggctaaaatgagcaatctattctacaggataacaatcagaaaatatgggctaaacaagacacatctaccctgacctccgaacacaagtactaacaaaatatggagtacattagtaccttgatgtgcaaattagttagaatctgaaatagtactaacaaaacatgaatacctcagatttttatatctgaaaaaacacctcaaaatatactagtctttagaacctttccaaaactgtatcttagttctgtatactcctacattatagccaagaaaatcataccagcagcctactgttagtaagaatcaccaatctgagcctttatatgtctcctagctctgaaccagatctatagaagagggaaaacgaattacaggcaagtcagcaaaactggtccgagtggtaaacaaatcacagaaagaaatcagaagagacaggggtggcaacaccaacgcttgtctcaggaaaggattgaaggaacgaggaggtctgggggaaatagaagaggaacaggcgaggacgagagcacgtctggagactggagtgacgtgtcctctcccttgatcctgatttccttcggtagccatactgttggcccgattggacctttattatcatgcatatagaggtaccatctatgggcttggagcccctaactaatgggggtccagatcggtcgtccttactgacctgcctcagggccagccctgtgaacttcacaagtttataaacatcgagcagcaaaatatcatttaattaacataaaaaaaaggaaaaccctacaataacttataattctccaggtaaggaccttctgaccccttccccccctctttttttttgtttcttttttgcaagtagcagggcagaatgtgatagaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctgggctaacagtacagtgttctaggcttaattttggcaaaaaaaaaaaaggaaagaaaagaaaaaaaaacccagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaactatgctttgagcaacaaattatattgtacatttggcatcatatcagcttgtcgtggggcaaggaaaacatacaaaatcttgtaatttcacaggcaaaatgttcattctctagttcgttcagacagaaaggtgttaaattcaatcgtaatggtcatacctaatatcaacaaggcaatatcacaagaaacctctcaaacgaatttctatatgagggatgtccagcaatcaaatgccataaacgaatttttgttacctttttttcctagatggagatgtccctcggtgatgaaggggagaaaggagacaaactgtcgacgacggaggccaccgtgcgatggggtggtgggaggccggattcagcaggtggtggcagccgcggag

SEQ ID NO: 25153 - DNA, 11509 bp, Oryza sativa
tgacggtgcttagactacaagccgcttgtccaatgaagtcaaacaagattatggggttcagtcttaatagtaactcttcaactctgaggctaaaaacctaaacaagcaaatgctcacataataaacataaaaataaaggatcgaactatgctttgagcaacaaattatattgtacatttggcatcatatcagcttgtcgtggggcaaggaaaacatacaaaatcttgtaatttcacaggcaaaatgttcattctctagttcgttcagacagaaaggtgttaaattcaatcgtaatggtcatacctaatatcaacaaggcaatatcacaagaaacctctcaaacgaatttctatatgagggatgtccagcaatcaaatgccataaacgaatttttgttacctttttttcctagatggagatgtccctcggtgatgaaggggagaaaggagacaaactgtcgacgacggaggccaccgtgcgatggggtggtgggaggccggattcaggaggtggtggcagccgcggaggactcggtggcggcgcgcaggcggccgtcgaggtggagatcggtcgcggcgcggaggagggcgaggggagcggcggatcgggggtggggaaacgcgataggcagggggattggggatttttttttttttactatttgacatctttccaatgccacgctcccaaatgccatcttccaaaaaattgtagctgaattgccattggtcccccacattagttgatttcctaccattttggtccattcttgatgccacatcagcagccacctcatgacactttaagaaaatgacaatgatacccctacccgttcagtacaaatttaacacagctcacagcaaataaaatgaaaccaacttcaatgcacaacaatttcacaagcaaacacagcttggaacatacaacaaaacttgcaattgggtggagccatggctccctcaaatctttctgaaaaccaaaccctagacagatcaatctaaaaaaagaagcaaagatcatgaaaaaaattgatgccaaatcaaagagggaaatacaaaggatctgttcttttacttgggattgtatcattgtttggccaccgccagcggagtcgcctagagcagggagtgacgcgaagtcagacgaggaggagcgatgcgaagcctggagaaagtagcgatgcaaatattagagtttttctcccactccctatacgtaagggcaaaatagggatttcgccccatccaatgctgatttgacataaaaaggaaaaaaatggctgagaatcaactaatatatggacccggtggcaatttatctagaatttttgggaagatggcatttgggagtgtggcatcggggaagatggcaaatagtcaaaaatcccgggggattgagggtggccacctttttttccccctttttttatggtatagaattcatctggagtatttctgctctattccgcattagaactccctcggctggaaaatataatatatgcgcattttactacctccatttcaaattataaaatattttgactttggtcaaagttaaactgcttcaagtttgactacgttcgtagaaaaatacaataacatttttaacccaagacaaatttaatatgaaaatatatttaattactgatttaatgaaactaatttggtattataaatattactatgtttttccataaacttagtcaaacttgaagtagtttgactttaaccaaagtcaaaacgtcttgtaacctgaaacggagggagtagttttttctagactaatcatggattttagtttttattaaaattacgccaaaacatgtagatatatagtacatgtggtgacgctatattcgtatttcatatgaagttaattttataatatattgatataaactatcaaagaaattaatgatcaaagttatcaaaggccatgtcaaaaactaaaatgacttatattcctcatcgaagggagtgcatactacgtaatcatgtacttcactgtatggtctttctttctttgcaaatccatataacttaggtggtgtttggatccagggacttaactttagtccctatatttagacactaatttagagtattaaatatagactacttacaaaactaattatataaatgaaagctaattcgcgagacaaattttttaagcctaattaatccataattagagaatgtttactgtagcatcacataggctaatcatggattaattaggctcaaaagattcatctcgtgaattagtccaagaggatggatgggttttattaatagtctacatttaatatttataattagtgtccaaacatatgatatgatagggacttaaaagttttagtcccatctatacagggccttaacctccttgatccttgtttatttcaaaattaaaggacatgacaaagggatatgctaagaaaaaaaaagactatgtgtatataaacattgtctcttgatatcagtgttcctcattgagtaacaaagcgccaagcttggcgagctcaaagctgtcgtggttctctgtggtgagcaatgacttgacattactcttcccgaaccctttctcgcattcctccaccatgttggctgccttctccaacgccgacatcgcctccggaaacctgccagcctgcacgttgtagaagatgccaagctgaccctgtagcacgctggcgtatgctgcctggcacgactggaagcacaccgtcgtggcgtcgccgggtttcaagccgttgccgtcgtccttaaggatgttgtctatcttggccttggtgctcgtcgtgttggatgtcaggaggtcgatggcgatgatggcgaggtcactgtagtagctggcgctgaggctccggctgtcggaaccgagcgcgtccatgcagaacgtgacgctgatgacgccgctgctgctgccagcgacgatcttgcatgcgccggacatgaaagagtcagcgttggcggcgtgttgagcttgagacgccgcgacgagggcgacggcgaagaggaagaatgcattgacgatgccatgggaggagaccattgtgaaacctcgatcgatctgcaagatgatgtcgaatggtttttttggatgaatacttttgtggccttgcgtgtgaactatttatggacaggttttgcatggtgttaaaaacgaacagatcgtctccagttaataattagatagagtagatccgtaaaatcaattattgattccccgtaaatctctgaccaaatatggctgaggcatatacaatgacaatcattagcatgttttgaagttattaataagatgattttacttacataaaaaagagaagacagagaaatatatttgttacttgtgacaacgacagacttttagtgtttctaaaataacatttgtcgcatgagaatcgataaaagaaaagaaagataataaaaaaatagttttggtgtattaattgttagagtagtattttaccatctctactgctgttgtaaattgtaataagatagtctctaaatgaactaagaacctatactagctttaactttaatcatgcctaataaaacatccttaccgttgcatagagttgatgatttttttttatatgctgtaccatcaataattaagctcgtaaaactatactatatatgcctccgattcatttgatgttaataaaaagactgacagttgctagtttcctataacatgttctactctcacatcatttcagggaagctggaggtctggagcatatatatatagaagcagacaagagagccaacggtttgaatcaacgatgagattgagatatctcgcactgactgaactgcattccatgcaggtgacggcggatcaatccctaattagctgtggaatcagaaaatcgattgatatatagctcgagtttcagtcattatctttaaaaaaattatcaagtttcagtaatctatactcgagatatatctgtgctggactctatcgtcttgattattgaccgcacgatcatgatcaactggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagccgtcgcagcgcctgccgtgcctcggataccccattctaccggccgaacgcctccggcaagccattgtgttgcgctcgggcagcaaacaccacgagacttatggcgctcactatgtatctcgagataaaattcgatacctctagatactaagtatctcgagatacatctagatatcagtgtaaaattttctagttaaaatctaattcctatgtatactaagtatctcgagataagaaaaaggtgtaaaatttaggtgctaagatatcttctcaaggatcgtaaaatttcacttgttttagagatgtcggtacatgatgattacaagcatgcatgatgcatatcatattttactataaagttaatgctcaataactgctaaatcatttttttttgaaaaccgaagccagcttaagctggagttatattaaggaggagagaaagtatttacaatatcaccaagaaggtgaaagaaattagagggggcgaggaaaaaaaacctaaatagagctacacattgaacaaaaacctaagtggatattctcgcgatgtcttttgctccacacatgctccatagcttgatttcgtcttgtattttggcaagtagctgcagcattgttttttcttgacttcgaaacaccctcctgttatgttcacaccatatttcccatgccaccaacaagtggattgacttgagtgctttagccttgctttttccaacttgagatgttcttttaatccaccattccaaccgagcttcattttcatcatgtgggtggtctatgtcgtggcagtataggctacttagaaccctctcccagatctgacgcacgaaagtgcaatttttgaaaagatgttgggcggtttcaaggttcctatagcatagttggcagaagtagttgtttggccattgtctgacctgtagcctgtccgctgtccaaatcctattttgtaataggagccatgcaaaatgtttgcatttggaaggtgcccaatgcttccaaatcagttttgctgcagctgagcttattctgccattgaactgtgctatgtaggctgactttgcactgtactttccatttctcgtccatctccaagttatggtgtcctcaacaccttctgtaggaacaatgtcttccacacatggtagaacacctcaaagaattcattgacaagctcgactgtgaggctgtgcctgatgtctattatccattggtcatttgctaacccttcttggaccgttctacctttccttttggcatggttgtataaggccggggctaactccttcagtggttgttctccaatccaatttgattcccaaaagctcgctttccgaccatcacctatagtcaccttggttggagaagcaaaaagcttttttgtccatttcatcacaagtagggggtgtccctgcccaaggcttgttcgggctttcccaactgaaccatagccatcacactctcaatgctcgtgcaaatttctctaaatccaagactcctagtcccccaaatttggtgggtgaacataccgttggccaatttactttgcatttgcccccactaatctcttggtcgcctgcccaaaggaacctcttcctaattttgtccatgtcatgtaggaaatttttggggggttttagtgctgtgaggaagtatgttggtatagaggttagtaccgaagtgacaggggtcttccttcctgcctgttgcaacaacttccctttccaacctgcaagtcgggatccgagcttgtccatgactggttggaggtgcactctcttgattcttcccattgtcaaaggtaaatctcagcatccaagtgtgtcacctcatcatccactttaagttttattatttattgctttggtcaggtgtgatgtaatatgcattagtacatttgcttgtacattcttctttattgcattatattgtttggtacaacaatgtgtgcatttatgtcatttcgtaaaattcagcagattatgtatggaaggggacaaataatataatgtactcgcacatggaaatcatccagctggtacatgaagagaacaaacaaaatggagacacaaaaagtgagatattggttaagccattgttggatgcacttaatacaggcaaatagagtatgcatacattaagaatgtctttgccatttctgagtgcataattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacggaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgatagattcgtcttcatttcactttttatgaaccttcaaacctttgttagctgatcatcaaattcatcaatatatgtatgatgatggggaatcttcccctgttcctctaaaaaaaaatcttgtttgacggagattctgtgggattccactaaactttacatgggttcagtagtgactgcggacgatctttggagcttgcatgcctgcaagtcgactctagtcccggacttctgttgcggcagctgcagtttcaattttctagtaggtctaatccaatgatgcatactgttttctgttaaatttcttgctgtttaacaactcaatcgattccgtactcttctttttactgctccttttcttactctatatttctatatgactactagcgaagtagcaatggtctgaattacagtttttactgacctactgttgttcggcaggcaggaccgagggcatgggttccaaagatgcattcttttgcaccttctgctccttgcttcttttttgtttcagttccaaatgcctatcttcagagctggacctgcctcagacagcactagtagaggttgatgcttcatgggaggtttcacgaaagatccctgacacactatttggattattttttgaggtcagattttgcctatttagctctgtcagttcatcttatcgcgtcactttctctgccggcatcaaaatatgttaggatgagatcaataatttagtcaaccttacctaactgctgcagctagtcttttcagttgaatttaccattgttcacactacactgcactgtattaactatggtggttcttcatatatcttcatgcaaatcttctttctggtttcagaaaataactcctatgttgtacatgttttctcattccactgtttccttttccaccactattttgtgtggatgccggtgttataattttgtctgcattacttctagtcagggaaagaggagggattggggtgtgtgtgcgcgcgaagatttcttttgttagcgcttgctttatattcattatgtgttcactgcaatctgaatattctagattatgctcgtcagtcatgataactagatcagtgaacattataggaaattaaccatgctggagctggtgggatatgggcggagcttgtcagtaacagaagtaactctcagtttgataaacattcctcatggaagctgtgagaagtgaatggatgcacttgactaagttgaagatttgttatttacacaaaaatagataaatcagtccaaatatcaagcagtgaatcagtttcttgcactgcgcacatgtcaaaaagacacattgcaggttttgctgtataagaaatattcttatgttcacatacatccaatagtcaatgaaggaaattaaagtgtaaagtgacatttttgtgcaagtgatacacaatgctattttacaagaacaatatagaactccttgtcaacattcgcaactgcagccctttgcaatgctcaagtttattcatgagaaaaaaaatcaacccttgtcaaatgcatttactatatttatcctcattcatattaataactgacatcaggttgcttaatttctattccatattttggcttctaagttgctacagaacagaaaagattacagttctgaattaaaaccaaatgaaacaaaagcatctgtgttttataatttgtcatcaacattgaagtcttgctttaactgactaatgcatggattatactccaggatttgaatctggagggccccacaccccttctaacatcgatccatggtctatcattggagatgaatcctctatatacatcacaactgatcgctcatcttgtttcagcaaaaatagtgtcgctctaaggatggagattctctgtgagaattgtccagctggcggtgttggcatttacaacccaggattctggggcatggtatgagtccttatcgatgtaaaataactcattgtccaaataatcttttttctaaacaacagttactgtacaatgctgtcacttaaaggaaatacagcaaagttgtgatcttttttccaaaaagttaaactaatagctaacgttacctatattttgcttgatttcattttatgctcatttttctgacataatgttgtctttctatgcaatagttctgttttttttacttggaaatatgaatatctgttatagtttttcttccgaccatttctacttttatcttctgatatatatatatatatatatatatatttatttatttatttatttgcttgggattttaccatctgatttttggatgaacctgttcgttccaacttccagaacatagaagaaggaaagacctataatctagtcatgtatatcagatcattagaatctgtggagttgacagcttctctcacatgttcagatggaatgcaaaatctggcatcagtctctatacagtatgtatctttgacataacactgaaataaataattcttgatgtgtttttcttttatgattgaaaggattgcatattgaaatgttgcagagagattgatccgtcaaattggacaaagatagagatgcaattattggctcaaggaacatgcagaacttcaagacttgaattaacaagtatgaaaaggggagtaatttggtttgatcaagtgtcactcatgccatcagacacatacaaggttcactgcattttcatcctgctattggctactgacagtcatgagcatgctttgctatgggagtagccagtgaatattcatccactgctttgtgatgcaactaatgtactagcagaattataagttattcataaatgcgtaggaaacatgttgattcaatctcattgttaattagtgatacttaataaatctacttatattcattttcacaaaactttggaaaaaaaaagtcctcatttgtttattgctagaccatgcttattagtttccgcatttgttaacgggaaatttcttatatatgtacagggccatggttttcgtaaggagctaatatacatgcttttggaattaaggccacagtttctacgctttcctggtatttcttatgttcccaaaaatcatattttaactagaattagaccaaaatgaacatttagataactaaaactaaacctgaacatgcatacaatcataagaattttatgatttttgccgggtaatatgaattaatagtgataatatattgtatttactgtgtgattctattttgtggttatgcatgctttgcaagaggacttctaaaccaattctgggatactaacaagcataaataattaagaaataatactctagagtaaagcatcaaaaagttgtggtcaattagtacgaaaccagcatgattgtagatttatctatatttgcattatatatggttccatgatttcagcaactaacttttgaacaattctacacatatattgagtcaaaattttgtatcacaattatgacagggggggtgctttgttgaaggtgattggttaagaaatgctttcaggtggagagaaactattggtccatgggaacagagacctgggcactttggagatgtttagaattattggaccgatgatggcctaggatattatgagtttctccaggtatatgttgattaatgcaatctgagttttttttatctcttctgctaccaacatatctaaccaaatatttctaccgaaattttcatggaaagcttgctgaagacctgggtgctgcccctatttgggtgttcaatgttggtaatacattctaattatttaaaattttcctgttttaccatatcttttctcatcgctagcatgcccattaccagcttacaattttaccttgaaatttagggatcagccaccatgatgaagttgataccatcataattgaaccttttgttaaggtacgttaaatgccaaaagtaagaatagtcatccaaatagaactgggtagaggattactccggtttgacttttccttattgcagatgccatcgtagcaaaacaaaatgttttctatgcatttgtcattctttaagttcattattttttttctatttataggatgtattggatagtcttgaatttgcaaggggaagcgcagaatcaacatggggctctgttagatctgcaatggggcatcccgaacggttcccactgaagtatgttgctattggaaatgaagattgtgggaaggaattttaccgaggtatatttttattaatcagaatttgacatactactgatcccatttgttgtcaatgccatagttgttttccttaggttggtacatctataggctgaaatggtgtgatggccaagtgtacttaacacaaaatccctcatcatatatgaatgcatatctaaaaccacttattttccttcttctttaccccttgtttttctttgtttgtatgccgtcgttactttgtggagtcaactacaattatggcaaaacaatttcatccttacagataagcataat

SEQ ID NO: 25154 - DNA, 7135 bp, Oryza sativa
ggttttgaatcctatcttacaggaaattacctcaagttttatgatgctatacgcaaggcctatccagacattcaaatgatttcaaactgtgatggatcatctaggccgcttgaccatcctgctgatttgtacgattttcatgtaatcttcattccattttcactgtttaaatactgtctcattacttctaacagacttttcattgtgcttttattaagatgcactctgacatattttttcaggtatatacccgtgctgctaatctttttatcatgaagaataagtttgacaggacatcacgcattgggcctaaggtatttttcagtccttgtttggatggtcagggatccgtggccatcacggcccatccaaaatatggactttgtttttgtgatttattctggcaatagatatatcctcgaaatactcctatatgggttggtctttaattgacctatcatcctaactttggtggaatatttttaggacattattttttttccatgttattctacctgaggctggccactggcatgtttatttattaaatttcttcagaaattatattgaagtcataatattatatgtgtaacttccattaatgatagtgttctagtgtcacaacacttcagccggctttgtttctctgtatcattacagttctcttgcatcccgacgccctaggatattggatacacagaaagtacttattaattactatgctatgatcctgttccaggtatttgtcagtgagtacgctgtcaatgaacaaagggatgctggtaaaggaagccttcttgcttcactggctgaggctgctttccttactgggttggagaaaaataggtgatctctctcacttcttcctttctttggataatctctcattccatattcttgggactaactgaatcgtgcatgcagctgtatttagatcattcatgacttttccaggataaatttcagtattgtcttggataattagtagtttatgaccctattcagataatcacatttggaacaaagggaaaatgtctgttgttcagaaattacaagataatgaataatacacgtattgtaaatattaatagtgagcagcaagaatactctatcatgaataaattaaaagtgtatgtcctgtttatctgcagtgatgttgttcagatggcaagttatgcaccactcttcgtaaatgacaatgacagcacgttagtacctccagctttgctcctttttatttccaacgttcttgttggtcacaagtacgcgagtttgactagaccttaatgtaatgatcagctggaacccagatgcaattgtgttcaattcctggcagcagtatggcactcctagttattgggtgcagacatatttccgtgaatcaagtggttctgtgattcatccgattacgatcagttccagatattctgattcattggctgcttctgcaatcacctggcaagactctgaggatatctttctgagagtaaaggtaaactaaccattccagtttctcctaatttgcatacccttgcagcaattcattacacaagcacctaaatgttttgaatgatttagttacaacgatataaaactgattcaactactgcatacttggataacatctctttggattttagaacatatgttgatcttcaaaagatcttctgcagatagtaaactttgggccaaatgctgtgaacctcacaatatcttcaagaggacttcaagatggcgtcaacactgcaaaatcaactgtgactgttctcacatccggcaactttctggatgaaaattcatttagtgaaccaaacaaggcaagacaaccattgtttccatcacaagtttcttgtttcataaccatgcactgaatttagcagagggcaaccttaccattacaaatttacagtctgccaatatatatgcaagccgtatgacttatttaatcaagtagtgtatgttatacataaggcataaacttttgtagtcttatagatgtcctctcctctgtctttttttttcaccgagccctctcctctgtctttcagttttatctgtaagttttccaggaaatagtttatttggttatgtctcaatgtctggaatcatttcctacaagtatttctagaagttgcacctttttttgatagagttgccaaaatttagtttggagagtctgttagagatgctctaacacgcaatattctcaggtgttggcgagttcatctaacatacaagtatctttgtgaatgacgcatgcaggtcgtgccggttgaaagcgagctgccaaatgctgcagaggtgatggaagcagtgctccctcctttttcattcacttcgtttgacctcgctctggatcaatacagcaagctcgtagcagagatgtgaagcaatgatgcatagtttcaacagagaaacaggatgtttacatgagatgtgatgcctgaatttcagaaacacttggtgtgatcctgctgtttatgacgctgcaagcatagtttaaggtttgtcacgttattgaacctaggggtaacgctaattaatatccttgtcaataagctatccccttgatcactgaactctggttactcagagcttgaatggattctcagttaatctggataagcaaacagaagggaaaatgtagggttgatgagaaatggtcctgcatgtttaccttgtgttcccccaagtgataagattgacatttaataatgcagcagaacatatctgtgatatctcaaacgtaagtcaataaaaactgatcaagcctttcagtgaaggtttcttaccatgcgatagtgcagtaaattaatgacaacggtaatcatgcactaaatggacacatggtaagagtaagccaatggtgtctttgcttagggaactgcataaacacaagcgtagccaatacatttccccatccaaataagtatagtacatacattttgtaatgctaccaaatacatttcagttttttttcctacttgtctccattcaatagcatcgcttccatagggcagaaatttacatacaagaggataacaatcatagtagcattttttttaatataattcaatagtatgccaatcatctcttgacccagcgagctttccttactggacgaaaaaaggaaattcaattaagaaacatcgctgatatcgtgccaccaaagtaaatgactttcaggcagccaaagagatttacctcctcttagggagtcaatgaggacgaagtatgaggggatatgtacaacaccagccactgctccagcactgcatgaacagttgaataacaatgtgagcaaccataattatcatttaactaataggctcaaaacttttgatgatctcataccacagaaagcaatggtccttgcttaaatttgctatggaaggcaaatgcaagtggctttgctccatctccaggtcctcttatgaatccactgtatatgcacattggaaattcgtcagacaatggtccaaaattatcaagattcaatgttcatgaccaagataacatggtaaattagaggactgcacttacactagtgaaactgagacaagtggagatctcctcacatcatagacagcaacaaggccatgatacatttcattaccatctttgaatgataatgccaagcgctctcctgaagaatcccatgctaatttatctatgcctcggctagatgaaccagagaaagctagcataaataagtatatggactggacaacaagttacttttctaggctgtaatggatgaaatgatagacttttgaacatgtaaaggttcatcctaaatgaaagcatctgagtatatactaaaatggcaagagacagactttttacaagccagatctaaagatattttgaaaaaaaaaatggttgaggcgcttcaattgattagggagaacttgcctttacttgctaatgatcctaagttacataccataagtgatttatttaaaaccatacaatccatatcatgaatgacttcccaaccagatgcagatgtggttattcaaaatatcatcagttaaagttagcattgaagacagcagtaaaatatgttccatcgggtccacaagaagttaggagtatagaatggtaggtactgccactgttgttacctgacaatcagagaggaaatttcaggtagttcgactggtaggagatgggcatctgaagtcaatgaacacaacacaatgttcaggattcagacaataaacataatactgtaacttcacataaaaatgctgtggtgagatgagggtagctgtccatacctaaagatggtggctttgatgagaagtgaattgagcccagtgttgttgagttagaaaaggataataatgcagtacggccttctgggtcccaatttgctccctggtatgaaagcaagattaaaaaaaaaaagcatcataactccaaaattaatcacaacacccatatttcattcaaaatactgctttaaggggggggggggaatgtatatattacaagtgaatgagaaatgtttgctgtaaaactgatcttatgtgatatacttgggaaggttcaaattaagttgagctttatgtaatatttacaatttataaagtcaactgaaccaaaaatcaacttttgaacaagcaattgatcttgttggcaaacaaaagtatagctgttgaaatgacaatacattaacaagtaaaaaggtactgcaaggtagtcataaatacaaaataaacccaagttcagaagcttgatacaggcatgtttaaaatgtatatatcttaaaacaactggttatataagttaatatgttgtatcaatcttcagaatcatgctaaacacacttgttttcaagataaatacatgtacaaaatcagaaagaaagttacatatacaattttgaaatgggtctgagataacaattcttgagttaaaactggacccaataacccataacatgcaaagcatttgccctttcatttcatgacttaattaagaatccattccttgcaacatggtaaacaataatgttgaatgttaaacaatacttatttaaagagtgaagatactactacttacagacacatatccattagatgaagaccatggttctgacgtccatgtatttgtttcccataagtgaaaagttccatcactaattaaaaaaggaaaactatataaatcttcaaaaggtatgagcaatgaaaataactaaagttgaagttcatacagcttagcagttaaaaggtaatctccactaggtgaccaccgcactaatgatatactacttaatccacgtcttataggcgttcccaaccctgaagcagaagaaaatctaaagatattagcatgcagttctgtgtaagatggaattgggtatctgcattctgatgacatttagataccttgagaaacatcccaaattgtgaatgatgggctattacaagaggcagataccaagtatgtggagatatatgtcaaggaatattgtctagagtcactgatattttttctgtttgcaagtgaagacatattatttgttttaggttacattttttttatttttcaaataaaagagatgaatgatacttatgattaaatgctatactgaaaacttataaaggatatcttccatcaggtttccaacaaagtgcgctaactagctcagcagaagaaccacggagaatgtccacgagtatccattgaccaccggaacctctagaaaggcaccaaaagaagaagaggtgacaccagatttcacagatgcaacattgccaggatatgatgctgaccagaggcatatccctcccctgaaaataataataataaaagttaatctaatagtagattgtgccactaggtattatgacatgaaaagaatatcaaaacaaatctttaatagtgctctagtatatggcggcagtaggacatacttgcacccaactgcaatcacctttccactatttggcctccattcaacagctttaacatccttttgatggtcacttgttagaatgtaggattctttattatctgttcagagaatacaaatgattagttgttggcttcagctgagttgagaaacatacttcagttcattaaatacaagaataaatgttcatatagccatcatgcttcagttcatcatatctatcttattaatacaacataagaaagttcagcagatctcacctggctcctcaaagtcatgaactgtaacttggttcttcccagatacaaatgccaagcaatgcttgtgaggattccaacttactttctgggtatcaatttcttgtagcagatttggctgcgaaaacaaaagatttgtcgtaagtactaaagtacagttgttaaaaaaaatctatcctgagcactttgcacacaaaaataagcttgtgtgtagattttgggtgaacaacgagaatggggcaatatatgacagaaaagcagtaaaatcatgaatgcaagcaattgattcactaagatatgatgaagaaccaaactcacattgcacgaagggaagagcatttgtttgaaggactcagctatggtggaagctaaacttgttctggggacaacttcagcaggctcagcagcttcagtgacagcaggaggctcgtgggtggcaacagtcgcatccggctggaaaggaatcgggctgaagaccattccctggaagccccaaattgaagtttcaattagaggcctaataaaattagtgttgtgaaaaagaaaaagaaattattgcgagggggaggagagtgtactgacgaggacatccccgtaggcatccttggctcgatcatcggacagcgcatccgccacaactgcaacgcacagatttggacagccgattgagagaaaacaaggaggagaggagatcggggtggagaaagcaaggaggtggagggataccataccgaggtcacggttgatctcgcagacggtgacgccgccgggcggagggaagctcggcatggccacgccgcgcgcgggcggagaggttttgttcgcacctggacctggggaggagcttgtcggcgaggctgtggccggcgtggagcttgacggcgacgccaacgagaggggaggtgttggtttcctcattaaaccctcgccatccgcacgggaggagaagaacgga

SEQ ID NO: 25155 - DNA, 867 bp, Oryza sativa
cccccccccccccccgaggccccaaccaccaacctcaaccacaacaagagtgaagagaggcttccgcttcctcttcctcttcttcttcctttgccggctccccgtcgaccctcgccgccctcgcgctcgtccgcacaagctgcaactgcaaccccagcatccaccctcatccggacctacccaatctcctagacgacatcaccgtttcagcttccccggcgagcatccaccattccaccacctgctgtactcctcagcttcgtccttgtgagaataagctgttcgataaaatgtctactaaggttcaccagcttgtcttgctgtgtttcactgcctgttaccattatgctgcgtgcaggataccacggattaaccttatataatcaattgtagcaaattgcgtacatgttctgatcaacttccttttcgcagtttctcgctacatttttacttcttttttttttacagctcggccttatactttactccacacttccacagtgagtggcatcgctacttttcaaaagctcttggaaggaaagaaaacaggctcctaggtctggttgcacacataatagtatgtatgattcacgcatgctgtttctgtagatagctgtcattggattaagtcaaactgttttgtgatccaacaatgagtctttcatgaattatgaaattggcaaagctcctgattttttttatcaaaataacctaacaatgagttcttttttttaatactattacaaataaaaatgcattgacttcctttccctttttttcgagaatacgcatcgtatctttgtattaaggagagggtaaggctacaacttgccaatttacaggaatgccagaacattaaaaaagcga

SEQ ID NO: 25156 - DNA, 6464 bp, Oryza sativa
gtattagctttgcgacccttcaaacagccgtgggctattgaattagcttggcttctcgccagagagttgccaccttgggccaagaacacgtttcttggttaaagactcggcggttgtgctctttctagatggaccaagccatcaaggtgacaattatatcaaagccattgcatagctatttgctgacccttttccggttgtggtaccactagctaacgaaggagttttgtatggtcggaagaatttcgggccatccgatggcattgagaactatccactagagttggcgagatttaggacaggacacaaggatgtggtccattgtctcctcgcattggtcgcaaaggacacatttggcagggcgtggcagccctcatttgtacaagtggtcggctgtccagcaagcgcggtgggtgatgagccaggtgaagtacctgcaatggtgtggcgcattgctcttccaaactagagattctgggaagctttcacgaccaaggaagagcagtgagtaggcagacttggtggaatattgccctgagatcttccacttccagacgaagttgtcagcttgcctaggtagtagggtggtcaaggagatacgctaccagatcctaaggtattgcagcactgcttcaactcctaaagtccccctgatgtcgctaatccatcgccgatcagtgattgcctccgccactattcgtttgcggctcacgcgcgccaagacaagggaatgcagggctagcgccaggctctttaggttagccccttcagccatcgatcctcccagaaaaggatgcaggtcattatcgtagacacgaagtcgcattcttgattagagatcggcattggtagccctttccagggcttgcttgcattggttcgcagtgcccaaagccaccgagcatgaagggccagacccattagattgaggtcatggattccaagaccatcgtagttttgggcacacatacattgctctaggcgaggcggcagtggccacccttggctttggctgttccagtccagaggaaaccccaccttatcttattgatccccttgataacccatttgggaggggacatggcgatcaagaggtggattggatggatcttaacactgaattgataagtgccaggctgccaactgcctggccggggcaagctaaccagctttctatgacgggagcctaccggcgaccgagtcaagcatcagttggagctcggccttgttcagcttgccggtggagagcagtaggcctaggtacttgcacgagaaatgcgtgattaggcaaggtagcttgttctgcatgagctccatttcgctttccccgcaccgaattggaatggccgaacacttgctatagttcgtcctcaaccccacgactgaagcaggttgaagaaggtcaaggtgctaagccttgacgaacatggaatttagcatttccattacgatgacgaacaacatcggtgataggggatccccttggcgcacgcccctgccgtgctagattgtccttcccggcgtgccgtttagtaataccttgtactactagtgctaaagaggatggatagccagacttgccaccgtttaccgaagccactatggagaagtatctcgaggatgaattgccaggagaccgagtcgaatgcttacgccaggtcgagtttgagaaggattgctggggagagaccggcatgcaacttccttgccggctggtgtacaagcacgaaattatcgtggatgcaacgatacttgatgaaggcactttggttgtcggcgaccagcaaattaagtttgggcactaattgctttgataggattatcgtgaataacatcgcaaagctgtggcaaaggcttatgggccagtagtccttcaagccacttgcgtccgcacgcttcggagcaaagttatgagggccttgtttactttgtcaaatcttgatccgtccagatgaaagagttggttgagggctacaaggatattttctttaatgaccgaccaacaagatttgtagaacaagccggtgaagccatccgtccttgacgcgcaatcattaggggtgtccttgattgcattccggactttgtcctcagtgaagcacacctcgaggttgtgcatgacaggtcggctagggctaaagaagggtaagctgagtgtgtgcttccttgaagttgaaggggtggagcctagcactccggcgtagtactcgtgtaccattcgctctttatttgcgtgcgagatggcgaccatcctattgttagccagctgctggatgaaattctttcatcgcctatagggtgcttgttggtggaagaagtgggcgtttgcatccccctctttgagccaggtgacgcgtgagcattgtcgagccatcgttctttctagggacacaagggcaagcacccacttcttcaacgcatggtggagcacacactcctgttggctaagcgggcgatgctcctcggcagcgtcaaatatgtcaattatctcccttgtcatggccagttgcagcttgacgttcccgaccttcttgttagaccaactgcgcagcgcctttgctaggcatcacatctttgcgtccaatcggtgaatggggtctttgaatgggcaagggaagtaccaggaatcctggactgttacgaggaacccatcccgcttcacccagaagctctcaaagagagcgagcagagcgtcaagaagaagacgaggtgtttaggaggagtaggtagtggtcagacatgtccatcgagagaaccttgaggaatcaagaaggcagggttgtccagttgtcggtcacgaagatgcgatctatacgctctagggtcgttctgtcccagccgttgaaccaagtgaaggccttgcatttgaggtgcacctcttgaactgaaggtcacaaatgacccggcgaaagcgcctcatcatgcgacggtgcatgtttccgttgttcttgtcttggtcctagtagatgagattgaaatcccctaccaccaaccaagttcggagaaggaagtctggatttctcggagttcttgaagaaaacgaactttgtcggagtcgccctgcggcccatagacagaagtgaaccaattgatcgttccgtctatgaactctagccgcattgtgattgataactcgttagtgcggtggctgaaacaactagccacactcggatcctaggcaaggaggatccactccccctccccgcatttgagtagccgcgagatagatgaaactagatagattagggcctaaaatttgagaggccgacataagggagattacattcagtcttgtttcttggagaccgaccaccaagcgcactacgtcccggcgtgctcctgcgttcaaccctctcacattccagactagtatgttgtagtttgggctagtcattgggaataggacaggggggttcgaccggggctagcgcattaagcctccaccgcgatcggcgacccctgcactggtggcgcctggatgaggtccatgccgaataggtccgccaacgcttgaatgtgttcagtggttagaggctcggagaagaattctttgtacgccttggcgtcttgctcggagggcttggagtcggggatgactttttttttctcgaacacgagtcagggatgactgggacttccgttcctaacttcttggcgaggactgattgcgccttggtcaacgtttctcatttccactcctctcaaacattctcttagggcttgttcgtttaatcatcaatagagaaggattggtggggattgaaggggagtaattccacaccacaataaatatggaataaatcacctttaaatcctcttcaatccctctatgagagggattgccttaaacttacaaggtcaactttaggataagtggttgtttagacgatgcacacatggcctattttttgtgccaaaacttgccacaaacaacttaggtatggtttggtaagaattagtctatgacatagtaccataagtgtatcatgtcaacactcaacagttatgatagtgaataagacactcatcacctactactataatttaagaaaatcgttaaacgagtaatcgttatttcctcatattttctctttccgccttccagttcctggatccaggtgaccaggtcggacagctgcggtcaacgcaaacaacgagtaaacgcaaggctgcaagcagaaagggtcaacgcgaacaacgagtaaacgcaaggctgcaagaagaaaggcgcaaggtacgagccgtgccgcgagcagcggtgcgcgctagacggagcagtgcagccacggtagacgtgcaggcggcatcgacaaagggcggtcatcggtgctgatcaaggagtagcagcaggacctccaggtagccgcgaccgtcgaaagcatcagcagatcccaaaatcagtatgtgcccttcaatctatcctcagctcagctttctcgatgtggattcgtcctccaaattcttctcttgcccttagcaaaattgtccattttatgtgtaatgaatctgtgctaagatctatggattcattctccaattctctgtgctatttcattctttgtccatgtcttcacggtgaataatcggtgaaaagggggctcgagtatgtcacagcgaatctcgggaacttcgtcccgaaacgaggcttgacaatgtaccgatcgcaggcggatcttgtctggtataaggcggacgagcgcctctattgctccctcactgcgccgccgccgtcgtcgtgtgaggaggatggatgagcgctggcgttttcccgccgagtgggatggacgagcgccgagccgcttgcgggcctccctcgctcgctttgggctggtggtggtctggctttgggctttaccgctttagttattgggcccagaaaatattactcgctagttagaaagctactactaatagtttggcacgttattttaagaacctgaatcgagaaaatagagaagtgaagacctcctatgcatctgcatcgcaattgatccacgatcgatcatcgttccggatcatcgtcccgaaattattttaaaatttgttgttgtcctatgtcgctaactagtgttttaaagagccatcttttggaagatggagcctcagaccgaggttgtgctgtaggttctcagtgatgggccagggctatagttaggaggggtgaaattggaacacataccaagatggatacggatacaagcaatacggagtatgggttacggatatttattggaattcaagtcaaagcaacaaccgtacatatcaaatttataatagacattaaaccactctatgtattcaaaattgaaaaggcaactagattaatgcatattaaaaattaatagtagcaactctagcatgactgatttactgcatttacatcattagtagttttaccactagtattttaatcttgcagggagttttgcactagtagtatagtttactctcatcaaactagccgtacctatgagtttacaagtatagtcaacccaaaatgtgcatccatgcatactattcacggcttcacgaattatgcaaatacgtgactgcgtgtgcgttaataccaaggtacccaatagagtttgcaggcgagcacacgtctctcgtttgtttgctcatgtttctttgggttgtgtgcaatatttaatctgtaacttttgttttctttttttttatcaagagcctgacggctcccatttcttttactagaaatgaaacatcgagctacaatagtcttcagaaaaaaaaacaggaaagttcaaaagctagccctattacaagggttcctgactcttttcagaagttttgcctaaacagatatctaacagtaaaaaagaaggaaagggaattacaaaacatcatcacttatatctatctcatcccttgatccttttggtgttgattctccatccgaactgcgagttgtagacttcatttgccgactgtcttatgagtctggatcccagtagcagtcttcttcgacttgcctcctccttctgcagtagtgcccaggaatcaacccaatggcaagccaaaaagatcacatcagtggggtcttttggataaactttttcaaaacaagctttatttctagatttccagatggcccaaattatagcagccattcctaccataactaagtctttcatgttcttatcaagttttttcaaccaatctccaaacatgttttgactatcaagggctgggttcagattcaggacacaaattgcagtgttccacattaatcttgccaggggacagtcaaaaaacaagtgttgcatagtctcctctctatcacagaactgacattttttatccccttttctccaacctctcttgtataaattgtcttttgttaagatcttatttttggtgaagagccaaaaaaaaccttaatcttcaaaggagttctgaacttccaaatttttttctgtgggaaatgcacttgttgtagcttcaaa

SEQ ID NO: 25157 - DNA, 5472 bp, Oryza sativa
tttcagtttgccacagtttatatgttttgtcaaagtgatattgtaaaggttggggaattgttcatttaaaggtttgccccctatccagctgtcctcccagaaaagtgtcttttcaccattgcctatcaccctggagcagaatttcagaaagatgtttttgatctccatgagcccatgccagaaatgggactctccatttttaaatttcaataaagatatgggtttgcaacccatgtatttacttgtcaaaaagctttgccaccaaccttcctcattttccaatctccagatccatttccctaacaacgctttgttcattgtttccaaatccaggatccccaggcccccttgatctttgggtgaacataccaccggccattgtaccagatgatattttcttatcccttgatcttcttgccacaaaaatctcctcctgtaaaaatccaatctctctctaactccttgtggcagtctgtagaaggatatcatgtaaaggggcacattgctaaggcttgaattgaataaaatcaatcttcctccaatagattgaagtttgccactttgccttgccagcatcccaatttgtgttccatttttgttctcagcgtttttccaattcatgtaacttttgttttcatgcttatgtatcattagcttatacatttttaatgtcatattattgtatggactgttttatgaataagtttattatatatatgtttaattgtagaagacaataaaaaataattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcatcaaggtagatatatgctataactttctattaattctttgtatcttttcaattttgatacatgttaactagtgccttttccataatgtctgttccacatgtattttcacgctttgatatgaatatttgagtacatagatttgaattatattataccatcttttcctccttagaaaacatagcatgttatggttaaaagtattgatgaaacttcctagctttccatttgaaccatgacaaactccccattccagagatgcgctttcaatgatttcagatggtcatgtatgttgttggattgcagtttattctttgtattgcagcatttcaaaaccgaattacatctgtgttcgctgcacgcagttgggaacctatctccagcgcacggaaaacggaacagtccattagcacgcggttaattaagtatttgctattttttttaaaaaatggatcaatatgattttttaagtaactttcgtatagaaatttttttgcaaaaaacacaccatttaatagtttaaaaagcgtgcgcgcggaacacaagggagatgagttaggaacccttcctaccgaactaagcacttctcaattttttgtatgaaattattttgatattccatacattgttgtatgtttcatgcatgcaggagaatccttgtttatcgtcttcaaaacattatgttggattctgttcagcggataggtccgctgggccatcatgtttcatttactctttcaggcctgacaatgaaaggctggagtcatatcattgctaggaaagctagttcaatatcctgagagacctggtgaaccattctgtcgatactacatgaagtttggggaatgtaaacatatgactttctgtaaatacaatcacccaaaagataggttcagttgcaagaccacaaacactatcagatcagaatccttatgcctgcatgaccaggtttgtgtggggtgagtttttcattatttattaggaacaacttcactgtgaaagagcatatagcttagtggctgcagtgacttaagtagcactccaaggtcttgagtttaaatctccacaggagcgagattaagttccctgtttgatggtatagaagcccttctctaaaaaaaatttagaagccggctaagtttctaaaaaaggcggcatatatccgttaaaaaggcatttaaatccagttggatgtagttccctgtttctgtttgatatgctaagttcctaattttaaaaaggcattcaagttcctaaaaaaggctgcatatatccatttaaaaggtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattcttactgaccgaaaatacccttctcagaaaaaaaaaggtttttcttactgaccgtgcaaaatccgattatagctgatattatgatgactcatgtgttataccttatgcagcagacaacaattttggaaaatcaatttgggttaccttcacttgttgataaggccacagctaacacaacaaatcttgtggcatctgcgtcatcttccatgacacccgatgaaataggagaggggaaaaacaatccagatgaggtaatgccattggcatccatcgcttgtttattttagaaatcctatgtaatgtgagtgctttgtgttatctgctgcttgcatagcttgattgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctccgggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaatttactttctgtattgtgcactacttcccatgaaacttatggaagatccgatctattcattacattttttataaaccatccgtgcttgttatcatgtggagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgtttgtttgccttagattttttagattataagcaggcgtaagcctataaataaaaaaaacttatgacatatacaatgataattaataacgattcctagtcttgctaattaggaatatttgatgatatggaaggaagagaagtgaggagaggccaacgtcgttgctacagttaataattgcttaggaacgacttttaacctctatagaatgaaaactttactgcatgtgggtgtgaacaaggaatgaatagtaataaaaaaagttttattaatactttagagcctttgtagtctccaccattataaagacatagtttttaaataaatatgcattatctaagagtttatatggactctacctttaaacatacccatactgttctattcttgcataggtttctttgcaggcagctgaggctgccgtttctcagaatctagagtttctgcttccaaccatcatgatgctaatgcctgtgtacagtggacctcatcattggaacaatgacttcatggagatgtaagggaaagtgatcatctatttttccttgtttatatattatcttgattcttgagtactagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtgtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcattttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggacaatttgtgcaagctttattgtattttaaccccccccctccgttttgtaaaaaa

SEQ ID NO: 25158 - DNA, 1701 bp, Oryza sativa
gttaacagcacgtaccattttgctgctatcttgctttctgaggtggaagaggacggtaggtacaacagcattaaagagaaggccacatcatatggatctggaataaaaactttccggacaatttgtgcaagctttattgtatttttaccccccccctccgttttgtaaaaaataaatctattacacaacgtaatactcccttcgtttcatattataagtcgttttaattctttccctagtcaaacttctttacatttgaataagtttataaaaaaatatagtagcatttttaacacaaaacaaacatatattatcaaaatatattaaatgctagatttagtgaaactaatttgatttttaaaatattgctaattttgtttaaaatattgctaatgttcttattatattttccatatctatttcacctgactaacaaacacacattgcgggagaagtgctctttagtccctgtttgtaacctctttagtcccgggttgcaaatgggatgcccaatccaggactaaagattcctggcccctgacaagaatataaccgggatagttggtcaccaatcgggactaaaaattataaagtcccattgtgctaatgtgatttttgaatgacccgacaaagatcacttctacagtagtgaaaaggattttctagtggaatcttgtttgaataatttgttaacatcgtggaaatattgctttgccctctctctaaatggaagtattgctttccagcaacgtatcccgtttgcataaactatgcgtacaattttgaaggtacctttttcataccaaaggtttcatggagtccttttagacgaatccttcgtgcccctttttggtttttttttcttatatccaaatcaagaataatacttgaatgcatgggaaccctaaggttgcaaaccgcccaattcctttgtatggctgtaccttttttttatatataattaatggtgcgattgtaagagttttgacccaatttcccttgtactataggtcaaccctcccttttcacagtgaattgcaaaaactcactatctcaaagtagggatggatactgagttggtttggctcggtctagttcgttaggtaacgaggccgacggctcgagctagctcatttagcttgtaagccaatacacccatgactatctttccttaaaagattagcatcaaagatacagtagctgccaggaacatcctgtgcaattgaaaaaagaaatcaagcaactggcaaataacaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtgcggagttgcttgctcgtgctcgttccttctccatgatgatgatgcagaggcggagtggcacttgttgcggagtgagacggcaggatgacacaacgacgagagctcgtg

SEQ ID NO: 25159 - DNA, 6473 bp, Oryza sativa
  unsure (1)..(6473): unsure at all n locations
acaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtggcggagttgcttgctcgtgctcgttccttctccatgatgatgatgcagaggcggagtggcacttgttgcggagtgagacggcaggatgacacaacgacgagagctcgtggcctcactcgccgctggtggtgatgggcatggagagaaaaagcgatgtaccatggactacgaagtggggggaatggatcgatctcttgggccttggctatcactggggagcagagctacagtcggtaggtggcggctagggttttctgatggggaggggatcgttctcgatcgattgagcgagaggagtgacgggaatgccgttttttttaacaaattgatccttttcaaaaacttattttaaaactagtccctacaaaaaacttcaaccaaaaataggccgtggactcagcgccatagacattggcgctaagttataacgtatcagcgccaacgacgttggcgctaaactctaatccgaggtggcatgaattcgctgagtcatcagatctcagcgtcaaggtatttggcgctgaggtccagacgatttaaatagctgcggcggcatttaaataagagtgagtagtcaagagaacagaaattattttgtaaaatacattaattctaaaagaatgctaggaggaagagaaaaggaaaaaaattgtaaagaataagagtgagtagtcaagagaacaaaaattattttgtaaaaattatttgtaaagaattgctagaaatgccgccgcagctatttaaatcgtctggacctcagcgccaaatacattggcgctgagatctgatgactcagcgaattcatgccacctcggattagagtttagcgccaacgacgttggcgctgatacgttatagcttagcgccaatgtccatggcgctgagtccacgacctatttttggttgaagttttttgcagggactagtttcaaaataagtttttaaaaaagaccaatttgtaaaaaaaaggggacgggaatgactatcggggacagctaactagggtcaggggatcgatcaattgagttgggtctttcccagatgagtttgggccgccaagctgctgcaatgtggcatgctaaggttgcagcttataaagctcgtgactcgctaacaagctatcagttcggctcgttagaaaaacacaacaagtcgagttgagtcaagctggtcaccagccatgagttttttcgtccagccctacctttgaggtgcttgaaaaaagcatggcctagtgggggtatccaagtttatttactgctatctcctttcagaaggaaacaaattattcttaccattctaccgagactcttctgccattgtatcgagggctgttcccaatattttggcggcctaggatcggacgaggtaaaattagaggcccttggttccaacaaaatgtaggataatatttattttattagttgcaaatatcttcaatatataaatgatacatcccatatatataatacgatatcaatctaatccttcattaggttgctctagacaaacaatatccaactagacaaaaatgaaattatcaagtagggaataggaaaaatgaatctaggagcaagaggaaacttttaaaaagctcagtcgtcgtacatcgagtgatccgagaagtggtcaactgaaaaatagatttgaggaactggtgcgaattaaaggtataatttagtaattagtagtagatcctttttaaaattttaatataaaaatatgttaatctagttaatgacatgattttataaaactttaaaataataatacttgaagtcatatataccaccttctaaaattcgtatggttttgtatcatttatatatcgtataatagagaatcataagaaatgtggttttataatataggccttgtttagttccaaactttttattcaaacttccaactttccatcacatcacatcacatccaaaaacttttctacacacataaactttcaactttccctaaacttccaaacttttccaccaactaaacacacccatatttacttaaaataattgcttacacccaaatttagtacctaggatcgaaataggaaaaattgccaaagtttggggctctgccgatttcctccagagagggccggtctgaccgctatatgtgggccggtcagaccgacaccagagggccggtcagaccggcgggagttcgagtcagacgccgtttttgtcgggtctcgggtttccttgctcgggaaggcatgtttcaggattccattggtttctagctcgagttggacgtggaggagggcctgtagagggcaagatcaacccctatttaagagacaaggccggttcaattgtaacccccgaacacataatatacttgaatcgctttttcttttatctttacttttagccatgttttttactttaccctagtttcagtctatctttgtcgatgtacgccgtaaatcatccgccgccgctgtgagagtgcgacacctctttgtaggtttgtcatgaaaaccttctgtttgcccacgagacaagtagttatcctcatatcgatctaaatcggcctagaggctgattttgatctctagatcagctctgttagccggtttagctctttttctataaaacccatcttgatttggccgtttggctagatcgaggtgattggcgactccatatcatcacaaggcgtttaggtactgcgatcgtgcttgtcgacttgttaaaaaagttgccaacacaatttttgacgactctgctggggaatcgatctattcgaccatattatgaccgaatttggtttaatttagttgtcttgagagtttcggccgaacggccgaaatcaatccatatgctgttagtctgaccgtctgtattactccggtctaaccgacgtaatcagtacggtctgacctcttgtacgacgccggtctaacctacttggtcggtccggtctgaccggagtagttgccgatctaaacggcagaaagctgcagcagttgtgcatcgggacagcaacaagcggccggcatcatcttgctgtacacggtctgaaaatcagaaatccaatcctattcagtttgctgtctatacgtgttctaaaaacaaaatcaggctattagagccgatttacctagaatagacaaaaccaaatcggtttctgttattgtgcattaggcaactgtcaccgagaaaaaaaatcatcaaagccattgcagcgcattggctgttattgtggaacatcaatttccaaaatttttgctagaaccacacaaaatttctgctattgttgtacacggaagatccgccgaccaaggctgctgatcttttggttttcggaatttgttacgtgcacacatcaagtatgacaaggaaatcaagaccatatattaatctattcggtcatcgatttcggctatgagttatatggccgaaattaatcaaggagtttcttcgtcaaccataacgagcggaaacgagatcaacaaactcactaaggaggatttgaacgaggagtagcggcagtactttgaagaacaaatggcagtgttgaaggaggaatatcttgcataatacattaggaccgatcaaggtattctcaaaagaaacgtcccgctacctcaagtcatagtttcactaaaggtaacctccgattcgcccaacccatccgttgctattcaaaaagttaatgatcgttgtctagatgcatctgctacttctgttttgcttctatacaatatgcttataatgctatggaaggatcaatgggtgtttatacagccaattgcacaggaatcggctatatgcaaaatcgagctgacggtatgaccggtcgtgacaccggtcagaccgtgcccaccatggccggtcagaccgtgcccaccatggccggtcagaccgtgtattataccggtcagaccgtgccaaccatagccggtcagaccgtgccaaccatagccggtcagaccgtgcctatcctggctagatcgggcctcttttggccggtctgaccgcaccattgaccaccggtcagatcgggccataggccggtcagaccggatgcttggccggtcagaccgggctatttatagccggtcagaccggttccttggaaatttctctaggttttcataccacgactagcagtactgattttaactattattcatcacctgttaatactggtagtcatgctacttcacatatccctaatacttacaatgatcctaatagaggatatcttcatgacaccgggtatggccaatataatcatattgcgccgcaacaaccacctcttaggccactaaacccaccaccaaatccaccaaggcctgagactatggaggagttgattagtgtcattattagggataaatttggaattgaagcaaggaatcgtgctagggtttaccaaaagccgtatcctgattattatgacaatatcccatatcctcgtggttatagagttcccgaatttaccaggtttagtggtgaggatagtaggaccacataggagcatgtaggtcaatttttagcgcaatgtggtgaggctagtagttcggatacatataaattgcgcttattttctttacctttgtccggtactgcttttacatggtttacttctttaccggcaaattctattcatacttgggctcaattagaacaaagattccatgattatttctacactggtgaaactgagcttacagtgtctgaattaacatgggtaggcagaaacatgatgaatctgtcactgattatattgagaggtttagagatgctagaaaccgatgttttagtttgaatataactgacaaggatttggccgacattgcatataatggattgcttgattctattaaagagagattgaatggccagatatttcttgatgttgatcatgtgttgcatgaagctctggctcaagaaagccgagtggatgacaatagcttaaatgctagtttggatgataatgcaataaccaatatagccgaaccaagtgttggatcggattgtgttactagtttaagcaatgatggaatagccgaatcaagtgatggtttggattgtgctagtagtttagacaatgacaccgttgaaaatatagccgaactaagtgacggttcaaattgtattacaagagaaagtgaaatagtattgtcacctaaaaccgagtcacaaatcgatcatgtgaatgttggaaaagatagtgacaatgtcttgcgggatggtaatgaaatagaatccaaaatagctatgtatacatatcaaaggccatatcctgaacacatagattcggtcccatacccgcaaggatttgatgtgcccaacttcacaaaattcacaggtgaggatgctagaacaacaatggagcatatcggccattttgttgatcaatgtggtaaggctggtagtgctgatttgcttaagttaaaattctttcctctttctttgtcaaactttgcatctacatgggttagtttacttgctcctaattcaatttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttgnnnnnnnnnnnnnnnnnnnnnnnnnnnnnnnnnnnnnnn

SEQ ID NO: 25160 - DNA, 137 bp, Oryza sativa
ttttttttcgactcatgtagatggatcggcaatggatgtacgctgaccggcggtccaaagagtttattgatggcgtgcactattttttgagagtggccgaagctaacaggcaaaggggttttatttgttgtccatgc

SEQ ID NO: 25161 - DNA, 5014 bp, Oryza sativa
agtcgacctgcaggcatgcaagcttgggctcataaacccaagccaatcatttggagatagatactgccatggctggctgcaaacaagaggtatagctaaagaaaacaaaacaaaacaaaatgcttactactcgctctgttccaaaatacaccatccgtcctagaaagaataaacttctaggctcagaagttgttgttgtctcgtttaaaacaaagggagtttggagtattaaggatttataggttgtttagaaaatactaagtttagggcaattttttttgtcattttagttgtcaatttttaaattttgaattgcatagattctctttccaagcatctaattggctttggaattattgaaatgatgggaattgtagaaatcagagaaggaatgcttatatgagtattaaaaactaaatactagaaatcctgatattttgaaacggagggagtactataattaaaacacatgcattgggataaggttagagggggatctatgctgctgctgtggactgtggtgagctttaaagggttttaagggaaggtgcttgaagatgtcaaagacaatggaaaagtggagttgggaaaagatgaaaaagaagcatcttggagcaaggatgggaatccagattccatccatccatccacaagatgaactgaagaagaagaagaagaagaagaagaagactctgctttcaaaggggctttaggtagtcaagtaaagtactctagctgcatttgcaaaaaggcttttcttgggccagtagaaacatgaggaagctaggcataggcagaggagctcttggtgatgatccaaatcttggaaagggatactgcaactgcatgcagagtggatggatgccattgggaacagcagctgttggttggcatcgatctctgaatgacgagttgccacttcacaatgataactcttgatcaattcccactttgcaagtaaaaagcatcagaggttttatactctgtttttgccctccagatttcaaatactacctgtttttatatttttaaaaatatattaaataccggttttcataaattttggttgagattgaagtagttttactccatgtgcctgtgttgcagcgcttgatctgatcccttgtcatttacaggacgaggccacaatgcaaagttttggtaattgcgagcacatgggccgtgagagagagagagagagagaggggggaaattcggcgagtgggccatgcagcccacatagtcagctttggcctggcccggtatcggggctatgggccgctctagataggcccataaatgacagaccgcggcccatcatgcacggcgttctccagatgggctccaaatctgacacttcggcttaggccccattctaacctccaacgacgacttacaattttcttgtttttcgttagcaaattgctaaactcctaaacggtattttggggcagcctaggctcgggcgcccgatcaattcggagtaaaatcgcctccgatttacgtgtaaaactactttaaactgatttttcttttaaattacttatccaaatcatgatccgattgcaccattaaattcgttgcaattaaatcttcaaaacaagattacacatggatatattccgatgaaaaaaattagcttattattgaattacttttaaggcaaaattggttatatagcatcgaaagttcacgtttttggttttatagcaccgaaagttaccggttcactttaatagcacccaaagtttaccatgttcccatttttaacacttccgtcaattctcgatcgttttccgtccgtcttgatccagtcacacacacgatatgacgtttctacccctaataagtacaagtataatgcatgtcaatgaggggtagaaatatcatatcatgtgtgtggctggatcaataacgattaagacggacggaaaaattgatggaagtgctaaaaatgggaacaaggtgaactttggatgctattaaagtgaaccggtaactttcggtgctataaaaccaaaaacgtgaactttcgatgctatataaccaacttagcctttttttaaatgttgcacgatgttccaccaggtatatcgaaattgtctcactaagtacatcgaaaatgtttcactcgtttaaatcgggtgttgtttcaccttatataaaaacaatgtttcagcaaatagcgaaagaatgttttagtttactgcaacatttgatccatacatagtgaaacattataagtacactaggtgaaacatttttcgatggaacaaaaaataaaacgaattcccttaatagggggtttccaaaatatgtgggtttttttgttgcaatggaatatctcagtttactgcaacattagatctatacatagtgaaacattgtgagtgcactaggttaaatatttttggtggaaaaaaataaaccaaattttcttaatagagagtttccaaaatatatggttaatttgttgcaggggcaggcactgtggtgggccagacacatggtgggccagcggcatgcaggcgcatggccgcgcgcggggagcggggccggggggagcacccgattttgctcccccgtccagtcacccagatagcagcatttccccggtatttttataaaggaaaaatataatactggaattgatcatgcgtaaataatatgtctcgtttttttcctcagactgatttgtctgtctacacggtatgatgtgttggatggattgaactttcaagtttaggccgtgttcagttagttggccaattttttttatgtatactgacacatatttgaagtattaaacgtagattaatgacaaaacaaattatagattccgcctgtaaactgcgatacaaatttattaagcttgattaatctgccattagtaaatgtttactatagcaccacattgtcaaatcaggacacaattaggctcaaaatatttgtctcgcaatttacatacaaactgtatagttggtttttttcgtccacatttaatgatccatgcatgtgtctaaatatttgatgcgatgttttttgccaaatttttttaaaatctaaacacagccttgttgttgttttggaattcaaattcgtatgattagcgagcctcatgttgatttgggagtagtagaacagctttcacctggcactccgtacaaccgctcatcctagccgaacgtgtatgacctcgaatgctttcgacaaggacaatcattaaccatgtttgtttcagggccctggcaaatggatcacaacgatttcacatcacttcgtaaaccgtttactccgtcctaaaaaatccaacctaatactctatccgtctcagaatatagtaacctaggagcggatgacgtatcctctctccgtctcagaatatactaacctaggagcggatgacgtatcctagtactggatacgatacaacctaattctataaatttctattcagatttgtttcgttgtgttagaatatgtcatatttcttcattattttttttacgaagagagtagtagatctcacatctcggtagtctattcaaatcaaccttggccgccgtcctatccacggcgagccccacggcccccaaacccgccggccgccggtgggccaccgctccccccacaacaattaattactaactcctcattactaaatgatctctttattaatcccttgtacacctgtaaccactccacagtccaccccaacccagcgtaacgtccactcatcgcgagccgctcaatccaaatccaacggcatcccgcaacccacgtgtccctcaccgcgcgcgagtttgaatttcccaacggctctctcgaccgttgctgccacgctcctgaaaaaaaccaaaaaaaaaaataaaaaaaacacgcatctgtttttattctctcccatctctcccgatctctcgcccatttgccactgatcccgaaacaaacagttggcgccggcgccggcgcgagccgatgtcggcgacggcgttcacggaggaggagaaggcggtggatgactcgctcggctaccccaaggcctacgcgcgcctctgccgcggcggcggcggtggcggcggtggactcccgtacggccacggcccgccgcacggcttcctcccctacgtcctccacccgcacgaggtaatgggtgctcgtcgaggtgatggtcgcggctgctggtgcggtggtgagctgattggggtggttgtgttgggtggtggtgcaggcgatgcgggcgaaggatctgaacgagatgttcccggtggccgacgcggaggcggcgccgacggcgaacccgcgggggttcgcgaacctgctgtggaagcagctcgaccacctcggcaacgccgggttcgacccggcgctgttccgcgtcgacgcctacggcaacgtgctctacctccacgccgactccgcctcgcctctcgcgtgggacatcgaccactggttcccctgcgcccgtaagaaacgcagatcgaacgaactcatcccaacatccgcttccacatcattccttcgatctctaacgagattgttttttttgtatttgctcgcagaaggtgggaggacggtgccgagcaacctgaggatcgtgcaggcgcaggtgtgcaggaagaagcacaacaagctggagttcctcgtcccgtggtgggatctgcagctcggcatctccgtcaaccagttcctctccatcttcgcctccaagaacgccgacttcaggttcgcccatccgcatcgaacagcttaatgtgtctctgcgggtttttttttaccgatgcatcatggatcgaatccttctgagacttgcaggaacagagcattcacgttcttgttcgtcgacggggccagcgaggagctcacctcgatgcaggctgtggaggcgcacgcgtttccgcaccatttctccgatttgaccaagaaagttggccttgcccctgctgccattgtttcctccaggggatccgatagctcggtgctcaaatctcttgatgcaaaccggccgctcaggcct

SEQ ID NO: 25162 - DNA, 689 bp, Oryza sativa
ttgcttctcccacttcactaatatataaaactaaaatagctcattaaggccattaagatccttctttgtgtttgttctgttggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaactttcgattttgacgtgtaactaaacacaccttagtactctaaaaacgtgtggatgat

SEQ ID NO: 25163 - DNA, 886 bp, Oryza sativa
  unsure (1)..(886): unsure at all n locations
ttggggggcccttgactttgaaggtgccggaagaggagcttgcggaggagtcggtgtaggagcccgaggaggagtcggtgcaggagcctgaggaggagtcggtgcaggagtctgaggtggagacggtgttggagcatgagaaggagacggtgcaggatcctgaggaggagatggcggagccggagnagatggtgcacgagacgccgcttgtcgcccagggaggatgatgtaccgcctgcgccatagaataatggcatggcttgtgtctcatagatgcgtatcactgtctcctccagggtaatccagctcgaggtcctcgtacgcgccttcgaccaactcaacttcgaccttggagtatcctgctggaatcggcctgcagtggtaagtacctgaagggtccgttgggatggccatgcccgatgccaccatcatgtggtgagaggttatttattagtaatcaacatatataagcagcaactagcggaatggccaaatctaaaatatataaactacgagcttacctttattgataagttcttgaaaggaatatgcagctcacatggtgtccgctgagtgatgtcatcaacagggcaggtggattcgtcctgggtttgtatggcgtccatgctctgtgatcctacctgccccgttgaggcgcagctgctacggtttcctgacgggctcaccattgcaggaggaatggtcggctggggatcatgggaccgatgtgcgtggcgtacgtccaagaattcctaatagggtaactcccaaaatatagagttctttttccacatcgccgcgtgaccatcttcgctctgannnnnnnnnnnnnnnnnnnnnnnnnnnnnnnnnnnnnnnnnnnnnnnnnnnnnnnnnnnnnnnnnnn

SEQ ID NO: 25164 - DNA, 28125 bp, Oryza sativa
  unsure (1)..(28125): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtaatgtgtgtgccacccaccatggcatcaagttcgtcaatatcatcaaccaatgtggtggcagttttagcataaccctgtggtcgtggtgcgaggacggaacatggagaccagatgcgacactggatgctgcccaactttgggacctcgattgtgaaaaccgccttccaaatgtccaaccagaattccctattgttgacatggaaaacccttacaccgtttgcttcttgttgaacgagggcaactacattgtccctgaagccacaacatggatgatcaaggtccacatgaagaagaagattctactaggttgtactagttattctaaaaatggaagcttgtctcatcagaacaccacctacatgactgccagaaggatgtctgagagactctcctttatctccagtgaaatgccatattacctgtctggacaaaccatgaaaaggtaataatttcatgtctagtttgccaaatgcatgccatactgttcttttggttgcatgttgtacagaattttcctagtttgaagtgaattgttctgcccatttatgtttagacagcattgacgttgtggtagcttgatcagtcaagagcatgattttagatgaatataattgtggctaggatttagctatttagcagcaccaacgtttcttgctccctttaattacttggtcctgaatccctctataactcatcctatagtttatacaaaatcgatgtttgtttgcatgtttttatttcgtcttctcgacactttttctaaaaatatcactgaaccatttctgaatcttaatttcaagcaggaagttgataaactaggaatataactggagatcgaggaattgtcttaccagtttgaagattggatccatcaaacactgtgtttgcaagagcaagttcccaacactcccctctcgttttccacgcgcacgctttttaaactgctaaacaatatgtttttttaaaaaaaagtttctatacgaaagttgttttttaaaaaaatcatattgatctatttttggaaaaaaatagctaaaatacttaattaatcacacgctaatagattactccgttttccgtgcgcactgtgcatgttcccatccttccctaggatgtgagctcctgcgtctgcgtgctacagtaagttataggcaaaattggttcgatgctatataaccaattttgtcaataataaaaaggctaaaagtttatgccatagcaaacgaaacatgaagtgctactccccacatctgatttgccatgcaattttacaatcgaacagaacaatcaaggagcaacatttcacaggctagagaacatcgtaaaatccagttgcttctgtttactccatgcacaatgtgacaactgacaagcatatcatatcatacggccgccgatctcctgctacagtgcgatgtataggaaagtaggaatgtatgaggaagtgctatatatgcctatcgtatacccatccgacagtaagccgaaattctttagcactcggaccagttttctgtatctccacacctgggctgaacggcttttgtatgcgcctgcatgatggagatcaacatttgtcaaactcaaatatataaaaaagataaagggatgccatgaaatgcgcttaacgcaagagaattttgaatttgcacgtgaactctgccatttttcaggcagaaagtacaacaaatcgtgcgtggtatttgatcttccgtaaaaaagaaagagctcgatatttcaacaagcctggctagtagtgacgctgatagaagagttagagagcaaattgtaaggccacgcattgtatcatctcatctctaatcccgtgcacattcggcgcaatattgttcatgccaatagtttacctgcgggtgcctttcttcacggtggttgaaagttctgtgctttagctctccacggttagttgtcagctcatctaatatctcggcatcgtcacggctgccacagctttctgaatcagatgcaccatcctcctgtgtggaacaaaagattcagattaacaacagacgtggggcatcggagaattaaagagtgaaacacaatcatcactgacaagtaaataatccaagaatgggagataaatttataccagcgtgtgatcgtggtggacaccttcaagctcttcatactcagctgcatccaattcccgaaggtcatttggctcaaaaaactttgggaggacatgctgcctgataagaatcataaggaagaatggcaacgggaacaggatccctgctattggtatccatgttatgccgaagcatatcaagaggtaaaccaactggaagatcgtgaagacagtaattgtttttgaaggcactgactccatgaaagacgcatggggaccctccaaaaccctgcaaatgttgaagcatagtgtgagctgttaatcactgttttgacaaaaaatggattatcttacgattaatccaaaaggaggcacataggctgcaccgcaagtagtcaagcatgcaatttcattgttcaaatggggtaaacagatgcagatagagatattacttgtagcgtcggcttgatgggatgaatataagtcttattctttcccaaaactggttgccaggtagactgtcaatggccatataagcaaagtaaccccagaggaccgatgtcggtatcatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaccttcttgcagcatagcatccttcaagctctttaactccttgtcaacagaatcagtctgcaggacaatttttgacctataagttgatttacttgaacattttccatacaagactaacagtggcatctacattttgaatagttactgaaagaaaaccaaaagtatggggactcctcgtaaggtgaaaagtaaggtgttcaggcaattacatgagcttaggactaattttcttgacaactgatgtagtaattttgacaggaactggcattgacaatagaagtaaaatgcaacaaataaatggaagaggaaattatatggtaacatacatcagtaatgaagagtacatactcacatttttttcacagtccatctcaatgaaaaccccttgcatcttgccatagatttccaaactgctagcacgattcatcaggccttcgttggcagtttgaaccatctttttgcgtagcagctaagcaaacagaggaagaagatgggtgagctgatgagcaaatatggatattgtagcaaacaaaacacttcggtctgaagttcaccaacctgccccttaaggacagcaaggcttcttgtatgcatcggggactgaggaagtactccattagatggagggatgccaatcaaaccacaaagcaggacctgcatcatttttatactactatatgagaagaggagcatgtcacagctttggtctattacaccacaaagcagaatcagtgtccaatactcctatcaaccatcaccttgtagattgcagtagtgccaggttataatcacgcaaaaaagaatataagatattatggatgttggattttcaatcatacccattcaattgttgtaacaaataccaactctactttaaaatatatgagaatatttcttattcattttttttgaacggaaatatttcatattcataagactatactaaaagattttggctagttttaggctagaagtgatagagaaatgaaatgttcactgaggaccaaaagatgttaggttcctagttagccgagaaaaaaaaacttaagaagggccgccataagcagataatttttttagacgggtataagcagataaatttatcatagaaccatggcacacaccatgaatccgaggaccaaaatgtcataatggtaagcagagggcttcttcaagttaaactccttttgttgcgccaattgtgaagccacgctatgatcaaagaagtaaagtcctgcaatcatcaaagctggcagaatggcagcaaatatgtatgctgggggaacagaaaacaggtcctggaaataaaaaaaaaacccaaagatattatcaatgatgccatgcaaaataagctataccaaaattctaaacctgaagaccataaatattcacatctccagtatcccaagcaagtttgatttattacctttgctatggtccagtgatgcagtgaacttgactcccagggaagtggactgaacagcctcctaggaactcctgaaggaacatcctttggtaatgcgtacgataatgctgtccaaacaatcaccataagtgggacaccataatcagaaatgaagcctctgagccaccctgcaagtgtcaactcaaacgcacaatgatcagttcatgtacatgtgcttctcaatggttataaaatgtcatcatggagtcatttgcatgctgatgtagcatacatagtagtaatttcttctctttttacttgaaagatggcaaaagctttgcgtatttaatagagaagatagtagtaatttcttgtttttgtttctaaatgttaaaaatttcaaagagggaaaaacactgtgcagaataagaatctgtcgatatgggctactaaacaccatctcaagccaagccatccactcaataaggaaaaaaaaggagtccatatggtttgccccaaagctgacaggctgacacaacacaagcttgcagcccagcccaaccaacgcctgatctaaagtaggcccagtccaaacttcaaaacagcaaaagaaatgtttggcataaatctaacggttggatggatgactaatggaacagctattgctaatttgatgacccagagctcaacttgccccctaaattggacacaatgagataaaagtaagatgaaaacgtgaccaaccttgaccatacacccatgaccttgcccttcttgaccttaatgcagtgtataacagcccaattgaaaagattacaccaagtaggccgttgacatacaaccactggaatcgatatataggtgaactatggtcgacacctccaggtaccttgaattcttctataattccctgcaataagtaggcaccgttctaaatattttcttccaagatacaaagcactgagctcgctagaaatagcatactttaatagcttgttgcaggaacagaacagtgatcaacatcccgaaaagttctcctgcaacccttgtaaacctgctaataacattagaagcattgaacattgccagaagaaacaacatgatcgcagtccagatgcagaccctgtcaacagtaagcaaatcaggagagcattaacttttttttctgaaaagctaacgtgatagtattcagtttcagttgttaccatccagcccatgctaaatacagtcgttcccccagagcttgctggttcttggcaaagttgtagagatacgtgtacatgattatagttggctctgcaactccaactatcaacagaggctgccctccaagaatggaatggatgatgccacatattgcagtagatgccagtgtttctactgtggtgagtataccatctgaaatgaaccactttccctttgttagagatgtaattaaagcctaaggacagcaattccaaaaagagcacaactgtagtatggctcatagtggcaagagggtaggtatttacttgtttctctgctcagttgcgttccgaaggctatgactgggagggcagaggcaaaaaatatatacatagtaggtgccaatatcctgacgatacatccagaggcaacatgaataattaaggaatgaaactgacagcaacaagaggagtgaaaacacacacagtgatctactgcaaaattaattgttcgaaacaaaattaacctgaagccagagtggaatccctcaagccaatcatgcttgtaccaagctgctcggccttcgatatcagcgacgacacccttaaagggaatctttagtagttccatcagctgaattccactcaatactaaccagaagctgcaacagtacttacaattcagaaatggtacatatatattacatacgtagtattttgaagacacacatattggcatacacacatcctagaagcccccatgttacaaaatttacaaactcaggttaaggtgtcaagctacccagatgagtcaaatggagagaaaccacggaccaaacttgcaatcatcacaaaatgcacgcttggtgctaatacgtatgcaaagtttgcagtatacgtaattaatttgcgcttactgcattgcaacatatttggtgtaccataattagcatttgtaatttgtaattcgaacttctgcatgacgaggagacaaatttgcatttctgcatacaatttctaggaagtttatactatacaaattacttggtcacttgctgagctaaacatcatgcataaaagcactaaaataaaaccagcttgctgggttctttcaaaaataaaagcactaaaaaattgtcgtcaggtaaccgcggcaagtgtccaacacttcctctcctctcatgccgtcatgcgtggggttcagtcataacagcaaacaacacatacatgttactccaatattattacttagtggtaaaaaaaatcagaaaacagcaaaaagaaaaaaaaatcaagcagtagagacccaaatcacgaaatatttacagataacttgttagatccatatgcaagcattccacatcccgacatctacatgcgcacgcaaccaccgcacttgcgaaacgaacaagcgccgcgtttctccatcacctcgaacaaaaaacccacaaacttttaccaccgaaatcgatcaaaaaaaaaactatgaaaaaacccaagcaaatctccccacaagtaggaagagaaatcagccgcaaacaccagcatgcaacacaagacttcacagtccgaaagggaacgcacgcacaccgtgactgcaaaacctccaaaaacccatcgctcactcaacatcggccgagcaatcgaggcagcggcgagaggacccgtacctccggcgggcaatgctgacggcggaggggaaccctagacgtggaggtggcggaggagacgacgcggccgcggcggggcggcgcggggcggggttggctcctcaaacctcaaggcccccgtgatgtgcggctatttataatcgagggcgaatcgaatggacgctgccgagaagaaggggagaaaagaaaaaaaaaaaagccgccgcggctgcctctggaaggctggaaaacaaaggagacgagaacccgtttacctaggagtattttttttgaaaaataaatcggagttgttagaaatatgacgccatatactacagtcgattttttcagccatttatatagtagttacacctcacttacatatgtaattagtatgtaatttttgaatttacatatgtaattttattacttacatatgtaattttgagatttacactgtaaatacactaaaattacatatatatatatatatatatatttaggaacttacaatgtaaatacatgccgactattttttatgaaaaatattgtgttataaatatagctacacccaaataaattccaaaggattttttttctttttgtctactctctcatcggcgtcactctctgacaagtgggccccaggagctgacaccagtggggctcaccggtgatactaggggctctgccgcatggcagccgtgacgacgactccctgaggttgaagggtcagcgccaaagatactctactcctacatataccctccgttctaaaaaaataacttctacgaatgaatctgactaatacttatctagattcattcacagaagttaattttctgtgggatggagggagtacctacattctaagataaaattcgtttcaaattagatatggttaaaataaataaaattaaatgggacaagtttatgattgattgagaaataaagttatgaaaaaaattaaataatgaaggattatgattggttggaaaagaaatattgatgaagaaaaaaaaataaaagatttaattattatattatatgatagagatagtacggtatggctgtatggccttgtttagttaaaaaaaaacttttcacttatcatcttgtgtatgaagtattaaatgtgaaaaataaatcaattacacagtttgcgtgtaaattacgagacgaatcttttaatcctaattacgctatgatatgataatgtggtgctacagtaaacacttgctaatgatggattaattagacttaataaattcgtctagcagtttcctagcggaacatatattttattttatattatattacgtttaatactttaaatatgtgcttgtatatattcgatgtgataaccaaacctaaaaattaattttaaggccggggtgatggtgacgtgtaccgatcgttgcgtcatcgtcagcttccccctgccacccaggcatccactgctgcagggcaccgccacgtacgccgcgcggccgaaggcacggccatcaccaccaccagcagcagcagcaggcacggccgatgtgggtttctcgtccaaccaacaagctaagcgcaacgaacagctgctactaacgagcctacgatgccaaaatgaaaagaagttgtggaggagtaaattgcaggagctttttgttgagatgctgacacatttgccacgctgtattgatgagaaacagtaagttgtgatttagttttatagcgaaaggtgtaatttagttttgagacgtttacattaatgtaaaagatgtcgtactctaacagatgatcggttaaaatgaaacttattaaagggggacaatagtgggtcagtagattccctgtatctataaatattatgtatgtgtgagtccgtttttaataaaaatttacgggtattcagagtcagggctatgctgaaaataactatatgtatgataaaattgataaaatcttgttatgatcctgccttgcatgattaacgattgggccattaaaacattatattggagctcatgtttgttgcatgcactagtttcatagaagcaacattagcaagaaattttatcatatgtatagtagggcttgggctatgcggcggtttttatctcttcaaaacgtgtgttttggagcaaactggcaggtgagtgagtgagtggtatgtgtgcacatacgtgttgtgtgtaataaaaaaatatataatttatttatggttatttagatgaggttctacttctaatggccaaaatattttagttttattccgtttccgtaagttgtatagctctatggtgaaatggtgacatcatatatttttatgtattggagtattactgtattctttgtgtagtcgtacgtgtaagactcctccatcgtgtttaaatcatgtgtaattcctaatacacataaataaccatgagttagcgtaaattaagggtgagaaatacccctttctttcaaaactggaaagtattttccctacacctggccaggcgtcactgaaactactcacggatgtgttgttgcattcaatggaaaaaaacacccaagaaatgctcgcagctgctaggaacgtaacgtgaacctgacggcaacctcatcaccacaacctcttcttttgtctctaccaaataaggagaatgtaggacctctcaagccaagaaagagaaaaaaacgaatctctaaaatttaaattttatgagacaaggacttctcatatgttccctgataaaaacttaaaagagacaaggacttttcatgctcttgagtgtacttcaaagttttttgtgtggccggtgagttcttggagtcttagatcttatttatacctattagccaaagtttaaatttttaaccttaaatatagagtagattttaagtttttttttcatcgttgtttatttttcttagatcgttaagaatacatgtataaaagttttatttatagatttttttttgaaaatatatcgtttcactttttactctaatatacctaacgattgggctgttaataataaggcgcaacgtagcaactgcatgctgccttctttgggggttttcagtttggatcctgcagattgcagctgcagcgacgtctcgaattgttatgatctgaacagaaaaacggaatggtagcctcttggtcaggaagcaacaagcgtggctgcgtgggtgtggctaacaatttgtttgccgctccttaggccgtgtttatttccttgttaattttttttatgtatacggacaaacatttgaaacatttgaagtattgaacgtaaactatttacaaaacaaattacagattccgcatgtaaactatgagacgaatctattaaacctaattaatccatcattagcaaatgtttactatatttttttttacaaaaaacattgtatatatgaattcatgaaaaaaaacaattaaaatatatttcttaactttatagtatttaatacattcgtttgtgctatcaaataattgtaaaaaaaaaagaatcattcagtcattgagccttaaaaagcagaccctagtagctaaaatatctgcattttgtgtatagcagtacttacattgtactcccttttacctatgcgtaacaaaatcgtactactaagtacagttataatgttcaaaaaaaatacagttattgtgtacaagaaaaatcgtagccttcacaagatatttgttggtactttgcttggtataaatcttaaacaggacgtgctaatactttactgtctcgtacaattaattcggagagcgctacgtgtcggacgtacggcgcgagacgaaaaatcagacgcctccgcaaccgtccgatccatgcacagatgcaccatccatccatcatgcatgtatcaaacgaattttaaactattttttctctcaaaatatttatccaaatcatgatccgattgcaccattaaattcgttgcaattaaatctttaaaacaagaccacacatgaatataatccgatgaaaaaaaattttagcttattattgaattatttttaaatgttgcacgcagttgcaccaagtatatcggacttgttccactaggtagatcgaaaatgttttattggacgccgtttcgccttatatgaaaataatgttttagcgaatagcgaaatgatgtttcaactcactgcaatagttgattcatacatagtgaaacattatgagtacattaggtgaaacatttttaaattaaaaaaacggatggtcaaatgttgcagttgaccaacaagtaaaacatcatgttatatatatggtgaaacaaaaaagtcagcaactggaacatttaaatattttatgaaacatagtgaagatacatgttgaaacatgttgctgttacacatgaaacaacaagtattaactgattgaaacacatgtttttcttttatgaaaatataatcaagcgatatcttgttgtaaagatttaattacaacgaatataatggtgtgatcggttcttagattgaataggtaatttaagagaaaaattattttgaagcttgctaaaatacatgtatgtatgcatgcatgaggtggagagagagtagtagtaggtagtttcaggaattttgtgaaacacacttaaaacacatattgaaacatatcactatcacgtatgaaacattttgttttaacggtttgaaacatacgtttttcttttgacataatataatcatgtgatatcttgttgtaaagatttaattgcaacgaatacaacggtgtgatcggtttatagatcagataagtaatttagaagaaaaaatatttaaagagatgagaaaagaatgaaaagaaacaactatgtatatgcatgtatgttacagtacgacagtaccaggctgctgatctacaacattttgttgacgtcaataaagagaaagaagaaattagcaagcaaggactgagctgaccgtaggcgttcgatgtttttcatctgatcggacgttcgaagagaagcattttcgaattaattctgctgtaaaatacacacaaaaaaagatatgataatcgtgatctaagcgatgacggcgcctatagagtccagattcgctcatcaaggcagtgaaggcactggctatatgaagatgacaacgagactgactgtatgagaatatgagaggccatgttgaattatcgatgcaaaaatattgattaagaaaaatgagttttggagggagagacgtccctccaaatatttttttatcgaacatgagattttatggttaaaatcacacgctacttaccactgcactatcaagtacatctcgtaaaaatgttgattagtctcaataaagtttgatgctgccaggaatgtttcaaagggatgtctgtatttttttaaacgaagttctattgatagagtagaaaaaaattacaatttaggatcataactagaaaaaaggaatgcctgtaaattaaatttgatgagtcactgggtcaagatcacttttattttttacatttaccatttagcatgcggccatgcaaagcaatacaaataatgccccctacacccctccgtcattctctttccgttccactaaataagacatgatgaaatttaacacaatctttaaaactaatttttaactttaaatttctcatatacacaatgtttgtagcaagaaaataaaaaagaacaagtttcaatatcagtcaattgaatcgattgattattcttatcaaataaataattaatcctgaagattttaaacgatatgtacacacactaaatccattacattaaattaatctacactagctcctccttctgtttataagttgctttaactattctaaagtcaacattttaagtttatagaaatgtacaacaatattaatatttatagtaccaaattaattttattaaatataacattaaatatattttgatagtttattttatattaaaaatgttactatattttcttataaatttgatcaaaactaaaagaaaagtttaacttgaaaaaaatcaaaagcggaggtgtagctccaaagtccaaatgcaattctcagaccaggcaggcagctgacggatgaaacaaaaggataaaatgcgaatcatctgaaacatggctcaggtttaacctccagaatgttctcgctgattaaaaagtctgggcgaattaaccagctgacacgtacacgcacgtttctgattatattatcagctggtttattatactaatctcgatcggatcatgcagcataaatgtccaattgtctggtcgcctaatatgcagaggagggttgataattacttcctttgttttatactccgacttgatatgtttgaccattcatcgtgttaaaacatcaatactataaatttgcagaaatactactcatgcataaaaagcgtttttaatgataaaacaaaccacacgaaaataaataataattagtacatactcatcgaaaatatcattattttaatatgacgaaggtcaaatacaatattaatcgaaaaccaccattttaaaaacagaggaagtaatgtttaaaaaaacagaggaagtattacgcagtcactttcactagctcaggtagcgtttagttagtcgtacggatcaggtggtcggcaagatcaagattgtgattagaacatagtacagtatataagttggccatgtgttcgctgttcaggggtacaaagcagaataggcagctgccgttgcttgtgaggagttagcactaattatttgtactttgtcacgagtaagcatcgtcgaatgcactccctccgttcttaaaaacaacactgaggacaacaacaatatatatgacaaaagtagtccataaaactagaacccacatatataaactttaactattataaatttcacaatgtatatggatagcaaatagtattagtagaagagaagagatagagacaaataatatattttattctctataggcaggccatatgtttatgagtagcttttgttatttctttcctatgggctagtttcacaatgttgctaggtggctgaatcaaatattatattgcttatggaccatttttggagtacattgtggatgcccttaatcgaagtaaagatgtaatttcttctagcacaatgaatctgactcactctctatccagattcattgtactagacagactgtttaaatttattataaaaaaagattacatcttcttgtaggttttttttaatggagggaggagcacgtactccagttaattggtcggtgggaagtttcttttctctggatcgataagggaaattttcaatggcaatagaacgtactaatccgtagttaagtacgaactcgagacatgtacagggatatgtatgagtatgacgttgggatcaatatcacagtgtcatatagatgatcggtaggagagtatagctagtaccgacatagggaaaagtattatttcttgaccgatgatatacatagcattggttgtaaacgaaaatttaactatttgccacttctagaataaacaattatctagatgtcattcttatatttgcacttatttttttgcaaatatttttacccctctaaggtgatgacttctttaactatttaccatttttatccatgtgacataccaatgtgacaactcggggtgaaaaacggtgtggaacccactagtcaaactctccacttcccttatctctctctcagctagttgaccaggccgcgacagcatgcggagaggcccaggcggcactggagtggaggttgacggccgtgacggccctctccccggcacgcacccatcgaccttcatggcatcgatcaaattccacgatgacgaccattgatgcggggcaacgtaccaatcgggatgctcaggctgcctttccagtccgatctctctaccagcggtgactcgcgtgagcgctcttcggttcgttgtctccaccatctcctcctctagcccactgccccagcctcccattctccatctccgtccgcgtcaatgtcgggcccctcggctcccatgcctgcgccgcacgcccttctctctcaccgccgagttcaacctcgtcttcggcaaccccgtcttccccgtcttcttcctcttcctcaagctacggctcggtgttaatttagtgggaaaaagacatatatgccttgcatatttgcctttgttttgagggtgttgtgtttttgccatatttgtgccagcgtatcttgcatatggcgatggatattgcgcgcgcgcgcgcatatatatatatatatatatatatatatatatatatatatatacacacacacacacactcagcctcatcggttgtccatattttcgaatatgttaaaacagtttattaggaaacaaaaattaatttacagtaaaacttttgtatatatatttctggcaacttaagccaatataaaaaaaactatgttaaaaatattttaaatttaacatcaaaattaagtttgaaaattcaaatttgataaatcaaaccgatagaaccctcaaaatgttaactaaaagacaaatcttcacacgattgtatgtgaaggtgaggagaaaagaggtgcgacgggcgaggttggcggcgaggcaagcagaagcgggggaggcgacaattagagcaggtacaatagcagaatattagccagctacaaatatattttaatgagataaaagatgagagagaagagcagcgggatacagatctgtagctagctgcagcacggactccaagatgcaatgtatgtatgacagtgggaccatatactattagtatagtaaacaactattgtataaattggctattagattagctatagatgaattagagctagtagttggctatactattaaccttgctcttatagcgtgcacgatggctgcgacgacattgggcgcgttaggcggcgacgacgttggctgggtgctagggtgggcggcgatggcagagcggtggcgatgaagtgccgacgcatgcggttgctgggagcctgcctgcctggagactcggggaggagatgcggtttccgagaggaatcagggagggagaagcgtgataggcagagccgagtggggaggtcagggatgggacgttagatcgaaagatccaacggtcacaaaatatacgtgcggagtcatgggtctatgcggggtctggtgttacggaattttgttggatcctaggattgcacaactgcactactcgatttaatatcaaccctctgcaaagtggaacaactttttgtccatatgtcagtttatcgtttcgtggtgcaaaattattatattatattcgttccaaaataagtgtagccataagtacctttgaccgtttatcttatttaaaaaacttattaaaaagttgaaaaagtgcatcaacttagctaatcatatgctaggtgagttttttttttcacgatgtcaatatgccattacatagaaatcctaaggatattatctttaaaaattatactacacatccaattacctttaagaatttttgttttcttcaccttcccaaatctcaaccgaaatataataatttctacatccagcttaattgactttcagttattagttattaggataaaaatataaatatgcttatatacaaatccacactagtatattgccaaaataagtacttaaaaattgaatatgtataaaaaaaagtgctccaaataattaagttgtcgcataacttcttaacttattatatcaaaattgtacgtatcttgcaagttcttatgcgatcacttataaagttcttgtactaaattacacttacctaccaagttgttgcactagaacgctcatttcacaagtttttacaccaatttacacccacctgccaagttgatacattgtgggtgcaatttacttaaatattaatctaaaaaaaattaaatcagacaaatggccaaacttggacatgaccatcttgggagtccatccacttactttttgcacgagtgttttctatataaataaaacgctaaaagcttatgccagatcaaacgaaacatcaagtgctactgcattgaaagcccaaactccacatctatattccatattgattgccatgcaattttacaatcaaacagaacaatctaggagcaacaattcacaggctagagaacattgaaatctacatgtcacacagccttacagaccttcagtaaaatccagttgcttctgtttactgcatgcacaatgtgacaagttgacaacgtacaagcatgtcatatcgtacggccgatctccagctacagtacgatgtatatgaaagtatgaatgtattatgtatataatacaacggaccgctgcttgaggaagtgctatatacgcctataatatactcatccgacagaataagcagaaattcattagcactcggacaagttttcagtatctccacacctgggttgaatggcgtttgaatgcacctgcacgatggagacgaaacatttgtgaaactcaaataggtaaaataaaaaaaaggatgccatgaaatgcgcttaactgaagagaatttactctatgccattttaggtccaaagtacaatagatcgtgagtggtatttcaacagactggctagtagcctagtagttgaccacagcagaaggttagagagcaaattgttaattaagcccacaccctctatcatctcatctctaatcctgtgcacattcgctgcaatattgttcatttgcaaataatttaattacctgcaggtgcctttcttcacggtggctggaagttctgtgctttagctctccacggttagttgtcagctcatcaaatatctcagcgtcgtcacggctgccacagcttcctgaatcagattcaccatcctcctgtgaggaaccaaacttcagattaacaacagatgtggggcatcggagcattgaagaatgaaacacaaaatcgtcactacaagcaaataatccaagaaggtgaggtaaatgtataccagcgtgtgatcgtggtggacaccttcaagctcttcatactcagctgcgtccaattcccgaaggtcatttggctcaaaaaactttgggaggacatgctgcctgataagaatcataaggaagaatggcagcgggaacaggatccctgctattggtatccatgttatgccgaagcatatcaagaggtaaaccaactggaagatcgtgaagacagtaattgtttttgaaggcactgactccatgaaagacgcatggggaccctccaaaaccctgcaaatgttgaagcatagtgtaagctgttaatcacttttctgacaaaaaatggattatctttcgattaatccaaaggaggcacataggctgcaccgcaagtagtcaagcatgcaatttcattgttcaaatggggtaaacagatgcagatagagatattacttgtagcgtcggcttgatgggatgaatataagtcttattctttcccaaaactggttgccaggtagactgtcaatagccatataagcaaagtaaccccagaggaccgatgtcggtatcatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaacttcttgcagaatagcatccttcaagctctttaactccttgtcaacagaatcagtctgcaggacaatttttgacctataagttgatttgcttgaacattttccatacaagactaacagtggcatcaacatttcgaatagttggtgaaagaaaagcaaaagtatgaacccttaatcgttaggtgaaaagtaaggggttcaggcaattacatggagcaggactaagtttcttgacaactagtaattttgacaggaaccagcattcacaatagaagtaaaatgcagcagataaattaaagaggaaattatatggtaacatacttcagtaatgaagagtaaatacctacatttttttcgcagtccatctcgatgaaaaccccttgaatcttgccatagatttccaaactgctagcacgattcatcaggccttcgttggcagtttgaaccatctttttgcgtagcagctaagcaaacaaaggaacaagacggatgagctgatgagcaaatatggctaccgtagcaaacaaaacacttcggtctaaagttcaccaacctgccccttaaggactgcaaggcttcttgtatgcatcggagactgaggaagtactccattagatggagggatgccgatcaaaccacaaagcaggacctgtatcatttatgtactactatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgggacaccataatcagcaatgaagcctctgagccaccctgcaagtgtcaactcaaacgcacaatgatcagtgcacatacatgtgcttctcaatggttacaaattataatcatggagccatttacatactgatgtagcatacatagtagtttttttttttttttgaaataaagcaaaagctttgccatgtatatattagtagagaagatagtagtaatttcttgtttttgtttctaaatgttaaaactttcaaagagaaaaaaaactgtgcagcaactatccacataatataaaggaataagaatctgtcaatataagttcattaaaaaaaagaatctgtcaatataaaggctacaaaacaccatctcaagccaagccgtctactcaagaaggaaaaaaggagcccatatggtctggtccaaagctgagaggctcacaacacaagcttgtagcccagcacaacctaagcctgatctaaagcaggcccagtccaaacttcaacacagctaaagaaatgtttggcataaatctaacggttggatggatgattaatggaacagttgttgctaatttgattacccagagttcggtttgctctcaaaattggattcatgagataaaaataagatgaaaaagtgaccaaccttgaccatacacccatgaccttgcccttcttgaccttaatgcagtgtataacagcccaattgaaaagataacaccaagcaggccgttgacatacagccactggaattgatatataggtgaactatggtctgcatctctaggcaccttgaattcctctataattccctgcaatagataggccctggtctaaatattttcttccaagatagaaagaactgagcttattagatatagcatactttaatggcttgttgcaggaacagaacagtaatcaacatcccaaaaagttctcctgcaacccttgtaaacctgctaataacattagaagcattgaacattgccagaagaaacaacatgagcgcagtccagatgcagaccctgtcaacagtaggcaaatcaggagagcattaactttttttctgaaaagctaacgtgatagtattcagattcagttgttaccatccagcccatgctaaatacagtcgttcccccagagcttgctggttcttggcaaagttgtagagatacgtgtacatgattatagttggctctgcaactccaactatcaacagaggctgccctccaagaattgaatgtatgatgccacataatgcagtagatgccagtgtttctactgtggtgagtataccatctgaaatgaaccacttttcttttattagaaatgtgattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccaccaccagtccaccaccaccaccaacgcgaccaaaacccaaacccaaacccaaacctcgcagttcagttcagttcgaaatagagcggacacagtgcgaaactccaaacaccatcactcacatcagtcgtcgagcaaatcgatggcgcgcgtggcggcggcggcggcaatgctggccgctcgacggcgcgggagcgaaaccctagagttggagggtggtggcggagacgcgggtttctgcgccgccgcggcgggggagggggtatttataatcgagggcgaatcgaatggacgccgcggagaagaagagaggaggagaagccgcggcggccaggaaaacgaacacgtttacctagaataaaaataataaataaataaataaattcctccattattttctagtactacgtcgtcactctctgacatgtgggcccatgtctgacatgtggaggaccacaaagagatacgcgtggggcccactagcgatgacgtggcggggatgggaggctctgccgcgcatggtagcagtagccgtgacaaggttgaagggtcagcggcttgtggcccgggggtgtatgtgtggctgcaggtggggccggatggtggtgacgcgtcatcgtccacccaggcatccactgttgcagggcgccgccacgtacgccgcggcccaagggacacaccaccgccagccaccgcgcatgtggttctcggtttctcgtcaaattaactgatgacaagctaaattggaagttttcaaaaacatgcaaagttttttcttgagtaaagtgtatagccggtccctaaacttatacgactgtgttatttgagtccccaaactctcaaaatgtatattcaaatcccaaaacttgttaaattgtgtcaatccgatcccaaactaccatgacacctccaggatcctacatggcatgccacccggacaatgatgtggcagcatcacaaattctacaccaactgacaagtgggccccaataaaaaactttttttaatatccttttttgttcattcccatcatgtcctttcttcgtttctcctcttttcttcctactgcattgaccgtagccatggcctctggtcgagctgtctttttgatggcatgaacagaggtgcgtccgtgggcaagaaggcaccggcgcagcagccgcgtcgacggaggcgctgcaacgtgtgggtagcggcgccagcgcagtgatggacgcggttatgtcctgggcatcgaggagactctggccgggagcggcgcgactgcgtgtggctcggcacgtttaccggtgaggccgaggcggggcatgcctacgatgttgcggcacagtagttccgcagccgtgacgcagtcgccaacttccgcccctcgtcaagtctgacccgaaggctgccgtcgagctctgtttcttcgcctcccggtcaaaggccgaggtcatcgacatgctccgcaagcacacctacctcaaggagctcgttgttgaaacaagtgtgccttcacctccatctctcatcacctgttcgacaagacaatgatcccgaagcaaccaaaccccgaagaggccgcgtcgccgcctgccgccgccgtcggtactggtgttgcgcatggtacacggcctgctcaagaacggcggcagtggcgttgtcatcgccgcgagggtggcgaggttggtttgccgttgcgctcgtcggcagcggagccgttctggccgaagcttagggttattgccgctgacttagacttcggaattcgtcgccatcgtcgatccttgtccaaaattgaggtcttcctcatcttctctatgccaaactccccccttcccctctcctccccgagccgtcctgctatcggagctcaccagcaaggtacccgtgtgctgcggtgccgcctacctgtttggccgccattgtgtcagcacggtgcaccgccgctgggcgtccctgcccaagccgagaacacctccggctccaagtcgacgccctgatgctcctaggcagccgtgcccagtcggaagctcaccggagcgccgctacttcgcatgcccccgccgcttgtacaacaaaaaaaaaagagaagagaaaggacaaaaaagtgaaaggagaaagagaaaagggaggaaaaaagagtttttaagtgggtcctatttgtcagtcaatgtagaggtattgatgaggccacatcagtgtccgtgtggcatgccacatcagcgccgtgtaggatgctggaatggtggtggctatgttggaccgaaatgacatactttagcaagttttatgacttgaatctgtattttttgagttcggggacccagatgggacgacgtcacaagtttagagaccgggagtgtagtttactctttttttatttagaaaaaatattggaaaataaaatttatttgaactttttaaagaatatttctatataattttttttttattaaaaaacttatcctaaactaatttaggaagcgtgcttatgacaaagcagcttagcgaagattatgtttaaaacacatcctaatcaaacaactggtacgataaattctgacactggtggagaaaccatctttcgtcggtcggccgaattccacaatagtcccggatgcaataaaaatcggggctaaagatgatctttagtcccggttcaaaagggtaacgggcatatttgatcttaacaccaaccgggactaaagatgatctttagtcccggttcaaatgctgtcagggcctgtcaggccccccgggatctttagtcccggttggtagatcgtaactttagtcccggttggtaataccaaccgggactaaagtctcacccctatatatatgtcttcttcctcctccagctgcctgagcaagcttcaaaatttcttcaaaaaagaggggaggtcatgctaaaatttctagtgaatttattttggtgattacatacaaatcggaggtgcctaaaaggtttgcaacttcatcctccaatatttttttgtcatattacatttgcagctatgttttgcatacttttttgtctccaaaaattagttgtaagttgatgagggagaaaatttgtgtggggaagaaagaatatatagaaatttagttgatttgctaaagaaagttttataaaatagttgagaaggaaaactatagtgaaaattaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgttattattgtaagaataattatttttgtatgattttttttcgactcatgtagatggatcggcaatggatgtacgctgaccggcggtccaaagagtttattgatggcgtgcactattttttgagagtggccgaagctaacaggcaaaggggttttatttgttgtccatgcaataagtgtaagaatcagaaggagtattctgcatccaggactattcatttccacttgtttgagtcgggggttcatgccaagctataactgttggacatcccacggagagcaaggtgttgaaatggaagaagatgaagtggaagacgacaatattccgaactttgctcagtacgttggatttgaaggaaatcaaacgggcgaggaggaaagggatgctgatggtaacgacgttgcggatgattttggtcagatgttgcaggacgccaaggaggactgcgaaagtgaaaagggggcccataaattggacaagatgttagaggaccacagaacttcgttgtacccaggttgcgagcaggggcacaaaaagttggataccactctggagttcttgcaatggaaggcaaaaaatggggttagtgacaaggcattttgcgatttattgaaactcgtcaagaacattcttccgaagggaaacaaattgcccgagacaacgtacgaggctaagaagatagtctgcccgctaggactggaagttcagaagattcacgcatgtccgaatgattgtatcctatatcgtggtgaggagtatgagaacctagaagcatgccctgtttgcaaagcactacgatacaagattagacgagacgatccaggagaagttgacgggcagctaacaaagaagacaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctccaatctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtatgggacgaggacaaacaggaggagtttaacatacgagcgctgctgttcgtaaccatcaatgattggcctgcacttagcaacctatccggacagtccaacaaggggtacaaggcatgcactcactgtatggatcatacagaaagtacggatcttcagccctgtagaaggttgcatacatgggaaatagtcgattcctagcagcaaaccnnnnnnnnnnnnnnnnnnnnnnnnnnnnnnnnnnnnnnnnnnnnnnnnnnnnnnnnnnn

SEQ ID NO: 25165 - DNA, 19477 bp, Oryza sativa
tatatatgttgattactaataaataacctctcaccacatgatggtggcatcgggcatggccatcccaacggacccttcaggtacttaccactgcaggccgattccagcaggatactccaaggtcgaagttgagttggtcgaaggcgcgtacgaggacctcgagctggattaccctggaggagacagtgatacgcatctatgagacacaagccatgccattattctatggcgcaggcggtacatcatcctccctgggcgacaagcggcgtctcgtgcaccatctcctccggctccgccatctcctcctcaggatcctgcaccgtctcctcctcatgctccaacaccgtctccacctcagactcctgcaccgactcctcctcaggctcctgcaccgactcctcctcgggctcctacaccgactcctccgcaagctcctcttccggcaccttcaaagtcaagggccccccaagctccaccgcctgcccacacaagggcaacgaagaaggcgaaagttgacgccgccaagaacaaggacccagggtacgattgcacgcaagaggagcttgacgcttacgtggcatcagaagtcaagagacaattcaagcctcgaagtccagaaaagaagattcctatagacccgagtgtcaggaagttctttaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtgaagaaatgacgatagaagaatttattactgacaccagtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgctctcgacgtctctattatgagttgctggattttgtaagtatatcgttcagttagatttcttactacgtctcctttaattaattaggtccttgtatataagtagactatagaaaataatatattctcttttatcgttgtagaatggagattcaaagggcccgacggcggggggttttcgatactggattcatcgaccctcggaaagtaaacatcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctacaccgtcaacgtatatgactcaatggataaaaaaagagtctacgtttgacaaggttttcgaacttatggacaggtattgtcataagttcctctgttaattaagaaaatcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatattgctccgattcaaatatatacaagtgtatattaattagatctctcgtcgtttgtcatttatttgtagtgcggaaagcaaaagcagggaactaacttgtgctgctattacgtgtgtgagtattgccactgccttgcagaccaaatcatcaccacaagagagctcgatgtacgtacaaataaattcaaaatttcattacgtatcgatttcttgtttaattactaatcaatttcatacattcatatagtttattcgtatgagggataacctgaccacacacaaggaatttatcgtggcggttcaagaacaacttatgggattcatcaacgaacaagtccttgatcccaagggtgaattctactacgacggaaacacaattcataggtccttagcttctgagctagcgactactacgtcgaaatcgtagctagctaggacatataatggattgtaattaatacatgactacatatgtttctatatgcatgtgtacacattttctataatgtaaatatattttggtcacacacacacatatatatatatatatgtatacatatatatatatatatatatatatatatatatatatatgtatatatatatatatatatatgtatatatatatatatatatatgcatatatatatataaaccctacagcaacagagccatgaaaaaaaaggtcagctcgatttttagtcccggttggtatatctttagtcccagttatttcatccgggactaaagatagcgatctttagtcccggattggtagtcccggtttgaaaaccgggactacaaagggtttctccaccagtgtgaagtccaaccaatatccactttcggtcttgctatgagcttgacgaataaaattttaatatatacttttatttttaacgttttgcttttatatacatgcatagaaaagagttgtgaaaatatatctctaccctagaatggagatgcgggatcaaggcagtgcttcccgcgcagcgtccgcgtggcaccgttgctcccgcggaacgtccgtgcggaaccgtcgttcccgcacgcaattcctcgctcccgcgcgaccggcgcggtccagcgcgctcatgacgcgcggccggtgcggcaaacaagcacatatgcatggatgtgcatatgttgcatacatgcatgcattcacgttgcatgcagcgatgacggcgcggcggttccgcgtttccaggctgcgggatcgataggttccgcactgctgttttgcgcgaccgctggttccacaacccttatgcggtagagatatatttgtgcaaaatttcatcgcattggtatataaacacaaaataacgaagaaaaagatatattgtgaaattttttcctgggcttgaccaccatagacaaacggtgaatctatgccgaatgcgcttacttagctgcttccacgaaagttgccacatgatgccaatttttagcaacccagccaaagactaagaacttgtttggagtgaagctaattattttccaaccaaaattttagcggcctaaatagtattgcattgatgtttagtttgcttttttttccctcactaatataaatttatggtaccaaattttgtagtcgcagaaattatcaagattttagcaccatcaaaaaaatattaacaggggaaaatttagctccaaatcaaacaagtgaaaaaaaaaactttgtgccacactaccacacccctacagtgagagtgtgttcttagttcagcatcacctctacaacgtattctctccgtccataaataatcaatctaatttcaaatatgatatatcatattactacgaatctggataaaaatatactccctccttccctaaatatttgacgccgttgatttttttaaatatgtttgaccgttcgtcttattcaaaaacttttgtaaaatgtgtaaaactatatgtatacataaaagtatatttaacaataaataaaatgatagaaaaagaattaacaattacttaaattttttgaataagacgaacggtcaaatatttttaaaaaagtcaacggcgtcaaatattttaggatggaggtagtatgatactagcttgattttttttatgagtcaagtcaaaggaagtacttgtatttggaataaccccgagcggtagctgatttgaacacggaaagctgtgaaggtcaattagaagaaggccctatgtgcttgtctcggcagaataagattcacttgtccccatctccagatgacctgatcttcgcttggttgttccaaccgaaatccttgcagccaatcaaatgcccagaaaaaaactgggatattattaccgggaccgtcaaaacttcccagaagatagtattgtattcttaacccaagaacgatcggagtggccggcacaaattactgtagtggaattccggaagcttatgttgacacattgtcaatttgttgataacaaacaattactaggttttaatatattttttggaagatgtaaaacggctgtggattgatgcagaggtccaaaaatatcattctcgtttttcaaaaccggaaagtatttttctacccatcgagacgtcactgaaaataactactcaaatgtatggttgcaatcaaccaaaaaaacacccaagaaatgctaacttcggctatagggacttgatatcccacggtatccacaccctatagaggatcttagctatagcaactagctcatcatcttaagaccacaaccttttttttcctctgctattatctaaaattctaaaatttttgtttttgaaggatcacattttgatactttctggtagaagtgaacgaaggacttcaagccaagaaaaatgaagtgacctctaaaattgaagggacaagacttgctcctgaattgtactttatgtttttttttctttctgtggccggtaatcacttgtaattcaagcctgtaataaggcacaagagagcaactgcgtgctggccttttgtgaggttttcagttcgaattttgcatatttcagcgacagctagctggagttgtcagttaccattcgccagtaactattgtcagtcaccattcgccagtaacggctcaaattgcaaactatactctgattaattgtatatctaatgactgattaattgtgtaccttctctggactttctggtccctcgatgaatattcagtgggtacgaaagctctccccgcccggttatcctttcaggaaaagaatgtcatcgggtggacaaatcaaaacctaacctcttcgatcggatgaaaccttagccaaatgttttgttggccacaccttagctgattagctgagatcgaaaaaaaatctattacctatacctatactaatcaaacttcctgagagctcccggttaaaagaatatatgatcgttaatttgatgggtcgtataggttggcgactagttataacaatacatgaaaagtatggcataatataaccttgacaataaaacaaatctttcggaggtaattttttttgagtcacaagaccgcgggtagattattcaatttcagctaatttttatcctgttaattaatatatcagtcaataattagataatcagtatgtatagaaccccgtaatttttggaatatgtccgccgtttcatgagggtgagttcgtgcgtgttacaagcgtatgcatttataccgtgtttctaaaaagtttcttttaaaagtttgataatattttggcaaacgataataatggaccagacaaatcttacaaaatcagatgagaaacaaaatactcttccgcgatactcctatacgactatctcgtcagtttggtggaggtatgaaaacatgaaatgtgcatcagtttcttttatttttctttttaatttttaggaactgtgtaccagttgttgatgcgctataggtaaaatatctggttgttgtggatactcctatatggctatatagcagtactttacatagtgcggagtattacgcagacataacaaaagcgtacaaagtacaccgtctgtgacttaaattaggctctgttcggcaggagggattgggaacccctctcggcacgtaaaacgatgtttgtattaacgcgtaattaattaattaatagctatttttttaaaaaatagattaatatgatttttttaaacaactttcgtatagaaactttttgaaaaaaaaacacaccgtttagtagtttgaaaaacgtgcgcgtggaaaacgggggtgaagagctaggaacctggggatcgaacagagccttagtagagcgagtacaataaaatcaaagatcctttcccttaagaaaagtcgtgtgttctgctttgatcttcaatacggatatttggtcatagatacgtgacatggatgttgttttttctttttctaagtataacctttcagaactgtagacttatattttatttctactctatcaatacaaaacgtcacactatcttgtgcgtattatttaaaaaataaaattacatgagcgtgctatacaagttatcacatcaccagtgacgtatatagaaattttatatgggtgatccaacttatataaacttttttaaacaccctaaatgtaaccaagttagaaatataaattggtcaaatatgcataataatatatcaataaaaaaaactttttaaaagttttttttcacatgtgtatatatatatgcattggattaggattttttttccaagtgagcactaggatcacccctagattcgcacacgcacatcacatttgtgattacatggagaagagatgagagagaagaaaaacgtgctacagattcgtaaccagctacaacacattctgtaataaactatctgagatcgaatgaattaggtattaatgatgcagtatatatatatatatagctaataattatatgaatggattattaaataagttgcagatgatattttaattttgagtaaagtccatcaccagtccctaaacttgtacccctgtgtcatcccggtccctaaactcgcaaatcgaccgttcagatcctcaaacttgttcgactgtatcatcccgctccctaaacttgcagatcactcgtttaaatcctccaacttgttcagctgtatcacccagtccctaaacttggatttgaatatcatctgtgtcaaataggacggtgtaaagactttatatttaaaaataattcataacttttatgtgaactctaataaagacaaactttatatcaaacttgtagccctcgacacgatctacaactttgtagttgaattttttttattttaagtcatttttgttccaaaatgtaattttaaaattaaaatttcaaaatctataaatatgcaacaatattttgggaccctaaacagttttaattcaaaaaattttcaactacaaagttgtaggtcgcgtcgagggctacaattttgatataaagtttgtcttcattagagttcacatgaaaaagttatgaattattttttgatataaagtttttagaccgtcctgtttagggactggggtgatacaactgaacaagttggaggacctaaacgagtgatctgtaaggaccgggatgacacagtcgaataagtttgaggacctgaacgatcgatttgcgagtttagggaccgggatgatacaacggtacaagtttagggaccggtgatggactttactctttagttttttataaagttagtagttgattatattattaaaattgctcgtggtatactaagaaaagtaggagccttttacacgatatttgcgtggtactttgctgcgataatattttactgtcccgtgcaattaattattctgtgaacaattaaacaggaagtatatatgcatgagctaagcggtgacgtacggtacatccatctgttgaagttataagcacatgatgattcgagtactcgctaggcaaggcataaacagattgatcgtcctgagaattatcacaggccatatgcttgaattattgatgcaaaaagattgatcagtctgtggctctgtgcaatgagtgcggcacatgacattttctatgctgtcagtcaagaatctttcgaagagatacatgtagatctcattagtcaagatcacaatgttttacgtttttccgtttagcatgcaggagtagtagatatttgtaatgcaatacaaaattaatggccaaacgaatgagtggtcggctgtatgatctcacaaatcatgggtttttttgttctttttgcccctcaagagtaggccctgctcgtagtgctgcggattataatccggaatcattttgaatttttatggattggttttatggtttctttttatcaactttcattactgtcccgctctgcttttatgattgccgaaaagattgttattaaaaactaagaatttagaatcattatatactataaacactatataaacaaactaaacgtaaattaatcatcttcaccagccggcttgcatgtataaattcatcatgtacttcaaaacatatttaagaagtttaagattataagaaatagctgattcgtgtagtagtaagtttctgagaatttttttaaaaaaatgtgtttcttagattttgatttctagtttattttatggattctataattatagtttttttaatctaaactgtttggagagcttctgattatagaagttgtagtagtctggaaatcaagccggcactgtcttttattgagctgtgattgaaaataattttattacaatttattacatttttttaaagccaaattttaataacgagctagcgagtccaaatgaagcaaacacaactttcatgcaaaattttatcattttagttttatataagaaaaaaacatatcacttgacaaaattttgacttgtgcaccaatctcactaactgggccgatcgacagaaaagctatctcatcctctttttacggcccaatctcactaactgggccgctccacgcatacacgtcccagcccaaaaccctccctgcgtaaataggccgggcctaatcactttaagtgggccgggcctccctctcctgccgcttcgtcctcgccacctccgccacttggcgcgagattcctatcgcgcgcagacgcgccggctagctaagtcgcgagcgttttcggcccatatcctcgcgcacggcccactagctacatccttctttttctattttttcgcaacgaagtgcgcaggacttttagaaaaaatcgtatacgtaattagttatcgataattatggtatattaagctaaccattctttttttctcagcaaaaaaaattgaaaattttgaaaacttttaagtcgaattttgaacttttaagttaaaatttaaaaacttttatctcaaatttaaaaaaatttaacccgaatttaaaaactttcgacctaaattttaaaaacttttaactcgaatattcaaatcttttgaccgaaatttcaaaaactttcaactcagatttgaagactttcaactcaaatttaaaactttcaacttaaatttgaaatttcaagtcaaattagaaaactttcaacttaaaatttaaaaactttcaattcaaatttgataactttcaaatcaaaattaaaaactttcaattctatatttgtaaagagatatgccaaagattaaaaaaatcggaaaagaaacaccgaaaaagataaagaaaaaggcacccgtaagcaccaaaatcggaaaaaaaaaagtgcaaaaaaaaaagacaagggagctatagggtggggcagctggcgtgcgcgccagcaatttagctggcgcgtatgcgcgcagtagccaccccccacgtggcggatcatgtccgtcaggtcggcgtgcgacgacccggctttcttcaccgccgccctcgccgtcgcggcgagcttcctggcgcgcgcccttctcgccacgccgtccgcgccgccgtccatcagctcggccaccgccttctccacgccggcgccggtgacctgcacgccctcggcctcggcggggaggtacatgggcggcgccgtgacgcccgaccggacgccgacgccgagcacgtcgacgagcagccgctcgctgctgaactggtcgaggatggtcggccatgtcagcgccggcacgccgcgggcgatggcctccagcgcggcgttccacccgcagtgggtcaggaacccgccggtggccgggtgcgagaggatgctcacctgcggcgcccacccgcgcaccaggacgcccctgtccttgacgcgctcctcgtatccctcgccgtcgagccactccctcacggcggcggcggcggccttggcctccttgatggtccagacgaacggccgcccgacgccttgacgccgcgggcgagctcgatgacctgcttcgccgccaggtgcgagatgctgccgaagctgatgtacagcacggacgccggcggtcatgcgtcgagccaggagaggatacgcccggcgtcgacgtcggcgcggttgccccggttggccctcgcgtcggcgtccgtgctggcggcggcggcggcgcacgtcggcccgatggcccacgccctccggccgagcgccgccgcgtagccgtcgacgaaggcgccctcgatgtcgcggaacgtgttgatgacgaagccatcggcggtgcgctcggcctcgaccgcgtcgcgctcctcctcctccaggccaggccactggaagaagcggcggaacgtggccgtgtagacgacggcacgcaccgggaagtccggcacctcgaacggctccagctcgccgtcaccggcggcgagcgcgaggcggccgtacacgccgtgcttgctcaggttgtgggtggcgaggaggaagtacgccgacgggcagtgcatgacgacgcgagcgatgccgaggcggtcgcagacgggcgccgtccacgggttgcagtagtcggcgacgaggcagtccgggcggcgaggcagcgcccggacgagccgctcgagccgcgccgccatggcccagatggccctctgcagggacaggtacatgccggggtcggcgtccgccagctggtccatgttctccagcccctccggcacgccgaactccgggccggggaaggcgacctcggcgaggtcgacggcgaggccgtcgcggcgggcggcctccacggcggccccgttgcgcgcggcgttgacgggcgtggtgacgacggtggcgcgcgcgccgcgggcggcgagaaggcgcgccacctccaccatggggatgatgtggccctgcgctatcagcggcaccaccaagaaatggagctccgccgccatcccgccgccgatgagtgtgaggaagcaagcaagttgcagtgtgcgtatacaagtcgacgcgacgaggacgacgcctgtgtcgaggcgccgcgccgcggcggcagaagcctcctggaaaagtcgggagggaggggtgatgacgtatgcgcctagcgaagcttcgtcgtcgcccgcctcgtagtcttcacagctgcctctgtcacgtggactcgtggctcccaagtccaatttcaacaagaaagttttttttaaatgcaacaaacaagaaggtaattaattgagttttaattatttcaaatttaaacaaggatttctttgatattttagagcagtttttatacagaaagttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaacttaggacattaaatccactggcttataaatcatataagccaataagctgacttaaaagtctaggccaataagcctaagcctaaacaaagagggcaatagccatctgcttggctttcttatataggccgtgtttagattcaaacctccaacttttccgtcacatcaaatgtttagacatatgcatggagcattaaatgtggacgaaaaaaaaccaattacacagtttgcatgtaaatcgcaagacgaatcttttgagcctaattacaccatgatttgacaatgtggtgctacagtaaacatttactctactagtgacggattaattaggtttaatagattcatctcgcagtttacaggcagaatctgtaatttgttttgttattagtctacgtttaatacttcaaatgtgtatccatataattaaaaaaaatttagcacacgaattaaacacagccataatgagtttaaatgttagcacttcaaatcacatgaaaccaaggttacccttatcgatgggtttattgcacagttgccatgcggcaattgcggtaaccacaacaaaccatagaagccatacaaaatttatcaaaatttcagactattttttgaatctatttaattttatttttggtaccctagcaataagcacagttaccgtcagttttataaatcctgcttggaagtattttcaagctgttcattgagagagacaatagaggaatatctcatactcctaccttcttttggaatttcctctgaccaatttcgaatggatagtatccatagttcttctagaacttccattactacacactacactcccattcacgaggtcaggagtccatagatgacgagtgaacatgcgtcactccaagttgaaagtttattttgctattttcttctccggcatgatcgctccatccggcaagttgatacaagcaaaccggccctccgattgtttaatcgtccacacgtcactctcctttgatccgaagctcattgactcaaacgccataaaacaacttcgccacaattcactagcaacaaaccacagccatggacgacgacaccgccggccacgcctccggcggctacacgacgacggcggcggcgcacttcgtgctggtcccgatgatggcgcagggccacgccatccccatgaccgacatggcgcgcctgctggccgagcacggcgcggcgcgggtcagcctcgtcgtcacgccggtcaacgccgccaggatggccgggttcgccgccggcgtggaggaggccggcctgccggtgcagctggtggagctccccttcccggccgccgagttcggcctgccggacggctgcgagaacgtcgacatgctcccgtccaaagacctcttcagcaacttcctcttggcctgcggcgcgctccgggagccgttcgcggcgaggctccggcagcaacggccgccggcgagctgcatcatctccgacatgatacactcgtgggccggtgacatcgccagggagctcggcgtcccatggctcacgttcaacggctcctgcaccttctcctcctttgccaggtaaaaatcgtagcaaaagccactggcatatttctctgcatatgaataagggtatcccgtcatttttacatgtcacttaaaaagtcatcaaaatattttaaaaaaagtttggtaggatagatcaatatgtgatatgtaacttcacgagcatgcaaattcaaattcaacctatacaagtggaaataaaaataataaatttgactatgaataggacgcgcaattcacggtcaaatttgttatttttgtttcgaattgtataagttgaattttaactcgcatgtttgcgaaaagatatatttatatattgatctatcttgataaatttttttataactttttaaacgacatgtaaaaaacgaggggatatctcctcgagggacaaaaatctactttccatatgaacagagaatacttactccctccgtcgtgtccagatttatagctaaaaatgcttatattctgggatagagatagtagaaggagatacttatcaggtatgtgatctaagaactcacagtttggatgtgacctaaggttgtgtttagatccaaagtttggatccaaactttagttcttttccattacatcaacctgtcatacacacacaacttttcagtcacatcaccttcaatttcaaccaaaatacaaactttgcgctgaactaaacacatcctaagaacttggtccaagtttccaactatctcgcagggacatcatttatcgcaaaaatctattggagaacctcacggatgatgagatcgtcaaagtctcagggttccctacgccgctagagttgccaaaagctagatgccctggaacactgtgcgttccaggtctgaagcaaataagtgacaagatttacgaggctgagacgcgaagcgatggcaggatcatgaatagcttccaggagatggaatctctgtacatcgagtcgtttgagcgaaccataggtaagaagatctggacgatcggcccaatgtgcctttgtcacagagacagcaacgccatggctgctagaggaaacaaggcgtcaatggatgatgcgaaatgtttgcaatggcttgattcaaagaagcctggttcagtgatctttgtcagctttggcagcctctccagcaccgaccctcagcagcttgttgagctggggctgggacttgaagcttccaagaaaccattcatctgggtgatcaaagcaggaaaaaagtttccagaagtcgaggaatggcttgcagatgggttcgaggagcgcgtcaaagacagaggcatgatcataaggggctgggcgccacagatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaagcaagaactggaggatcctattgtgcttaccctgattttcatccctcaaactataaagaactgtactctccctctgattccaaatataaatctttttatacttgtgcaatttgtataagaattaataaaaacaactctaatgaatttgttgcccttcatctacagtatactatatcaagaaagataaattatttatttttaagagggatatagcatttatttagcaaccacaaacattgaacaatagtaaaaaaaaattgctaagaagctctgaaacgatatatatttgggtaagaattgagaaagactcaaatgacttacatttggagcccaacagtcccaccagcttctgcagtggacgaggttcccaggaccccttgcggatgagaagagtattctacaaatgatcagtgtatagagtggattagacctggtcttacatcactttcgtaattgctgcttcgattcctctgaatatatgaatgcaaattttgtggtcaaagtcaggcatagacttataaagatcacaaaaggaatttccttgtaccagataatgcagaggccagggagtatctttcgattttaagtacgtactgtattgatagcaactgtggcctctgtggttgcataaagaatggaagaagcttcatgtacgagggatctagccacgagtccatgactagcatgcgtcactgaaactgaagttgccaaagtctagcaatactgttctttttcagcacgagctcgaactggccgagttgatagtagtacaaactgttggcgctgcaatactttcaacccgtcactttcctctgatccgaagtggcaggcaccacatatgcactcctcggttgctgtcaagtgtcaagcttctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgaccagcagcacaggtgctgctccaggacggtgcacttcgtgctggtcccgatgatggcgcaggggcacaccatccccatgaccgacatggcccgcctgctggccgagcacggcgctcagatcagcctcgtcaccactccggtcaacgccggcaggatggcggggttcgtcgccgccgtggaggaggctggcctgccagtgcagctgctggagctccccttcccggctgctgatttcggcctgccagacgggtgcgagaacattgacatgctccagtgcaaagacgacatgaggaaattcctcgaggcctgtggcgcgctccgggagccactcatggcgaggctccggcagcacgacctgccgccgagctgcatcgtatccgacatgatgcactggtggaccagtgacatcgccagggagctcggtatcccctggcttacctttagtggcttctgtacctttgcctccctcgccaggtaaaaatcacaggccactggcatatttatctctacaagaacaacaaatagttagaattgatcaatagacgaggcaagacatgagaatgatattggttaaaggattttaatcaaaaccacacattaagccttttatctaaaaaatacttcaggtcaggttggcaattggttggcagcactactaactcatttcagaaaatagaaaaacttttcatggtatcttaagaactgccggttggatgtgttttaagagctaagactgctatcttgaagggacattgtttaccgtaacaatctattgcgggacctcactgatgaggaggaggtcgttaagctctcagggttccctacgccgctagagttgccaaaagctagattgcctggaagcttgtgcgttccaggtctggaggaaatccgtgagaagatctatgatgaggagatgcgaagcgacggcaaggtcatgaacagcttcgacgagctggagactttgtacatggagtcctataagcaggtgacagataaggtctggacgatcggcccaatgtgcctgtgtcacagagacagaaacacaatggctgctagaggaaacaaggcgtcattggatgaagtaaaatgtttgcaatggctcgattcaaagaagccaggttccgtgatctttgtcagttttggcacccttgtcagcaccgcgcctcagcagcttgttgagctgggactggggcttgaagcttccaacaaaccgttcatatgggtgatcaaagcaggaaataagtttccagtagtcgagaaatggcttgcagatggattcgaggaacgtgtcatagacagagggatgatcataagaggttgggcaccacagatgatgatcctgtggcaccaggccattggagggttcatgacacattgtgggtggaactcgacaatagagggcatctgcgcgggtgtgcctatgatcacatggccacactttgcagagcaattcttgaatgaaaaactggtagtggatcacctgaaaattgggatggaggttggagtgaaaggagtgacacagtggggaagtgaacaaaaagaggctcaggtgacaaggaattctgtggagacagcagtgtccacattgatgaatgagggggaggctgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagactgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatcggcaacattccactttcctccgactccgagatccgaagcatcaggcactactccgtagcacctcaaagcaagtactatgagcatccaagcacaagccccaagatgtcacataggactaaattgtgaggtggaggagagaagaaggatgagagagaaatagtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacgacttctccagagttattgcatacctccgcttgactagatacaaccacagccatgtcctccgccggccacgccgtcgaccagcagcgcaaatccaccacgatgaaggcgcacttcgtgctggtcccgatgatggcgcagggacacatgatccccatgaccggcatggcccgcctgctggccgagcatggcgcgcaggtcagctttgtcaccactccggtgaacgccgccaggatggcaggttcgtcaccgctgtggaggcggctggcctggcagtgcagctggtgaagc

SEQ ID NO: 25166 - DNA, 379 bp, Oryza sativa
tcaccactccggtgaacgccgccaggatggcaggattcgtcaccgctgtgaaggcggctggcctggcagtgcagctggtgaagctccccttcccggccaccgagtttgggttgccggacgggtgcgaaaacctggatatgatccagtccagggatctcagccgaaacttcatggaggcctgcggagcgctccgggagccgctcacggcgaggctccgtcagctatgcccacctccaagctgcatcatatctgacatggtgcagtggtggaccggtgaaattgcaagggagctcggtatcccaaggctaacatttgatggcttctgtaccttcgcctcccttgccaggtaaaaatcatagaaaaagcaagttttgtgagg

SEQ ID NO: 25167 - DNA, 1213 bp, Oryza sativa
  unsure (1)..(1213): unsure at all n locations
nnnnnnnnnnnnnnnnnnnnnnnnnnnnnnnnnnnnnnnnnnnnnnnnnnnnnnnnnnnnnnatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaccttcttgcagcatagcatccttcaagctctttaactccttgtcaacagaatcagtctgcaggacaatttttgacctataagttgatttacttgaacattttccatacaagactaacagtggcatctacattttgaatagttactgaaagaaaaccaaaagtatggggactcctcgtaaggtgaaaagtaaggtgttcaggcaattacatgagcttaggactaattttcttgacaactgatgtagtaattttgacaggaactggcattgacaatagaagtaaaatgcaccaaataaatggaagaggaaattatatggtaacatacatcagtaatgaagaagtacatactcacatttttttcacagtccatctcaatgaaaaccccttgcatcttgccatagatttccaaactgctagcacgattcatcaggccttcgttggcagtttgaaccatctttttgcgtagcagctaagcaaacagaggaagaagatgggtgagctgatgagcaaatatggatattgtagcaaacaaaacacttcggtctgaagttcaccaacctgccccttaaggacagcaaggcttcttgtatgcatcggggactgaggaagtactccattagatggagggatgccaatcaaaccacaaagcaggacctgcatcatttttatactactatatgagaagaggagcatgtcacagctttggtctattacaccacaaagcagaatcagtgtccaatactcctatcaaccatcaccttgtagattgcagtagtgccaggttataatcacgcaaaaaagaatataagatattatggatgttggattttcaatcatacccattcaattgttgtaacaaataccaactctactttaaaatatatgagaatatttcttattcattttttttgaacggaaatatttcatattcataagactatactaaaagattttggctagttttaggctagaagtgatagagaaatgaaattgtcactgag

SEQ ID NO: 25168 - DNA, 891 bp, Oryza sativa
aaaataagctctttcttaaaactagttgggtggcccgcataattgcgcggctagcacccaaacaaaatcatatatttttcagtatgatttcacttaaaatttattaaatagctatccacgtatcatccccatatttctaattacgtagcttttaaaagttataccagctgctacccgttacttctgtcatatccttttttatttgcttgctcggtctaccactatttctatttattcttcttgaaacctttaaaaattagatcttatagttttttgagtttattatctcgttgggtttcgtttttataatttctggaagtcccatcaaacgctgccattatactcctttacggcccatccactgtcttttctctttattgtcattagaattttacaaatcgaacataattatcgttcaagtttatttttttactttctataagtcccgccaaaccgtcagtggctttgccattgtactcctttatggctcacccggtgtctcccttctttattctcattgagattttaaaattatacatgattatcattgggtttttttttttactttttagaagttccgaacctttaaaaattggaccttgtagtttttacaatttattgtcttgttgggtttcattttttaattataatttttagaagtgacgtcaaatgatgccactatactcctctacgacccattcgccgcctactctttattgttattgggattctgaaattcgaacataactatcgtttcaattcattttttattttctagaagtcccgccaaccatcggtggctttggaactataatcctatacatcatgcccgctgcttctcttttttattgtcattgagattttgaaaatcgaatatgattatcaatgggg

SEQ ID NO: 25169 - DNA, 8136 bp, Oryza sativa
attcgactaaggagaacaataatccggatgctgatggctacattagcaacccttacctgtccattgcaacggctagggactcgctgaggcaaagggaagaggccaagaagaagcaagctgagctcactgagctggagaacgaggccactgagctgaagcagaagaatgaagaggagcgggtggccatccaggacatggaggccctcctcatcaagaggcggcggcgcgtcgagaagtgccgccgcttggcggaggctcagtcgaattacaaggctgtgctggagaagatgatcagagacgccatgcaccagtaaggatgaatctatgcagcaagagccaagaactctcatgcagttgatttcaatgtcgattgtttgtgctaattgttgattgtggtgcaaaatgtgcaggtctgttgtgtacaaggagcagcttaggatgaaccaagctgcaacgagcactctcatggcgagactcgaggcccagagagcaatgtgtgactcatccgaaaccgagctccggaggaagtaccagcagaaggatgaactggagaagcagatcaagcctttcaccgatcaagcaaggaagcggtatcgtgttgacgatgatggattgctagaggaaaggcacagcttagaagaaaggcacagtgaaagggtgaagtattttccaggaataagactgaggagcagaaaccctctcaagcaggagctgagggttttcctggaggaggaccagagggcttcagatgcatacatctccctagaggaagaggaaattgcaggtgaaacttcaacaatgggaaatttcaggaattcacctttcaaggtgataaacttcccaaggaggtccatggaagacaacacagttgacactgagagaggaagagcatcagtgagggagaagctggagcatctggcgatcaaagaacggcagcgcggcagaaggagagaaaggaccatgtcatcaaggggatcaagggcaactagcactcctgtgaggtcaagagatggcaatggcaagggcaaagcagccatggtgcaatgtgagtctgagactgaaagatctcagacagtttcagtgccaaggacatcctcagttcctccaagtcctccttacagagtaactggcatgtatggaacacctagatatcctgcagagaaatcggtgctattgaaaaagaataatgtgattcatcggcaaggcgtcggtcgatccgaaggcgacgcaaacatgaaccacaccggcaaaggaactgtggataagtggcttcaaatgctcatggaggatcagcagcagcaagaagatcctgcagcagcatatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccagaacgtgctccacttgaagaacccgccgccgccaccgttgccgcctccgccgcgccggcttctttccgtgctcagcctgtccacctgagcctgcagcgcgctgcactggacctgcacgtcgcgacgaagacgaggacgaacacctcaaaaagctttgaatcgaatcgatgaacggcggcgagcggcggcggagatggccgtacctggaggcgggcgaagtcctcgcggaggcggcggagctcgtggtgctggccgagcacctcgcgcttggaggggcagcgggcgccgggaaggtcaaacgccgggctgggcgcgccgaaggaggaggcaccgccgctgagctcggcgaggcggttgagcttgccgtgctcggagaagagcacctgcagcacggagcgcacggggaggcggtcgttctggacggcgtgcgccgccgcctccgccgtcagcttccgcgcgtcgatcagccggcacagcgacttcctctcctccttgctcgtgctcgcgtgtgcctgctcaccatgaaacagccaaaaaaaattagctctttcttaaaactagttgggtggcccgcataattgcgcggctagcacccaaacaaaatcatatatttttcagtatgatttcacttaaaatttattaaatagctatccacgtatcatccccatatttctaattacgtagcttttaaaagttataccagctgctacccgttacttctgtcatatccttttttatttgcttgctcggtctaccactatttctatttattcttcttgaaacctttaaaaattagatcttatagttttttgagtttattatctcgttgggtttcgtttttataatttctggaagtcccatcaaacgctgccattatactcctttacggcccatccactgtcttttctctttattgtcattagaattttacaaatcgaacataattatcgttcaagtttatttttttactttctataagtcccgccaaaccgtcagtggctttgccattgtactcctttatggctcacccggtgtctcccttctttattctcattgagattttaaaattatacatgattatcattgggtttttttttttactttttagaagttccgaacctttaaaaattggaccttgtagtttttacaatttattgtcttgttgggtttcattttttaattataatttttagaagtgacgtcaaatgatgccactatactcctctacgacccattcgccgcctactctttattgttattgggattctgaaattcgaacataactatcgtttcaattcattttttattttctagaagtcccgccaaccatcggtggctctggaactataatcctatacatcatgcccgctgcttctcttttttattgtcattgagattttgaaaatcgaatatgattatcaatggggtttttttttcactttctagaagtccggcaaccatcttacacgtttgcttcatggcctgcctatcatccctccttttaatcattattaagattctatttggtgttttactaatagtttttatatgtcgtatcaaccgccaccactctactcttttataggcttgttacttaatttatctcatcgtatgttttatatggtcttttttttcaatagtctttatttttatcaccaattttagttatttataaattgtattcctaattgaaatattttttatttttcttattttagaatttattttttaaaaaaattatttaataccatatagcattcttttaatatttttattttttatttttgaattttagttgtttcaaaattgtattcttacttgaactctcttttagtttttctaattttggatattattttatttctttattctgaattttaattaatctcgtattgggttattatatggatccttcttttaatattgcttatttttaattccgaatttcagttaattttaaattgtattcctacttgaactcttattttctttttgctaatttcggattttatttttatttttattccgaatattaactaatctcgtattgggttcttatatgtactcttctctcaatgttccttatttttaattccgaatttcagttaattttaaattgtattcctacttgaacttttattttattttctaatttcggattttattttatttttatttcgaattttgattaattttgtattgggttcttatatggacacatctttcaatatcgcttatttttaattccgaatttcagctatttttgaattgtatttctacttggactctccttttctttttctccgattaatgtgagaatttctagcttccacagcgaacgtggtgcctcctttcaagactgttttaataatataatagatagattatttttcttttttcactaatgcgcaaaatgattacatatcaatataatagaagaagaagaaaagtaaaatagaagaagaagaaaagtaaagtttaattacacaacacaagcagcagaaggctgttgtcagtggacaaggatagaagaaccgaaaacaagtaacaaacaaaaatgttactccttccgtattttaatgtatgacgtcgttgtcttttttataaacgtttgacctttcgttttattcaaaaaatttatgtaattataatttattttattgtgacttgatttatcatcaaatattctttaagcaagacataagtatttttatatttgcataaaaattttgaataagacgagtggtcaaacgttggtcaaaaagtcaacagcgttatacattaaaatacggagggagtactagctactaagagggaaaaactcctatcgctagggaggttgaggggtttaaaatcctatactcccaaaaggcccccaaaacaagtggcgccaacagcgaaccacaaacggcctttttttctttttaaaaaatattttttgcacttgaaaaatcatttctcccatgatttcacagcactttttgctcaacaaagtgtaaatttattctagacaaaaaattttgaagaacagaactgaacaaaagatggcatcttgatatttggcatagtgccattggcatgaacttgcatggcctaactgcctaacatatgattggttttgacattgagaatctttcatttgcagacagcagcaacaatgctgagttgctggcatttctgatgaacaggggatctgtaaaagcgcagagaacagcagaaacagaattccacatgatttttgtttggtgtcatttggatctgaaactctcagcactgtcaagtcctgacatgtagagccatgaaattgaaagatgaatctcctggctctgttatacagtagtctggtacgatggttgttaaagactgttaataagtaccacctgcatgactgttcatgcctgcaagatctctgatacttgcatgtttatctggcaatttcaatcatccacacgtttttagagtactaaggtgtgtttagttacacgtcaaaatcggaagtttcattgaaattgaaacgatgtgacgaaaaaaagttgaaagtttgtgtgtgtagaaaagttcgatgtgacatatttgggttcaaactttgaatctaaaccaggcctaggagtatgatcttctctcttagtactctttggacactcgtttgctcggttgataaaattgaatgaaacaactaaaaataattaagtacaaatgtggttttttttgtttgttgaaacgcgcagctacagtaaaactgcttgttagtcactcgcaccaggacaaagcacaagtgttgatgagaacagcaggcagcaagctaagggacaagaaggatttgatatccacaaagcacctattcccatgtgtaaatacaggtaaacctttgttctttagcagtttggagctcacgtgatctcttccctacgctttgttcttaccctacttcatagaagtactccgagttacgatttatttttttttcagaaaaaaaaactacaagtgatttggctgaacaatcttcagatattagtaactttatagtttggacactacagtaaacaccaacagaacaaacacaaagaaggatcttaatggccttaatgagctattttagttttatatattagtgaagtgggagaagcaactactgatatcaatcattcagttcacaagctaacaagacaaaacaaacccaagggagaaaataacaggtcttatcagttgtcctgattctcctcctgttgatatacaatattacacaaattttgtttcttccaaagttccaagcctatatctaattggtttattttgattgtgcaccctacactaaactttatacttatacttgcaaaaaaccaaaaggatgtttagtgagtagatgacacacaagattctcttcgacagagaaaagtgagcacccgtactaccaaacggagtatgtagaatatgctatgctgttagtgcattgtccgatgcaatttcagtggtcaaacacaaaaacagatgcagtagacgcctcacaaattttcaggctgtctcgtggcgattgaccaaagaacaaaactccccatttggttcagtacatttatattgaacatgcatgatgcatccaacgttggcacatcggccaacacatttgcatggttgcatactttgcatatgctagctgctactagtgcaaacccaacacaccactagctaccatgtcagctggaatttaatttcttgtgaaagaaaaacaagaatttcaccataacagtcaaatcaaaatattctattttgcgagtaaaaaaattcaaaaccttctttttactaaatgttgtgcatattagttacatagttataaaatattctgaatgaaataattcgtgtttgctaaaattatgacaccatattttttacggctactttcaatatgtttctctctcctatcccattttagttctaggtaggttattgttattgttgttgttgttgttgttgttgttgttattattattattattattattattattattattattattattattattattattattattattattattattattattattattattattattattatattgtacgtgtactgcaaatttaaattacagtgtaggttttaaaaatgttataatgtaagtatatgtaatttacagtgtaataaaattttgacaattttttcttaaattgtaacgccatgaatattaaaatgtagctagctggtcccaaaataattcacaattgttttgacgatatgtagaagatggtgatatcaattttttgaaaccgaaaagattgcgacatcaaatttgtccataaggtgtaaaaaagaccttatcggtatatcgagacacaatatgcaaagctacattggtagcttttttttttagtagtaaacggaaacgtaaaattagtggagatggaaggaggagtacgtgtgggtgaccttgaggtaggtatcgacggcgcggtagagcgcgtcgtacgcggggcgcgcgtgcgcgggcacggcgcgcgcgagctcctcgaactcggtcggccgcagcccggcctcgagcgccgcctcggcgaggtaggcgtcgaccagcctcgccaccctcgcggcgggggcgcctacgccaccgactgtcttggcggcgccgcccccgccggcgccggcgttcttgaagaagccgcgcaccaggcgcagcaccagcggcacgtcgagcagcggtccgcacgcgtacccgtgcccgaacgccggtatcatcacggcgcccag

SEQ ID NO: 25170 - DNA, 1390 bp, Oryza sativa
  unsure (1)..(1390): unsure at all n locations
cccggcgggtcaggcgggagcgcggcgacaagggactccaggaggagccgcttcttgagccacgtggcggtggggctctccgggggcaggaaccgccccgacgccgacgtcgccggcgacgaggacgacgacgacgcggccaccacgtcggggagccacttggcggcgtagtgggacagcacggacgcgagcatgtcggggcgcgacgccgccgacgagcccaccagctgcctagacttggcggcggcgacggtgcgcgcgaagttctcgacgtcgttgacgcacgagtcgtcgcaggtgctcgccaccgccgccgccacgagccacggctccgaggaggaccgcgtgtgctcgccggtggcggaggtggcgcgcggcgacggcgtcctcgggctctgcccctgcgacgacgacgacgccttcatggccgcgccgcgcacgagagcttcagctcgttcttggctggcgagctatgcccacgagagctgcataatatatgtcacccgcgtatggatgtgaaattgtggatggaaacgtgcatgtacgcgtacaaatacgcaattttttttagatgatgacaaatacgcaatgataaacaagaagctcgtgtacagcgctgcatgcttcagtattcatttatttttgctgggtaaaaatgaaaattttgtgtggagggagcgtagcttaacacgttaggttttgtggtgtaactagcctatatggatgcaagtcttaggcttgatggtattcgcatttacggcaaattattctttaagagatagccaacgtaacctataccccttgacagcaacccggtactcgtatttacgactagttattctttgagtgatagatgacataccctgtacctctcgacgacaacaggctcaatcttctgaagatactcattaaaggtaggatgagtgtgcgcgcattatacgtctgcttgtttttttttaggaaaaatgaaaatcttgtgattaattatgctgcgtgtacaactaggcaactatctagtagctactactactgttcattgtatgggtgcggagtgtacgtgcattatgaatgcctacttattttccatgataaaatgaaaattttgtgattaattatactttgtgtacgactaggcaactggagtatatagctgctgctactactactgttcattgtatgtggatgtagtacactcctgtacaatgtgtaatgcagggaaactgacaaacaaatccgtccgcagtgtgccacctggcatcaactagctagcatttgattaaatcaaggtgctacctaagcaacgtaggtatgtatactcctgttcatctatatatgnnnnnnnnnnnnnnnnnnnnnnnnnnnnnnnnnnnnnnnnnnnnnnnnnnnnnnn

SEQ ID NO: 25171 - DNA, 6183 bp, Oryza sativa
  unsure (1)..(6183): unsure at all n locations
atgggtgcggagtgtacgtgcattatgaatgcctacttattttccatgataaaatgaaaattttgtgattaattatactttgtgtacgactaggcaactggagtatatagctgctgctactactactgttcattgtatgtggatgtagtacactcctgtacaatgtgtaatgcagggaaactgacaaacaaatccgtccgcagtgtgccacctggcatcaactagctagcatttgattaaatcaaggtgctacctaagcaacgtaggtatgtatactcctgttcatctatatatggttgtacatggtgtcatgcatatatgttgtatgtgtatttaccttgactttgcaaaagcttaattgataaaccaagtgagcggaaatatcctttcgactaagaataggtgactttgaccattactacatcagtttcatataataaggtttttaaataagtttttcctaagtcagctttttaaagtatgattaaatttacaaaaaatctaagcattatttccgacactaaacaaatatactatcaaaatgtatttgataatgaattcaataaaatgtagtactacgtttttatgggaccaaagcccatatggtcgaatggaccacgagcatcgttggccatatacagtgcattgcataccaactttacttttttctttttagaactatacctatatacatgtgtgcgcattatatccgtacaagtgcaacgcaagttaagcttgcctatgtagcacgaacgttgttaaaagtttctctagccatcaataggttattattagtcctttttgctgagatgtactagtagtagcatctaggttagtcattgtaattcagtttatagctcacgtgaagaggttacaaaaattgctgtcatgtcatgtcttcaacgaacccaaagttagcctcatcattatttcaagtgcacattttttccttaaattgagcccaggtttagttcgtgtgccaatttttttaaaatatacagacacacatttaaagtattaaacgtagactaataataaaacaaattacaaagactgcctgtaaaccgcgagacaaatttgttaagcctaattaatctatcattaacaaatatttactgtagcactacattgttaaataatagcgtaattagacccaaaagattcgtcttacaatttacatgcaaactatgcaattggtttttctttttatccacatttaatgctccatatatgtgtctaaatatttgatgtgacggaattttcgaaagtttgaaggaaactaaacactgcccgagactcttaccatttttcatggatataaatatgagtacaacatcatatcctcttcctttgcactcgatctcgatcaatagaatgaataggcacgtttttcaagctcctaaacatactttttctagaagcatatattttcaattttattagtatatttaattcatttatatgtataaaaaaggacggaaaacgtgacgatgatgacatgattcaaatttcaaaaaatattgatggcacccaatcgatatcatgaacagtggtgatattttttaattaggtaaagttgtaatgacatggattcaattatcgcaagaaacaaacgctggcttttattctaaagatgtgaagatacaatccgaagcaccatattaccatgttttctaagaaaataagcaagggctctacctgaattagacgaagatggaaaaagggatgaaaacaaccaactttgcctgcaaaacggcaaagagattaacaaagagaaaaaaaaacagaagacctttgttcttttatgagaactcaaaacagaatgcaattaatatccgtgtaccatatattgtttacattccagagcaattaacgaggactccaaacaaacatggcgtaaaggtgacaaacaaaattctctctattatctgaaaagaaaaatctctctgcacctccgggtcctattcgtgcgtatacgtacaataatacatgtgcgtacatatgtacggtgacatcgacgttgctagatacaacaaaaatccttcattatacctgtacatctgtacatgtacgtatacccgtcgtatactagtacaaattgaataataaccgtataataataaaaatatttttcattattttacctgatgctttaccgtgcctttggcttcagaaaaaaaaagaaaaaaaaacaccgagcgactaagagaaggggaagcactcgccgccggcccgctgtctcgccgcggaaatttcgtcttccccgggattccgcggggaggcggcgcggtaaccgccggcggttattccgtcaatagaatggcggggaccgcgtgggggaggcctgagaagaggaggtgaggcggatggtccgcgccctgtcacgtgcccgcagcctgctcgacggaattccccaccggcgggggcgtgctgcgagttcgtccgtgtccggccatggcgcggaggaggctgttgcgggatacgtccgcatgctggctggcggggccaggcccgacgcgtacacgttcccgtccttgctcaaggcgacgacggcggcgcggggcgcgaccgtggcggcggcatcagttggcggtgccatccacgcgcacgtggttaagttcgggatggagtcgaacgctcacgcggcgagctccctgatcgtcatgtacgcggccaggggagacggcgccgcggcgcgcgcggtgctgaaggcggcgtgcctcgccacgggagggggagcgccggtcatgtggaacgcgctcatctctggccataacaggagcgggcggttcgagctgtcctgctgctccttcgtggacatggtcagagccagcgccatggccaccgcggtcacctacgtctcggtgctctcggcttgcgggaaagggaaggacctgctgctggggatgcaggtgcacaagcgcgtcctcgagagcggggtgttgcctgatcagagggtggagaacgctctggttgatatgtacgccgagtgcggcgacatggacgcggcctgggtgttgttcgagggcatgcagatgaggagcatggcgtcctggacgtcggtaatttctggccttgtgaggtcaggccaggttgatcgtgccagggacctgtttgatcatatgcctgaaagagacaccatcgcatggaccgcgatgatcgatggctatgtacaggttggcaggttcagggacgcattggagacattccgttacatgcagatttgcaaggtgagagcagatgagttcaccatggtcagtgtggtcactgcctgtgcccagctaggtgctctggagacaggggaatgggcaaggatttacatgggaagacttgggatcaagatggatgtttttgtcgggaatgcactcatagacatgtactcaaagtgtgggagcattgagcgcgcattggatgtattcaaagatatgcacaaaagagataagtttacctggactgccattatacttggtctcgcagtgaatggccgtgggaaggaggctattgacatgttctatagaatgctcagggctttacaaactccagatgaggtgaccttcgttggtgttctcactgcctgcactcatgctggcttggttgacaaaggccgagagttcttcctcagcatgacagaggcatataatatttcccctactgtggtgcattacggatgcttaatcgatgtcttaggccgagctgggaaattaaaggaagcattggatacaatagacaaaatgcccatgaagcccaactccactatttggggaaccctgctggcatcctgtagggtttatggtaattcagaaataggtgaattggcagcggagcgtctccttgagttggatccagataacagcacagcgtacatcttgttgtcaaacatgtatgcaaaatctaatagatggaaagatgtccgacggattaggcagataataatggagaaaggaatcaagaaagaacctggttgcagtatgatnnnnnnnnnnnnnnnnnnnnnnnnnnnnnnnnnnnnnnnnnnnnnnnnnnnnngctgataggtctcatcctatgaataaagaaatctactcaaagttggaaaatgtgctaactgattttaggaatgctggatatgtgcctgagggttttaaaaaaaaaccttttggaaaaaggggggtccctttgttttgaaaggtgcaccggaaagaagtgaaaaagcaaaaaagggttcttttacttggcacaagtgagaagttggcagtcacttttgctttactcacttcagaatctaatgttatcataagaattgtgaaaaacttgaggatgtgtttggactgccacaacgcaataaaattgatatcgaaattgtatggaagagaggtcattgtgagggataggacacgcttccatcattttagacatggatcctgttcatgcaaagactattggtaagtggtagcacattaatacattatatatgaatcatacggacaactgaacatctgtaagcaagtgaaaacccaaatgaccaacaagcatttcagttgaaatgtggcagtgactgcacatttttagtccagggaatgaagtataataatgagagaatatttttaatccagcttagcctatacatgttgtgctctcctttgggcactataatatcttggtgtaaacctctctgtcgctgatggttgtactggcaaagttcttattgaaaggaaggttaccttacatgttctcttttatgtcatgctgaaatctgttttccttttcctggttagagagtattaagtttttcctgatttctcaataagtggttccttaatttagactattctgttaaggaggttttctcactcagattcttatgagctaaaaatcgaaatatgatatgtatggaatttatttatttttaaaacaaatccttttactaacatgctgtacatgattcactatgcgacttgccaagatatcttacacttggagcttttccagctttgcagagattttcatgtaagaatttcttgcagtaatgttaaatttatcttgtggtctggagctaatctggtgcgccgttatgctattaagcaaaggaggatgtctgatggagccttactgtttcattcatagaaaaaccaggtatgctttattttctccagtctgcagctttcatatatttgattccatttgctaggctgctatttgaaattgtaatgacccaaaacatgcatttgacttgcttggtaaagctttaaagaacttaaaaacagtctatttctgtttatctgctttaacatatggaggtttgtaagggatgcatgatcttatgaagcagccacagttgctagataatatacaatattttcagaaaagttaaagaagtatataattggcaaagtattgttttcataaatttacaccagtcctctatgctcgtaagatgtaccagtcgtacacccaaattacttggagattagactttgagagcattttggcctagggtgttgcacaaacgctattttatttaatttttactccttctctaaaatgtatcaactctgctgagaaactgagcaactgatgcaatttagaccaggtttattttaaaccatagaatcataccacacaacatactggtcatttgtaaaacacaatcctttatagttagaggggatgaaattcaggccaaatccatagttgaataaccaaatgtggacatcttccatactttatgaagatataagtatgataggtcctccacttcatgctcatcatgattaaaaaaaatgcttattcccatctgtatcaaccagatgcattttgcttgtttcccatttcttgaatcaataggcttatgttatcataagaagaacctccctcttccaaagccctgcttgcctttacacccaagtcttttgctctcatcctcatctcctgtgcagcttctccatcattcatcaatgtggacactgctgtctccacagcattccttgtcaccctaacctctttatgttcacttccccattgtgccactcctttcactccaatctccagcccaattttcagcagattcaccacaaatttctcattcaaaaactgctctgcgaaatgtggccatgtgatcatgggcacgcccgcgcaaatgccctctattgctgagttccacccacagtgtgtcatgaaccctccaatggcctggtgccataggat

SEQ ID NO: 25172 - DNA, 816 bp, Oryza sativa
gtcatcaagatgataccgacatcggtcctctggggttactttgcttatatggctattgacagtctacctggcaaccagttttgggaaaggttaagacttatattcatcccatcaagccgacgctacaagtaatatctctatctgcatctgtttaccccaattgaacaatgaaattgcatgcttgactacttgcggtgcagcctatgtgcctcctttggattaatcaaaagataatccattttttttgttagaaaagtgattaacagcttacactatgcttcatcatttgcagggttcttgagggtccccatgcctctttcatggaatcagtgccttcaaaaacaattactgtcttcacgatcttccagttggtttacctcttgatatgcttcggcattacgtggataccaatagcagggatcctgttcccgctgccattcttccttatgattcttatcaggcagcatgtcctcccaaagttttttgagccaaatgaccttcgggaattggacgcagctgagtatgaagagcttgaaggtgtccaccacgatcacacgctggtatacatttacctcaccttcttggattatttgcttgtagtgacgattttgtgtttcattcttcaatgctccgatgccccacatctgttgttaatctgaagtttggttcctcacaggaggatggtgaatctgattcaggaagctgtggcagccgtgacgacgctgagatatttgatgagctgacaactaaccgtggagagctaaagcacagaacttccagccaccgtgaagaaaggcacctgcaggtaattaaatt

SEQ ID NO: 25173 - DNA, 602 bp, Oryza sativa
agcacccgcatgggtcggcacttcatagccacggttttgccatcgcggcccaccctagcaccaagccaacgtcgtcgccgcctaacgcgccaatgtcgtcgcagccatcgtgcacgctataagagcaaggttaatagtatagccaactactagctctaattcatctatagctaatctaatagccaatttatacaatagttgtttactatactaatagtatatggtcccactgtcatacatacattgcatcttggagtccgtgctgcagctagctacagatctgtatcccgctgctcttctctctcatcttttatctcattaaaatatatttgtagctggctaatattctgctattgtacctgctctaattgtcgcctcccccgcttctgcttgcctcgccgccaacctcgcccgtcgcacctcttttctcctcaccttcacatacaatcgtgtgaagatttgtcttttagttaacattttgagggttctatcggtttgatttatcaaatttgaattttcaaacttaattttgatgttaaatttaaaatatttttaacatagttttttttatattggcttaagttgccagaaatatatataca

SEQ ID NO: 25174 - DNA, 712 bp, Oryza sativa
  unsure (1)..(712): unsure at all n locations
gcnnnnnnnnnnnnnnnnnnnnnnnnnnnnnnnnnnnnnnnnnnnnnnnnnnnnnnnaagcacatatgcatggatgtgcatatgttgcatacatgcatgcattcacgttgcatgcagcgatgacggcgcggcggttccgcgtttccaggctgcgggatcgataggttccgcactgctgttttgcgcgaccgctggttccacaacccttatgcggtagagatatatttgtgcaaaatttcatcgcattggtatataaacacaaaataacgaagaaaaagatatattgtgaaattttttcctgggcttgaccaccatagacaaacggtgaatctatgccgaatgcgcttacttagctgcttccacgaaagttgccacatgatgccaatttttagcaacccagccaaagactaagaacttgtttggagtgaagctaattattttccaaccaaaattttagcggcctaaatagtattgcattgatgtttagtttgcttttttttccctcactaatataaatttatggtaccaaattttgtagtcgcagaaattatcaagattttagcaccatcaaaaaaatattaacaggggaaaatttagctccaaatcaaacaagtgaaaaaaaaaactttgtgccacactaccacacccctacagtgagagtgtgttcttagttcagcatcacctctacaacgtattctctccgtccataaat

SEQ ID NO: 25175 - DNA, 640 bp, Oryza sativa
atgcatatgtctaaacatttgatgtgacgaaaaagttggaggtttgaatctaaacacggcctatataagaaagccaagcagatggctattgccctctttgtttaggcttaggcttattggcctagacttttaagtcagcttattggcttatatgatttataagccagtggatttaatgtcctaagtttagtagtggagtcatacatctatctcatttaagccaaaaaagcttctccaacctagcttttggcttaatagtgttagaatagcttatggcttcaaaaaagccaaatgaaaaagctacttgtttgttttggcttagacttttcaacttataagttggcttataagcctaaacaaagagggcaatatatatgccttcaggccagtacgcagaatcttatctttggcctggtttagttcccaatttttttcttcaaacttccaacttttccaacacatcaaaactttcttacacacaaacttccaacttttccgtcacatcgttccaatttcaatcaaaatttcaattttagcgtgaactaaacacaccttgtttttgttaacacacttttcaaacaactaaacagtacgtttcgtgtgaaaactttctgtataaaaactgctctaaaatatcaaa

SEQ ID NO: 25176 - DNA, 1156 bp, Oryza sativa
ccctttgcctttcccttgcttttcttcttaaaattggttgcagccttgggtttgacatcaggcttaactttcttgttgttgtgggatgcatgagggttcttcttctgtaccatattggcactagaacctccctcaacctttttcccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcatcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggaatgttggaaatttggtcataattcggcatattttaatccaaaataacaagataataatcatgatatttacaataggatttgatccagtgatagtggtgaatgtaatcaacatgagcatgcttaacgttgaataagcatcaacaatcatgaattcctagcataatgagccttggaatttatttgatttaattgatttaaatggattaattacccaattaaatctaacaatgtgtacctagaagttacatatttaggttaacaagttcaatgcagtacttcacaactttcagaataaagttgtagtaatcctttttatgcttgtactgagatcacgagcagaatatatctgagctatgttagtatatatagtaattcaattagagataattaaggcacaaaccg

SEQ ID NO: 25177 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnncannnnnnnntttcagaaatttcggaaaaaattcgtatgaaattttttgaatttttgacagatttttaataaatttgaataaaatgtaaccaaattcacaaaaaaatacaaaaaaaccgaaattttcgggcgagatgttagcatttcggtggggggcgaaattcaaaatttccgaaattttgaaaatttcgaaccgaaatttcaaacactgggtgctggtggcggagaaggccagcaagctggtgggcgacgaggagaggctggcgtcgttcaaaggtcaccgcctcccccgccggtggcagtggcggcttggcgcaactataaacaaataaggaagaggcccgtgatggcgaggataccccttcaccggtaccgtgcgccggcagttcctggcagcgaagccgacgatgtggtggtgaggtaacggggcaccgtgcacgtgatggacgaggtgaggacaggttggggaggagctcgaggccgtcggcgtcgtgaagtccagatccaggtgctgacagtgtcgcatgtaggaaaataaatgtggcaatgatagataaagctaacttgtgcggctgcaacttcgttatagttttgacataattaaggaccatccaatttaaattttcgtgttgtaatcgacttgccgatagatgcaatgcttgtataagtacatgcatgagaa

SEQ ID NO: 25178 - DNA, 917 bp, Oryza sativa
  unsure (1)..(917): unsure at all n locations
nnnnnnnnnnnnnnnnnnnnnnnnnnnnnnnnnnnnnnnnnnnnnnnnnnnnnnnnntctaaacttgattaaagttaaaagaagtttaactagaaaaaaagttaaatgacttataatataaaacggatgaagtaactatgttagtggccagaatgacgatttttggctggtttgtcgtttgtgccaatctgggcagaggtggagaccccacagtttcaaaatttgcattgtatttactggagtttgaacaaaatctgaaaaaaactaaagtattggcttcgttcaatcgaatatttttagtggtcctgtttccgccgctgattctggctattttgatccatacatattccatttttttttcctttttagtgattattgcaaggctcacatgcacaaatttatgtgacatcaaatttgatcataaaaagtataggttctacgatgaatttggtttattcatggatgatacaagttccatgacaaaatttgctgattcgtcgtgactaaacgaatgtcacgctccgttttttacgaacacgtacgaatacgtcacagaaattttcttatgacgaattcgtcatcgaccatgacattaaagttttatcatagatatgcacatttctactagcgactacaagctgccaccagcccaccaccacacctctgaaacatacgtcgagcaccttgtgtgcgtgcccaaagcactaccagttcaatgtacatatatgacggctagattcctgatcaattatttccgatcataccatatcgccgtgaagacccttctttcctcccacgcatggccgccatgcaccggcgaaactaggagtttgccgtcgcgccaacccatttggaaaaggaaaaattggaaccatgccattataattttgtaaaatttgtaaatttaagatatgaca

SEQ ID NO: 25179 - DNA, 2332 bp, Oryza sativa
  unsure (1)..(2332): unsure at all n locations
cggacgtaaacacatcgattttattcatacgttcgacatgcctgtttatgtgcgcaatcccatcgtgtgcataaaccatccacatacaccgtgaacacctagcatacagtggtttgcaagttgcgttaaagccttgtaggcacgggcaggggtgaaccttgtaggcacctagcgatctctgcgtacgcgtagggcgtgcacgactcgcgaaatagcatatcagccatcacgtacgcgtaaactgtgttgtaggcggtactctctatgtacgtttttacgtaggcataatgcacacacctcgggctgttgtatgggcgagacgtgcgtgaagccttacgcgtacgcgtgtggtgatcgcgagttgcctacatatagttcatgcatgtccatggatcgtggacgtaaactcattcttcgtgcgcgtacactaaactttcaaacgtagcatggatatgtttacacctgagatccacacgtgggcgtgtaccatgtagagcacctcgcgatgcccacgtacgcgtaaaccgcgcacggcttacatcgaatcgacgcgtcaacccttagttgtaccgtacgtatgtgcgcgactgagccgtcctcgcagcctctttccctgcctcctgggcctgacttgcacgctgggcctaatgggctgatgggtgccggctggctggactgggggaggggcacggggatgatcgatacatccaacatccaaagtacttaacactagaaatataactagtagttcaactatataaactactacaatgtacttgcattttttctgcttcttcctcggtggcaagtctccagatgaactgtcgtcctcgtcctcgtcttcgtcgtcgtcatcgtcatcatcatatgatgcgagcagaggatcctttacgtcagcgttccagtctccgagacgtttacaaaaatcattccgcagtagacaaatcgatacgttaacatccgaaagacccaatgatccatatgagtaggctcaatatgttacgactatatggttcttacggtgaataggtgagaaatcacttcatttagtattctttttataaacaataaaacaatttcccatgcatttgcacgggtttctttcctatggagtagttacatacatatacatacgcgcgcggggatcacgagttgcctacatatggttcacgcctgcacgtggatcgtggacgtaaactcatcattcgtatgcgtaaattaacctttcgagcgtagcatgtatgtgtttacacccaagatccacacatgggcgtgtaccatgtagggcacctgatggatgtgttttcgagccttaggcacatatgtcgcgtctcgcgtgcaacaaccctgcagcgtaggatggatgtgttttcccgacgtaggagtaattggtggtgcataacccattcacctgtatgcgtacaccttttgaccgtaaatgggggattttttacatgaacctttagagcgtaaatggtgtacgcgtaacccattcgcgtctgcactagctcgcacccttgctcaacaaaaagaaaaagggcacgaagagatcctcgcaagactcacctctccgaaccccaaccccaattaattgtcccccaattaactgccctcgcctcgcgacgcctcgtgcctagcacggaataaacgcgttgattagtgaaaggagattactactataaagaaggaagcccccctctcgactctctcgctcactcccctctctctctctctctctctctctctctctctcgttctcataacttctctcttcgtccgaatcccagcgannngatggaatgggcggggcgacaatnnccgcttccttcttcttgcgtctggcaaggagaaggggaagtggaagcgacctgggggttccggcgacaaccccctaaaccctaaacccatgtgctcacttggatggacacattaaacatatcctacctccatcctaacatacagctatttctagatagctacatattttgggagtgagtgagtattccttttcatttatgaaaaaaagtataatacactcttatatatagtaatatagaaacttaatcatatcgaaattcagctacatcacatctcatttaaatcaatcatattatcaatcacctctcattcaatatcttcatgtactttgtacaattcaatatattaataggctggtcctagacatcacagtggctcgatcaacactgctttcaaacagtgtgaccaagtcattagcatgattaagactatagctaaaatttgggctattacacctccaacaaattaatacatgttcattgggtatcctacaccaaaggcaagaaacttttag

SEQ ID NO: 25180 - DNA, 2761 bp, Oryza sativa
  unsure (1)..(2761): unsure at all n locations
tgggctattacacctccaacaaattaatacatgttcattgggtatcctacaccaaaggcaagaaacttttagtgtcctgtaacaaatttttcctaaatttttagccctacatgtgatttcttttttttaaaaaaaaagaacataactatacccctaaattaaatgggttgattggatccataccattatagattctcaggtttagaaatatgtcattacaatttctccatttgtaaattacaattttatagcactttgggatatgtcattgcttaccagcgcattcataaaaagttttcaaccattttacccttgtcttcttcctccttcccctccttccttcccctccccctctctctctctctctctctctctctctctctctctctcatgtctggggaagcctgggcctccactagagctcctcctctagcctttaccctgccatcaggcgctccttcattgctcgcccgctcctcgaagaggacgagcagaggacataacatgaggaggatgactagacaataacggtcgcagaatggagtgcgaacgttggttacacgaggataacaggtaggtgcttgtggcacgagaagaacgtgcagatgcccgcggtgcgaggacgacaagcaggacggcacatatgacgcgagaaggatgttggcggatgttggcaacacgacgaggacgatcgaacaatgttggcgactaggatgttggcggacgccgatggcgtgagggcgacacccgaacacggtgccactactagagctaggatctagaggtggagctccggatgctagagcttgagcaggtgagagagctccagccggatggcctcgacggatccgcacaggaaggctcgggattagctgctccggtggctcgtgaaggagctcaggcatagcagcatggtggcctactctggtgggcgggcgcccgcttgtcttcctcggagcgtgtacccatcctccttagagtgtgctcgtgatggtgctcaggttgtctgctctttctccacagtaggcaagcgggtgaaggagctagtgaggcagggtataagttgaaggactaggagctccagtggaggctcggtcttcattagacatgcgagagggagggggaaggaagaaagggaggaagaatacgagggcaaagtggtggaaattttttatgaatgctctgaaggagtaagtagtgatatatctaaaattataatggtacggttacaaatggacatattgtaatgatacatttctaaattagagaatttataatggcatctgtcctgatattggttgcatattgagttttaaagtcatgtatgcatgatatttaaaatattatagataataattgctagtgaatgatgatgtggcacacttgcatgtgatttaaaatactctagataaaaattactagtgagtgataatgtgacacacttacatgttgagcttcagaagttagtgaacatcataggatgctgagtgggactaatgaaaatccactactatggtatatgtagcagtgatttggtttgtcttactgggtttgtgttccctgatacaagctggctaggtgctcgatgaaatgtcgccatggagatcggtcactagctgaggacatcggcgtgcagcatagcagcaggaaccacaatttaccacctcaggatgcaggatttggaagatgctcggatcgatgtgaaggttcctttcgctacacacctgtaaatatcaaattgtgctgtcgaatttagtgcgattagacggttattgccaccattagctggttgaacaatggtactatatggttaaattttttttttggggggggaggggaatcaactaaatctaaagttctccggtctaagcggatacatatagatatgaatatgaacatcaatcaaatacgctgtattctgctataatgtgtattttcatcaatattaaccatttagagcttgtttgtatcaaagtttctttctgtgtgtggatgagtggggcagggaggggatgcataatttgcgtaatattcgtaaatcaaaatcctacaggagtcagtggtgtttatttgttgtttggattgaagaaaagaattaaacacgcatcgaaactccatagccatcctgagtgatagccttctctatttagattcctcaaaaaacaaaaacatgatttccctttagactcttgaaaagacaaaatcatctcaagtgccatgtgtcttctctaatctcttcggttcaatgacaagactatgaccgagtacttcacgttctccttcgcaaggtgcctctccacaatctgcgcaaacctctgaaagagtttgtcaagtatatattcgccaaaatggcttgccagcaagggctcagacactgctctgatgcacttggcgacgttcatcccacggtgagggctaatgtgcatgccatcatgttccaagtcatcgtagggatcccaattggactcaaacagctcgatatggtcaatacaaaagagcttgttccgtgtgattactgtcttcacttcatcaatggagggcccatatattggtaaattgaatgactccagctttcccttctccactatcccctgatatacgaagtcacaaagcaaaaaaattcctcatcatcagccaacagccatctatagtgtagcagcagggcattcattctacgtgaaaaaagtactgagctttagacctcagtaaaaagagattgtnnnnnnnnnnnnnnnnnnnnnnnnnnnnnnnnnnnnnnnnn

SEQ ID NO: 25181 - DNA, 13362 bp, Oryza sativa
tcggcgaatagtcacgcgcccgccaccccgcgcggtgcgcgcgcgaagagaccaggcgctgacacgtgtgtgattttttcctttttctggttttttctttccccttttttgtggttttctgttccggttttttctttctgtttttttatgtttttttgcacttctggtatttaacatatacatatacaaactatgtatacacacagatacaaactttatatacgcatatacaaacttatttttacatgcgtatacaaactttgtatacatgtatttttgggtttttatgcgtacgtatactaattttgtatacatgtatacaaagtttatatgcacgtatacaaagtttgtatacacgtattttttaaattttttatacgttcgtacacaaactttatatacatgtgtatattttttatacattacaagtgtatacatacaaaaaaaaattatatacacacacgcgcatgtatatactatatatacatacgtatacaaagtttatacgtatgtatatatagtatatactatactacatatagcagtatgtatagtagtatagactagagggggggcagctgatcgcgcggtgctccgctcgcgaccagtcgcgtatcagcgccccccgcccgatgtcgcctctcccctctcccctccagcggcgccgctccctctcccctccctctaccctccggcggcgctgctcagtctccccctctccctcctgtctcgccggcacagcgcggcgacagtggggtgcggcagagatggcggcgacggccgtccctccccctctacctctccacgtcggcctcgacggccgtccctccatctcgacaacggtgccctctccaccctcaagatccggcagtgccctcccaacggcggtgtcagcggcgacgacggcgtcagttgcgtccgcaggtagatccatcggtggtggcgatccagcagcggcggctctctccgcggcctctattctccctccagtggcgccccgtggtcggatccaatggtgacaacagcattggcggcttcccagtgatgttttagttttcttcctgttctttttctcaatcgcttgattgtccgattagattttgtatttttttttggctttatttgccttattaagcactcgtacggacgaaaaatcacgtggactgactaaacggatggtgacgaaatgaaaattacgaatattttaattagttaagattaagattttggccggcgtttttttctctttggcttttttttcgctttttttttccgccgcttttcttgctgacggcgttcgggcctttttttttttctgttttttccttccttttccgaattgttttctgattccatatttgagacggttttttcggcgttttgtatttttacttttttgggcgcttttttaaaaaatgcctttttagatggattttttttttctcgccggtgttttttaaatcggaatggtttttctctctctctttcttttcggacgatggaaacattttgcacttttaaaacagtagaatagatagatagtagagaaatagactaacaaaataccggtgcgttgcattctaatctcttttgtttttcattactttactctgtggaattgggctaggaacctatgatgtgttcttcaatgcaattccgtttcaacacacatgcatatttgctagccatatgaaagtaattccaaacataaatctaaaaatgcaacatgcatgacaaaatattactagttaagctattaactttaaagttggtaaatgttgattttttaagaaaattgtggctgccttataataatttaggatagagatagtagtaaattagcgcggagagatgaattaatcacgtggcttcatcactccgccaataattttgaacaagggaaataatagcagcaactttgtctttttccttgtttgttaggcggagaaggactgggagagaccgaccggtgacaacgagatgtagctagcgacgagcagaggaattcccatggcagcgtccatggaggcaaagagggatggagaggggaggttaaggggaagcccttagctcttagcattcccttgacatgctagaggcatatgcctagaaggtcggagatggcacacagtggtgaattgactgcgcgcctgcgcgggcgtggtggcttggagaaattggcggaagcggattgatgtgatgttgctcatcttttaataagtactccctacgtcaatccaaaatcagatgtgacactatatagtacgacgaatctgaacatgaggcatgttcatgttaggttcattctaatatgtagtgtcccattcgtatctcccaatttgttacactacattggatcctaggatgcaatattataggatggagggagtaggtaaaatatataaagttttttttcgaaacaacgtaagatatatacggtttcaaagtcctattgtattgttttgtagtatgatattgcgtttaggtgaagcctataacagcccttcctccagaactgtgtagccaacccatccgatgggcgggcccacttacacataccactccgcttatacttttgtcctcgcttcgtgtaaaagggttaacccgagagtgacatggttggaggaaagaggccttataagttggtcctcactttgtgtaaaagggttaaacctggggtgatatggttggagggaggagtccttgtaagttggaacatggttgtaaggaagaggccttataagttgcttcaagagaccttataaattgcttctcgcttcgtgtagaagggtaaacccgggagtcatatggttgaagggaagaaacattataagtttgttccaaaccttgctaaactagcaagctgtaggccgtgccgtaaaattcaggggtcctgtgcaaaatcactaaattgataataataataataataataataataataataataataataataataataataataataataataataataataataataataataattgatggatcttctttttaatatatttgcatagctcctttcttctattgttttttttcttcttacgcttttcacgaccgaagttatattttgtaatctgatttgtagacgatgtggcttgaaaattaaaatactagataaacttatacacgtatagatacaacatgaaaagaaaaaaaataatttagtccacatagtagataaaccaaataacctatgcaccaaaattgagaaacattatcatcaaataacatatgcaaccaggaggccagaagcagcgacgtaacacgtcgactccaccggtaaggcagaaagacggacgagcgatcaaggagacgaagaggcaacaaaaaaattggaagacgaaacgacagacggatgagcagtcgatttaattttttattgagctgcccacacgcatgtacttggggtattgggcctttgtggcccctcgaagatggggccgggacgggcctggcaaggtgaatttaaacatatgcagatagctcttatgggtcatacaggtcaaatcctagttggaccagaatgtcgcaaagccaaacctattgtgctatagaaatgaccaagatggaccaccgacagaaaaagttcgtattttcgaagtagtagagaaacggtttcaaagttaatttttttacatatttcttttaaatatttttaacttgaatttatattttttcagaaacttacatttgtttgaagcacatggatattgcacctaagttaaatatttcgtgtgcttagcgtgttcagtttgatatgataagacaagtggagagaggggaaggcagagagggcgacatgacaggtatagcggtacttattatgccagttgacattaattgatggcatggcaagctgattgcaacatggaacaaacgagtggccatggccatgtccacatagccgcccaagtcctttttgtaattagctttctcaactcacatttcttgtttttcacgtttctgaaactactaaacggtatatttttataaaaaaattctataaaaaatgttttaaaaaatcatattgatccattttcaaaaaaatacgtagctaatacttaattgatattgcacctaagtcaaatatttcatgtgctcagcgtgctcagtatgatatgataagacgagtagagagaggggaaggcaaagagggtgacatgacaggcacggcggtacttattatgccggttgatattaattgatggcgaacaaacgagtggtcatggccaagtctacatagccgccccaagtcctttttgttagctttctcaactcacattccttgtttttcacgtgccggcttgtgaaactactaaatggtatgttttctaaaaaaatatataaaaaattgttttagaaaatcatattgatttattttttaaaaaacatagctaatatttaattaatcacatgttaatggactgttcttttttgcatgtttgaacggagagttcccaactctaacaaaagaacatagcatttcccatactttcccaactcatctctctcgtttttcgtgcgcgcacttcccaaactactaaactgtgtgtcttttaaaaaaaatttatataggaaagttgctttaaaaattatattaatttattttaaattaatacttaattaattatatggtaatgagttattcgttatacgtgccgaagaggaggagggttaccaactcttctctgaatccagcctagaccctccctttcctcacctacatccctccagcttctctatcttgttgcagtactatttgtgacagagatggtgacgggggctgtgtccggtagcacgaaaaatagagctgtccattagcacatgattgattaagtattagctaattttttaataaatggattaatttgattttttaaaacaactttcgtatataaactttttgcaaaaaatacaccatttagcagtttgaaaagcgtgtgcgtggaaaatgagggagaggggttgggaactagaagttccgaacacaccctgggactgcgatagtgatggcttggtgctttgatgaagcctagtcttgcgctaattctagatccaacgctgataagctgatcactagaggtggatcggccgccacaaggcttgggagtgacggattcgccgccggcgagctgagaggcagatcattgccagcatgttggggagctagtggcctctactggcatggtgggtcctcgcattccatccgtccaaaaactgactctgcctcatcctcgccttcatgttggctattgtctactccctccattctaaaatataagcattttttggactctgatacggtttccaagatgctacttttaccaataatatataaaagtaagatgttttaaataaaaatagttacacattatgatagtttgtttaatgataaatctagtaacattaattttacatgattgatctgtcgaaactagatttcggcaatataaacggggtagcgcatgagacctacaagtggatggatgcagaaacaaggatttagacaggtttaggccctcttaacgagagttaataccctactactattcggggatttgaatccgccgggtgtaatattgatccgacgatctaattgtgaatcctctaccctagaggacctcctatccgccttatataggatgaggggcaggattattacgagatagaaaccttaaccaatacggtatcgattttctaaacctactttacaatattatcaaaccaggactttagactgttccgtaatatacaaggaaatgtaatacccaagtcatgatccgtacatattccatagatataagttatcctctataactagtcggataactatgccctgtgggtatggggtacccataatctccacgtgatcttttttatttttgttctttttaatagtcaaagttgaaaatgtttgatacgtcactgtgctaaaaattcttatattttgaaacggagggattacctcgctctctccttcggactagcttcgaagcagctgaagaccccaatccacatcttgatttgtgctgcgtgtttcccgtctgtgaagatcgatgtttcttaggcctttggttccgtgtggtctgtttacttgtctatgaaaattcgttttcaccgccagcgaaactaatttagtacgtactactccagtagttacacctgctttctgtacgactgtaccagtgttagcttgtgggttggcacagatttctcttgcacaattttagatattctggcttctagctagctggcatatgtatagtactgctggtacatgtcttggtgatggtctatatatgatggcacctcgcaatggagagagtacccacacttgagttgcattaatattgtgcttattgttgctactcaaagacccacatatctaataatccaagacaagccatggtcaatatcgaaggcgatttacacatgaccagtggggaaggagaaggtagctatgccaagtactccaggcgtcaggtgattatattgctcttcgttttattttattttttggctgtcaggttacatatatgtgtacaaataacaacatcatgacgtgtttggtttaccttggtaaattatgtttattgtgatttatcaaatatatataacaattagcttttcctcgtataataattattttctctgcatcttcttttctgctgaaaagcacgaatctctgtcgtctcttaattaattatcctcacagaaaatatatatgtgctgcaattaacaattagccataactattcgtagtactggagaaatttgtttagaagaatggatatatctgtcagttattgataatattaacctagcatctacatactatacaagatatacatgcattagacataggtcgacattgtataacaccatataacgtgtctatatcatgattaagagctcaaaattttcttttctgctcattgctagacaattgttatagatgaaactaagccagtcatcgagaaagctataatagaagtgtacaaggctattctccccaaaactatggtcattgcagacttaggttgctctgcaggaccaaatacgatgttcttcatgtccaatgtcatcaacatcatagcagaccactgtactaagttggatgaacatgatcctatcgaacttcagttcttcctaaatgacttaccaggtaatgatttcaaccaactctttcgatcactcgaaaagatcaagacctcaactacgatgtatcacaagggagattcgcttccatcatactacatatccggtttgccaaaatcatattactctagacttttccctcgtcagagtgttcatctcttccactcctcgtattgtcttcattggcgctcccaggtacgattattgatataaaaatgttgttgggaacatatcctatacacacaagtttcccgtaatacactccatacacagcaactaacaaatatcacagaaaattatatgaaaaattcggcacatactttcaatagtattgcacctatatgtgaaatcttatcttcaaatttattatattttagctgtaaaaaaatagagaaaattctaacagctttgtactctgaaaattgttagatttttcacttttttgttacagctaaaatataatgaatttgaatatgagactttgtcactttgcatatatgtgtcatcctattaggagtacatgtctattttttcgacatttgctagttggtgtgtatgggaaacttgtgtgcataggatatgtttcccaaagttgtttatgcattattgcatatatctgacgtatatacatgatgtgtaccaatcttgcatacatgtgatattgcttttaatttgtagctaacttgagctgtgaaattttctaaattaagtgatgtgtacatataggtgccagagggactagaggctggtggaaaatctctctcaaataaggacaacatatacatcagctccaccacaacaccattagtagtgaaattattcaaagaacagtttcgaaaggacttttcccttttcctcaagctccgccatgaagaactagtaaacgatggacacatggtgctaatattttttggacggaaggatgaggatgtatacaatggaagtctcagccatattttgggatgtgtcgcaaagtcactagaatcacttgtttgcaaggtaagagtagagatatcgctaattaacattctaagaagagatgtgctagtcagaattaaccattgattgatcatatagggccttgtgaacaaggaaaagttggaatccttcaacctacctatctatgggccatcagatgacgaagtaatggaaatagttatggaaagccatatgtttgacttggttcacatgaaactctttgaggcaaactgggatccttatgacgattcagtagatgacgttgttcatgacattgccagcagtagccaaaatatcactacgggcattagatctgtgctggagtctttgatagcaagtcattttggagaaagcatacttgacgtgttgtttcaagagtttagaccccttgtggcccaacaccttgagagggagaagacaaagtatgccgtcatcgtcatgtccttgaagaaaatatagtagcacgtgtggtccatgaatgtcctctctcttaattacgagatgcttttaaagagatcaaacacaatatggtgacatatatcgtaataagaacacttgtgtggttttgtttccctcctttcaaccatttgcaatattgcataatgctcatattctgtaaaactctagctaaatggattgtttctccattgtttagctatatatggtgtttggttacttggctatattgatttgcctcggcaagtatctataggttaatttgcaaaatgaacttcaacatatatatacaaataattataccgtgtaagaccattatgtcaattttaccagttatacatgaaatcgtgaatgagccgctatgcataattgccattgccaaactaatcagctaccatttgttcaagagtggttttcccactgaaaatttggtaacatgcaacgttaactagcggatccaggcaaaatggtcccggggatcatagactagtcaatagcattaataataagttgaacaaactaagaaaaacatatgacggcaatatataatacaactgtatatagatccctaatatatgatctcctctctagctacatcttcgcaggtgaattatcacatcatcatttggaattgcaggtagaaaaaacatcgcaaatgaagcatatacgataaaaatcattcataaatttatcatatatatacagttccataactttatcttcatttttttaccaggaaacagtgagggaagccccacggtaattttcattaattaaaaagaactgtacaaaggaatgatgaacgccacgatgcatcgaagaataatgatatggcctagccctatgggtggctatttcctcattagggttggtcctcgtccccaacgggagagggggcaggtgggaattcctacctgcgggtgagcgaggacgggggagagaatggacccgcaggtctcccagcaggcccccggagctatgagaaaccactatgaagacaatccatttaaagacccggctgatctattttggtggtgaaattgatagaaccatgtaaaagctgaaccctaatcaaccaaacctaacttcctatatccttcactgttccccttccatcgccgccaagcgtgctctccccatccaccaccaatccgtgccctcgccggccccaaccgtcctcaccacccctagacatcgtcgcatcgtctacgccgaccgaccacaactgttgcaagagggaacgactgatgtggttgtccgactgagggttgttgtaacgtaactttgatacgttgtaattatgttggattggggaggagcgtccataatcaatgtcccagtgatgtaggtttcagctggacatcgttaacaaatatcgtgcttctgtgtgttcattaaatttgaattttctatagtgtcggttttcaagatatatatctaggctgcgtcttataacaagctgtattagagcttgcgggagatcccaggtagaggtacgagggaggtgccccacaccacaccaggttacatatgtgtctgagataggactggcacaaggtggaacaaggtgatgatcaacgaagtttaattggtgggtcttcaggtggcgatctgtaccattagatgggttgcaatcaatactgtgaggactagatgtggtgttcggattgatggcagtgggagcgattggcactactccggtggtgtcggaaactttggttggatgactcgaactttcaggcgagctactatcaacttaattatcatatattttttatatgggaaaacctgtaaatatgatgatgaagaacttatcgcagttaattgtcaactggttggattcatatttatgaagtgtcttagtgccacaccaacattttgtgtaaaaaaagaggagcttgtaaaatccttggaataaataaaatctgagtttccatatcattcattgtttctgtccatactcatcttgtatacgattgtatactggagcgtctactttttattgtccaaacatagataaatatagtgatcgaaaagacgaaaacaagatgcaacgcctatagttagccctaataattaaatcttctctagggcttgtagtatgtcgtccttgaggtcctcaaacttttcgatcccaaaactaaacctcacaaggttatccttgatcccattctcggtcttctccgcttcactcttgcccctagtaaaattaagcacgaactaattatgccaacattaattaacacatgttacgtgcgtgcaccagattaaatccgttaaatgtatgaaattgagcgagcagttaattactccatcctttccaaaatgatcgatcatcatatatgtttatacaccaagactaaaaaaatcacctcaatcaagacaccatgcacatattctcccacaatgcatgtgtcgattaaaacatcataccaattataccttagcatgcacacattctctcatgctgcattacttgtattatgataaaatctatgtccatgtggttatatgatgatcaatttaaaaaatattgttttctattatatgatgataaatttggaaagggagtaatatttactgttgtcaacttaataaaacacaaacaagggtgcataccagtaggacatgatggccggctgctgcactaggctctcgcacccgccgagcgaagtcgcgatgaagggcaactccagcgcgtcgacgaacctcatcgccccgcgcatgtccgacgccacctcgaagctgatcacgccgccggcgccggtcatctgcttcctcgcgacgccgtgccacgggctgctctccagccacgggtagttgacacgctccaccttggggtgcctctccagcagccgtgccacccgcagcgccgtccggttctgcgcctccacccgcagcgccatcgtctttagaccgcgaatgatcatgtacgctgcattctgaaaaaaaaaatatgtttgttgttgtaacagtatataagtgaactgtaacaaaacggttaggtattgctccccccgtttcaagttgtaaggcgttttgactttatttaaagttaaactactctaagtttgactaattcggtagaaaatagtagtaatatttacatcaccagtatagtttcattaaatttaattgaataaattttcataatatatttgtcttggattaaaaatattactatttttcttgtccacatgagcgcccacagcaaaataaaccggcacctttatgaagaaatagatgtcagttttagagaaaaaccgacatcaataatatataggtaccggttttgttccacctctaatttattatatgtgccaattatttaaaaaaaccaatagctataatatattataggtaccgacacctctaaaaactgggccaagctcctctctctccagcgtcgacggccgcactgccccactgtgagcggcggcagcagcaccctcccccatcgtgagcggctgcggcgtactcctcaccctcaagatctggcggcgacagcggtgtccatagccttccgcgggcagacctggtggtgacgatggtgtcagcgacttcccagtgttttgttaattaatttttgtgatttttgcggtcaatgttgttggttgatggatcaatattgatgaatcattagaatttttgtgatttgtgtgggtgatgttattgaatgtgggctgctttgcgagtgatgtggaactgctcgatgcattagcttgaatcgagatgtattttttttttgcattatggaaccttaaggtgccagttcctaaaccgacacctttgaggaggactcaaacatacgtgatgtctaccgggtgccagttaagaaatccaacacccataccggttgtaaaatccgtcacccatggggtttcccaaccggcaccaatcaccttttgcatagtagtgaatacactttttaagttttagttaattcttaattaacgatgtaataatcaaccgctccgttatatgtaccaagggggaaggttcccaatcctcttaaaacaagaaagctagccaaagggttactggactgatggcgccgccaaggtcgtggtgccacacgcgtatgcgcgagatgagctcctccgagccgctgacgcagccggcgatcacgtcgtggtggcctgcgatgtacttggtgatgggagtggaggacgacgtcggcgccgagggtgagcggcttctggttgatgggcgacgccagcgtgctgtcgatgcacaccagagcgccccgctggtggcacagctccgcgacgcgccgcacgtccacgcacttgaggtgagggttcgtcagcgagtccgcgtagaacatcgttacctgcacacatgtacattctcgatcgttagaatattttatccatgtgtgtgtgtctgtgcatcggaatatcgggggttcgtgtgtcacgtacattgccctgatcaagaacggattgcaacgcctccatgtcgtccagatcgacgaacgtcgtctgcaaattaatgaaacaatcgacatcattcaatctgcaaattaatgtcatagtaggagctatatattgcaatggtgcgtgtatattaatatgagatttactctggtccaacaaaaaatatctcgaggtaccggtaccgtacggtattaaatcgtttctcaatgttggatctagctgggtaggatgggtattgttagatccaacgatcagaaacaatttggtaccatatctcaaaatactttttgttggatcgagcaaatct

SEQ ID NO: 25182 - DNA, 1924 bp, Oryza sativa
acccaccacacgtcaaggggggtggctgaagtgcggtcagccgcgagcggttgcacccgcgcggcgcacctcctccctttagcctcttacgtatctacgtatgtagataatacgaatgttatacatatgtatacaaagtatatacatatatatatacatacactatatatatatatacacacacacattgacgtataaaaatgtatactaaattgtatatatgcatataaaaattttatatacacatgtatacaaagtttgcatacatatgtatactaactttgtataaatgaaaaaaatacaccatatatagttcgtatacatatgtatgtatacaaactttatatacataaatattaaaaaacaaaaaaagaaaaaaaaccaaaaataccgaaagaaaaacgacaaaacagaaaaaacctaaaaaaatgaaaacacctgaaccaggctaccacttgcgcccctcccccgcgccgttccaccgccgccctctgcatgcacgccacatagctgcgccgcacgggagaggcggcgcgcagatatccttgtattagggatttcgcaagcgaagaccgattatcatcagcggtcgcttaagaggcccgcacgcgataacgcggccaaatctcatgcgaccttcttaagcgaccgcatgcaataatcgatcttcgcatgcgctcccttaattaagatacttgtaggtgattatggaccatatatcttctcctagcctaagttgccgccatttgaaagcgatgtttctctctctaaaacgaagatataaatagggggaggtttttcaactcgaaatatttgcttgcaatccatataaaaagttacatgcttcatttcctctttcatttgccgccttttatttctcagtttattggtgaaatgtgacaatttttatagtttttttaatggaattttaaaaactattttgctatatttagtgcaaatatattgtttagatgaccaaaatttttattctaatcactagttcttgatgcttcaatgtattgtagtttaaatttttaggagatatttgtttttccatgatgtgtgagaaacacatgcactaaaattttattcgtactgtaattatttataaattgattgggcatggatgtacgagacgtggataactcatccggcgttcatgaaggaagcatcaaaatttactgatcaggcaaggcatatgccccgagggagaataagagggatatttttctgtccgtgctttgattgcaagaatcagaaaatgttgaaagatccgaagataattttgaagcacatagtgaagtgtggattaaggatgattacaagatatggacatatcacgaggaagttgccattcctaaagagactcttgatatatatttccttcgatggggcagaaaattttacaatagaggacatgtcccgtgatatggttgatgaatttggtggctcggatattgatgatttagatgctgattttgatttagaggatatgttatgccatgctgaaccagaggttctaactggtacaatgcaatggttagacaattgggaggtgttttataaatgagcgaaggatcttctttacgacgaatccaagacatgtgataaggattatatggtgctatgttatgtgctagagcttctcagattgaaagctagacacggatggtctaatactagtttcaacgatttgatgggtctattgagagttatggttcctaagcctaacttgttgccattcaacacgtatcaagcgaagaaactgattttccattatctctaggtgttcaaaaaaatccatgcatgtgttaatcactatactatactacaaggaatacactgacttggacatgtgcccaacttgtgggacgagtcggtacaaaagggtaacggggcatctgatagtgatgttgtcgaccca

SEQ ID NO: 25183 - DNA, 2824 bp, Oryza sativa
tctctttcccctaccctcctcttcccctatatggcgtcaacaacggttgggcggcgtaagcggtggctccaagcatggatctggcgttgttgccaaccgggccggcgtcagcagtggatccagcatcggtggcgtgtaagatagaatcggtgacggatcagacatctgtggcatgcgagacggcatcagtggcggtcgggaagcagcgacggcggctcctagcacggatccagcgtcgctggcaagcggggcaacatctgcggtggatccaacatcggtcgcatatgggatgatgtctacgttggatctggcgtctgtggtgtgtgaggtagtgttggtggtaagcgggatggtgtccatggtggatccggcatcggtggcatgcggggtggcattgctggtgtgcggggcaacgtcagcggcggcaggggcgatgtcaacggccattcccacaacatatcaagcatcatctgcgtcggcggcgggcgagatagtgtcggctaccgttcccgcagaggatggtgaaatgttcaaatacagcaaagtgcaaaatgaataaattatggcctacaacaaagcccatcatgcgtcgtcttcctctatttcaatgattggatccgtcttcttcctatacagtggttatatccgccttcttcctccactatggtgaatggatccgccttcttcctctggcatcacctcacgtgtggccagacggagatcattggcagcaaagtagacctccataatgagagaaatcaaatcgtcacgatacgagaggacttgcttgatttgtcgccatggtggatgagatctgcccacacacaacgtatattgtctcacttgtatgaattgaggcaccacgggaagtgcggaaatgtagtggagggtcacgtcttatttttgttcccgtgtcggatgtgggacatacatcatttccctatagcaaaaccaacatcttttatacaagtgaatttcaattattgattttctttgttttttatttttttgattaatctagatgcataattgtgcttatatacattatattgtctaatttcacattggtatgaatttaaaccaaagcatacattatttcatattggtaagaatggtaagaatttaaaccaaaacattcttttttttaacatttaaggatggaaccttatttgtttcaccataagaaagaatatatgtaagtgtgaacttgttgatcacgccaaagtatcgctgcctcgattaccagctatgtttcttcaggaatcctactttgtgcacgttacctagcaacggaattagtgcaagccttatccacttatcctttccccccatcgctcgatccctttcatccatggttcctcctgtgattcttttcttccttatacggttctcgctttgtcacctcccggccggtgacgcaactagcttgggcaccacctacttacccctctaccttctcttgaactagacgatggcgagctaatagcatcctggtggcatgcagcacatatctttttcatctcttcagcaacactttgcttcaccctaccccgcctcctccaccacggcatacatgtaagcctagacttttgtgtttcgatgacctcctacctagcatgctgattcaccctaccccctcttcctctaccacgacacgaagagatgcttacaaccgtaggctcatccttccgagtgacatgtaagtgcctcttttttttcctcctctttatctgatccagataggagtatccctagaaacttccactgatttgagtataaagttttcagttgaaacatttcaaattgaaataattttgatttgaaagtttaggattttgggtagaaacttttgaatttttcaattgataagtttttttagaaagaatgaatcggtagttatagcccacaagtttaaaggttttatatttttaattaaaaattttgccattttttagatgaatgttttgagattttagttggaagtttcatatttcagatcgaaaggttttttacacttagttgaaattttaattcagattagcaaaaatgcttgtgcgttgcaacaagtgaacataattttcatgattgataaaaactctaccagtttaaacgacaaaccgaaacaagataaacaaaataaaggtaaagcaaagccagaaaccatatatagtattgaacccggttgcacttgcttcatgcatcatcacacaaaagaaatcccttatctacacatttccatagcctaaaaaatcgatcgggtcgctattccataagttgatacatgtgtattttgcagtacgttatcgactaaagattgagattttgattattcaaattagtgaaattctttttacatgtagatggaaagcatttgcaaagcaacaaactttctgcatacacaacttaataataatttcaaaaggaaaatattcgtgggagaaaattttgggagagaaaaaaagaggaaaaagataaaaggaggaggaaagagaggatatttgtaggagagggagaggacatgataattggaaaaaaggaaaaggagaaatagaaaaaaaaaggagagaaagaagacgttgtcgaggtaggggtgcacggcgccgagtggaggcatgcgggacggtgtggtgggatgatatgggtcagttgggttgggctgagagatggagggggaggggttgggctgggaaggggtgtcttttttttttataatgcaatagagtgccgacatttgatcaacgagctacaaccaattattacataagctcgcgctagaaaagagcacataaacaagtcttaaaaagcacaccgaaaaaacctaaag

SEQ ID NO: 25184 - DNA, 4169 bp, Oryza sativa
  unsure (1)..(4169): unsure at all n locations
ccgacatttgatcaacgagctacaaccaattattacataagctcgcgctagaaaagagcacataaacaagtcttaaaaagcacaccgaaaaaacctaaagcaacgacaagctaataaaagcccacaaaacataaagaccctttaattattgaatcctatttgtaaacctccaaccataattggccaaaaactgcaagaccatcgacttaacaatgtgatatctagttttagctcggtgtcctcatcacacttttgtatctaaggctagaaccggagctaatacgttaccctaaagataacctgcatataagatgaattggatacaggtgactaaaactaattaaaaaaccaacactaacactgatgacgtaccaatttttttacgaaaacatcctcaatttttttaatagtaaagaagagattataaataaaaacagtggatctcaagttctatcccctccggggtactgcatacgcgagttaagttcgacgtgcggctgcacgaattagcagcccctatgtttcctcttacatatgatgagaatacgattaaatataaattacctcttcgcacatgatttaccataaaattccgttaaataatgtattcttttatgagtgatatgatcgatgatcgatacttttctgcatgttatttggttctgaaataattctaattaatgggattagcagtacagtatagaatgctagagggcggtacagacgttaggggataatgttacatcctgacccacatccggcggcgccgagcactaaaatctcgtcgcgccggaacttggatgccactaccgtcttcccttgggtcccacggtaggtagctagcgacaccaaacacagctgaatcctccagccaaattcgccgccaatttcttggatctagctagatcgtgccattgccacacgagaacctctcgatgacgcgtcatcatatcgctctcgtacgtccgaggatgcagactgatcgtcctgctatacgtacgcttgaatcgaaactggacatcgttggatagacttgttgggggtagttctcatcttgttgaatgccgtgccgctgtcgattatttctgagattctggccggccgcctccacgggtcgctaacacagcaccaatgatcgatcacctttggccattgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcttgctaactaacaccctctctcaatccggacctaaccaggttcagattgcttttgaaattctccaggagtcttactgacagaggtttagtgaatccatctgcaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctgtgctagatctagacacagtggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagtattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcagtggccctctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatacagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcagtatataccttttccttgcgaactccactttgcaacctggtgcgcggtcctgccggtgcctctgaacctgtgtcagtcacatctgcatgctgtaatgtattagtctcatctgtgacagcctgtgcatgttcctgcgctggtgaggactgctcctgctcctgcaccacctgcgactcctgctcctgcaccgcctgcgacactgagtcttctgctgtctcctctgctagcgatgatgctgccccccgtggcacagaaccaggtgtgggacccggatgacggcctgatgacgtggccgcaggggagtggtggacgacacggtctggttctggaccagaactggcatccagaggaggcgtcgccggcggatcttctgcatcagcgggatgtactgcaccatctctatgtggctcattagcacgattagataaagcagcagaaacatcagcagataatggattagtcactggatgcatgcattgttcattcccaacagaccgtatgggtcctagcagttcaggagtgagaatatcaatctcagaacgaagacgggcaccagcattggcatgaagttcagtgaagggaaaaatattctcatcaaagacaacatcgcgagaaatatagatgcgtcctgtagagacctcaagacacttgaaccctttatgcatagtgctaaacccaagaaaaacacaatgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatgaatgcatgagataggagagataaaccgatctcaactatatgacgatgttttctctcagccgacccattctgttggtgagtatgaggacaggaaacatgatgaacaatgccaatcttagaaaaaaaagagttaagggggtgatattcgnnnnnnnnnnnnnnnnnnnnnnnnnnnnnnnnnnnnnnnnnnnnnnnnnnnnnnnnn

SEQ ID NO: 25185 - DNA, 3829 bp, Oryza sativa
agtgaagggaaaaatattctcatcaaagacaacatcgcgagaaatatagatgcgtcctgtagagacctcaagacacttgaaccctttatgcatagtgctaaacccaagaaaaacacaatgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatgaatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccagtcagtttgcatggctagaatttttctatcaaattgacgttctaccatgacttgaaactcctgaaacttgtcaaacacttgagacttatgttgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtctagctctcccgtgacatgatctgtagcaccagtgtcgatgtaccaatttgtgtcaattccataggagttaaccgctgcagctgcaacatgcttggcgtcaggaacgtaatcctcgtcgtacctataccaacaatctgctgccgtgtgcccccgtttgaaacacacttggcaaattggtcttttatcaacgcctcttggtgtgcggcttcgaccacggccacctcctccgttgccgcgaccatggccgccgccgtcgccgccgccgcgcgaacctccttggccaccattgctgttgccacgccccccgtggctgaagcctccacggttgacaacattgacggtgacctcctgtgcgccgcggtagatggcttggcgagcttcaaagttcaacacttgagagtacagatcactcacagagattggttcaacccgagcgtagacagccgacaccacctcgctgtagccctcgccaaggccggtgatgatatactgaatcagctcctcttcatcgattgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcaatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcgccggtgagatgcccctgaagccgcgctcctctgactgcggcgcttacttgcaccttccagagcgcatgatttgccctcccaagcttctctgagattgggtggccttggaacggatttgtggcagccgtactggacgacaaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacagccataacttcttttttctttttttctttctatatacaggagacacatgcacataccaatatacacgcaacatgacattcacatctcatgaatgtatctcctaacacacgctataaaagacagaaaccatcatcacaacccctatcttattaaaatcttacggaaagccctgtgtaatcactagtacagatcctatcatctgtgacgggctcaattatatctgtactacttgggccgtcagaacgaagtcatctcaattatatctgtgacgggctcaattatatctgtactcactctaagcccaagtacatatagcccgtcactgataacactcatctttgacgggcaaagatttaggcccgattgagatgacctcgcatatctcaatagggcctagacaccgagcccatcagatatgagggtcatcggtgacgggctccaaatatggcccgattgagatgactttaaagcccgtcaccgatgattcatatcggtatcgggcttttgttgatgcccgttagagataacttttacttaggtcatttttttatataactttttttctgaacagcttgagtttgaatttgaaaatatgacaacttcaaacaatatttttaaatactaaatgatttcaaatgaaaaaaattatcaacaacaaagttacataacataccaatatttacaacttctatttttattttggttatttttctatataaaatttttttttgaacagtttgaatttgaatttaaaaaatatgacaacttcaaaacaacattttcaaatactaaatgatttaaactaaaaaagtcatcaacaacaaagttgtataactcatcgagatctataacttttattttggtcatttttctatataacgttttttttaacagtttgaatttgaatttgaaaatatgacaacttcaaacaatattttcatatactaaatgatttcaactaaaaaagtcatcaacaacaaagttgcataactcatcaagatctataagttttatttttgtcatttttctatataacgttttcttgaacagtttgaatttgaatttgaaaatatgacaacttcaaacaatattttcatatactaaatgatttcaactaaaaaagccatcaacaacaaagttgtataactcaacaagatctataactttaatgtttgtcatttcttcatccgataaagtgctagtaacattgttcacaaaatttacatacatgttttatagtttataaactag

SEQ ID NO: 25186 - DNA, 1967 bp, Oryza sativa
  unsure (1)..(1967): unsure at all n locations
nnnnnnnnnnnnnnnnnnnnnnnnnnnnnnnnnnnnnnnnnnnnnnnnnnnnnnnnnttatagtttataaactagatgagagatatgtgaattttgttaacaattttactatcactttgtcggatgaaaaaatgaccaaaataaaagttatagatcttgatgagttatacaattttgttgttgatgactttttcaattgaaatcatttagtatttgaaaatattgtttgaagttgtcatatttttaaattcaaattcaaactgttaaaaaaaatgttgtatagaaaaataaataaaataaaagttatagacactgatgagttatacaattttgttgttgatgactttttcagttgaaatcatttagtagttgaaaatattatttgaagttgtcatatttctaaattcaaattcaagctgttcaaaaaatgttatatagaaaaaatgccaaagtaaaagttatagatgttatacaactttgttgttgatgatttttccatttgaaatcatttactatcaaaaaaatatttgaatttcttatattttaaaatacaaattttatatagttcaatcaaacccggatggagaaatgaccaaaataaaaatggtagatctcaatgagttctacaactttgtttttgatagttttttcatatgagtttcatttagtatcataaaattgaattcgaaatttattttttcctagaagtctgatttgcctccttctcatgataatacttgctaaatatatatttgatccaattaacttggatttgctggtgaaatatgtgatcaaaatagatgttatgtgaatgaatgtatatgaataggggatgctagggtgtgacatccaggcccagggtttaatattattaatagaatactcataccaacaaattacaatttctttctcggaagccaatctccaaataacttggccgatgggtgacctatcgggaaggcacacaagtgaggttcaaatgggtgaccgaccgggaaggcacacaaggctaaccaaaaaacaaaatttattttttcgtggattatactcatctgtgacgggctataatctaggcccgttagagatgagagtcatccgtgacgggtgataatctaggcccgttagagatgagagtcgtccgtgacgtgctataatctagacccgttagagatgagagtcatctgtgacgggcttttgtattggcccgattgagatgtgtcatccatgacggccggatgcccgattgagttacggttttgaaccggatctggcacatatctttccttccaaagaaaggtgccgcaaatagttgccagttttaaactggatctggcaccaatctttccttttaaagaaaggtgccggtttcagctaaaataactggtacctatatatttattagacatatcagctatgagctcagaatatagcttatcctcttccgtttgagctgatcgagtaaagaacaaaggggcgcctcttgttattgctcgaccagctagaggatggggaggttttgccctaaattaaaattgattgctaaaaggttattttttttatttctcactctattccactcttgcttgttgaattgaactgtttgctatgtatacatataaagtgtgcaactgaaacaattatgtgtatttgttttctaggggtatttttttatctgctttttttattaaattagatccatcctcggatgaccacatgacatttttgaatttaagtattgacatgacggtagttgattttgtacataatattaattattaggggctttaaataatattcaaagagtattatagagcacaatgttataataattaaataattgaattgcttgtaaattacaaaatcctaactgtattattctgcgaggtttgtaataaacggtaaattattggatgcgactacacgtcggtcgcccgatggaaagctcgggaaatcgggcgaccggcgtg

SEQ ID NO: 25187 - DNA, 16355 bp, Oryza sativa
ttattttattgcaatgaaatgtttcgttcactgcaacattagatctatacatagtgaaacattgcgagtacattaggtgaaacatttttagtgcaacaaaaagtaaaccaaattcccttaatagagggtttacaaaatatgtggttgatttgttgcaggtgggggcaggtaatgtggtggggcccaacagtagcgggggcggagccgcgggacagcgctcgatttttttctcccccgtcggtcgaccgacgaagagcattatcgtaaattattatattatttttctaggggtggtaaatttcttttatccttttccggttcgttttattaaattacggctgttttgggtccatttcaacggaagaaaattggtctagcagggccacagggtcatactttcttttcgataaaagctggtcttggtggtctcaatctcgagttcgctttgtttatccttcggtctccacacctcgcctgcacagttactgcaactgccgtcggtgtgttcggttaggcagtatagccaaagagcaattctacgtaatttagtaccttatagtatctaactatcgagacattctaaatttataataaaaaaaatagtatccccttaaaatcgtaaaattgctcgtaaccagatgtctactacatggctgtatctgattgcaaacgtggtcgaaacaaacgacttttgaggggataacttcataattgcttccgaaagaatcagaactaaacacgtctgatgacaaataattgacatgcgacaaaagcaatgggttttgtccataagcaaatgttttaattatatatcgtgctatacaaaggaaaggaatcttgctattaatcatctcgtcaaattcgtcgccgtttcttggatctagaaagatcgtgccattgccacacgagcttaattaataattgaacctctctcgtacgtccgaggatgcaattaaacccggtcgtcctgctatgtactccatccgtcccaaaataacttaattcttggtttccgtgtccaacgtttgaccgtccgttttattttaaaaaattataaaaaaatttaaaaagataagccacgcataaagtattattcatgttttatcatctaacaacaatgaaaatattaattataaaaaaaattcatataaaatggatagtcaaacgttagatacagaaactttggaattaagtcttcttgagacggagggagtacgcttggatggaaaaacgtaccggatatcgtagttggatcgacttgttggagtagtcctctcatcttgttgaaagccatttccccgtcgattaattctgagatttccggccgcgtacacatgtactcacctttggccgtaactgatcaaccacctccaggaacagtagccatcgatatactcgtagccgcttcctttgctatgtatatcgttctgttctattgtttgtgtttcctcgttgctgaatcgatcaagataaggacggaagtagctagtaataatcaagtacgccagctgcatcagcccagtaagcatcaccaaagagtattctaatattttattctcaaaactatatttttatctcctaaactgaatatataggaagtgagaaaactattatttttaatagatagcttaaaattgatttcctataattaaatgtgagccctccctttaactatcaacagaaaaaatgggtttttctatcctgccctgcgcgcgcacaacgcgagatgccgatctcctcatctctctcgcgatttttcttcactgacaccgatcaatctattcgagccgtctgttggttgctgatctccctcgattcccctctgccagctcctccatcccctccaatgccgccgacgcttgtgagggagacgatgatggctgctcgcgagtagggcgagaaaaggagcacgggaacattttctcccagcgcgcgcgagagagcgaagacagcgattgggaagaaaaaatcgctctctaacagtgggtaacgagatttccggaattgagaatctggattattggaagataggttagggaatctgttagatgcgatttttgaccaaactttcctaaatttgaggatagggaatagaataaggaagctgttagtgatgctctacgactacagtctacgactacagaccaaaaactgcgtctgttttcggtccattccaatataagaaaattttcgtaatttcttttcgacaaaagatggatttgggccattagataggcagttggctaaccatgtggtagttggttatagaacccgtacctataataccatatagggtgtcgatttgcaaccggcaccaacgattgaagtcatcagtgccgctagtattgtgccagcaatgatgaatccagaatgaaaatagacgggtgtcttgttcgaatgaaagtttcgggcgagaagcgttgactattataaaattcaaattttgatttattttaattttgatgaaaattctacataagaagttcttgctgaaatatcacaatgtttagtggtttgacaagcatatgcctacagaaattaagaaatttggttatctgtttattctttaatttgagttatttctggtacaaataagaaatttgatttacagtggattgatgtgtatagtttactagctttaggccatgtcctttcagatttagagttttttgcggtactttatgtatttgaaatttaactatatacccttcccaaaattgaacttctaggtacaaatatatacgtctcatcttagatacattttagatactgatactaattaaggtggtagaaaggcagtgtcgcggtagtatcaggaattaaacggtgtaatggaagaatgcaagctctaataattattttgtccgtgtcagttgtggtatacgtagttacgtacggtgtatccgatagtactctgttagggagtgtaaccaaatatccacaaggctgtatctgattgcgaacgtggccgaaacaaacgacttttgaggggatataactccataattaatcagattacttccgaaataatcagaattgaacaggttctacgacaaataattgacatggtgacaaaagcaatggaagtggataagcaaagattttatacaacatgcaattatttgaaatccttgaatccctgtgtctaactttagtcactcgttttttgagtctaatcctgggcgagtggatgggaagagcaccgtcagtggcggagctggacggaaaatcaaaggggggccagccggcttttgacagctcaaaaaattggcaatttctcctttttttcgtgtattggcaatacataaaagcgaatagtttgcagaagcggacaatatacttacatgttcatttaaactatacggcacgagtcttcactgtattgaaatcgctgctatgggccagcaagactgaattgggccatacggtggcctgctagacctggagaccatatataggggtaataaaaaatttctttttattgggaggggccatggcccctgccagcccccctcaattctgccactgagcaccgtgagcgtgctgtggagttaacgacccagctttttccgaaaagcacgatgcggggcgcacgggagggtgggaacagcacggacatgatgtggaacggtgcggcgtctgggtcagcatttcgtcaaacaccctgtgtgcgtgcaagtggctatctcaaggaaggagatggtgaatagttgcgggctgggttgggcggcctgcttaggggaagggtaaaagagaagaaaaaagtacaccaaaggtccctcaacttgtcatcgagttacaaaatcgtcctccaaccgtaaaactagatatatgtcatccctcaacttataaaaaccgttcactttaggtactttgatggttttgaccctagttttgtcctacgtggcggctgagtcagtgtaggccccatatgtcaggatgccacgtcagcaccctctctctccccctcttctctccacatatgttcacatattttcgctgatgtggcaaatgtctgggcccactcgtcaggcatggtgcgtgcaagaggtgcctctgccgctgtcgggagcaggaggctggctgccaccggtctcagccctcaccatgctcgcacgcggagatgccggagatctcggtggaggcagcgaagatgaagactcatcgtttccccaaccttatcgccgccgctaacagaggccctggtctaggaaggggcgtcctagatcatcttcggcagatcagtcgcgtgcgtcgctggtgagactgaaacagacccttggcgcctgatctgccgcctgtcacgctcgtcaatggcgtcgagcggatctagaggaatagggaaggagccggcgtcgacacccagtgttccgcggggggcggcggcgtgggcgcgtggggcggtgggtgtgcgaggaatcggagcttgtatagcagctccaacccgctgtaggagtcggagggaggagctcgtcggggaaatcctcggagacgagcgagcaacggcgacgtggttttgcttgacgacagagatacccgtggtctcctcgattgttgacggcgtgaacccctccctagacagcgtggagttgagcggcgtgtactcgtgcggtcgtgccacaacccgagcccgatgatgcttttcctccccatcctcatccgtcgtgctgccatgtcctcctcctgcggccgttgtctcccctctttgtttcgttgttcacagggcgggccggtcggtggggcaaggcgaggcgggataggaggaggtctaacggccggacacggtagcgctgggcagcagatagcggtgggtgcggaggaggctgccgaggcggctctgggcaccaccgaggcacggcgcgccgccaccaccgtcgaggccgagacctacgtggccgtcacagagtcgtcctccagcgccgcgcaggcttccgtcgaggacaggatcgaggtgctacaggtccagctccgccgcggctgctccggcagcggtgatgggtgcgaccatccatcgcgaggagcacacccaaggacaaattcgtcgttctccacatcaacgtgtcaatcaatcaatcaatgcatccatccttctagaacacgatggcagcagccactgcaacggcgacggcaacgaagctggcggtggtggtgtacacgaaggagccagcggggtcgccggtcggcgcaggggcggtggccggggatctcgccgggggagcgggcagcggagccatcttagacgccgggatgggggccgctccccgggcctatgcggcggctgtgacggtcggggaaaggcgacagcggcgctcgccgccggctgccgtgcacaggctggccgtctccctccgctgcttgagagcgaggaagaagagacatgtttacacccaaatttggcacctaggattaaaataggaaagatgaccaaaatttagaagtctaccggttttctccgagtgggccgatctgaccgccgtgtgttgggcggtcagaccaccggttgagggctggtcagaccgccggtgtgtggccggtctgaccggcaggtccaagtccgactgtgtttcgtcgggtctcgaggtttccttgctcgggaaagcatgtttcgggtttcctttggtttctatcccgagttggacgtggaggagggcctgtagagggcaagatcaacccctatataagagacatggccggttctattgtaactaaccaatctacagtcaatcaattgaatcgtttttcatattgcttttagttttctcttagtttgtctatctttctcggtttgcgccgtaaaccgttcgccaccgctgcgagagtgcgacatctctttgtaggtacgtcacggtgaacgagacggcggagcgcgcgctgttctactaaaggcgaggccgacggcggctccactacgtcgtccaaggcgcccctcctcctctggctcaacggtggccttgtctgctcgtcaatccggtacggcgccatggaggagctcggcccgttccacgtcaagagcgacggcgagacgctcagcgcgaggatgaggtggccaccagtgttatcgcaccacgtcgtgctgacctcgccccactgctctctgaggccgtcatgccgttcccgacgatgtcaacgggaagggggaaaagaagaaaggagaaggagaaaaagaaggaaagagaaggggcaatccgggtatttagaaaactatctcacctcttttatccctggaaataataaaataatgcgaccggtgttctacggccaattatacgcatttttagtgtccattagctgtgttacgttttttagtgttttctagctaattacatgttttttacgtgtcctgtagcaaattttgccgaacaaaagaatagggggtatagagaaaacgaaagaaaaaaagaaatagagaacaaggagtgtgaaaatgaaaactagtcagctagataggagaagagaaaaaacagagaaaagaatatgggttacatttaaaatgaaaaaaaaaagaaatagaggataaggagagaaaacgaaaaaaaaaagctatataagggatacagagagaacgaaaaagaaaatagaggattaggagacaaaaccaaaaaaaaaagaaatagaagataaggagagaaaaaaaagaagttatataggggcacaattggggctcgaacctagcacctcttgtctcatactctctccatttttataacgtaagactttctaacattacccatatttatatggatgctaatgaatctagacacacacatatgtctagatttattaacatacatacgaatgtagacaatgttagaaagtcttacattatgaaacggaggaagtagctatgatatctccatcattaaggacttgtttagttggaaaaaaatttgggtttgattgtcacatcggatattaaacgtagtctaatgacaaaacaaattatagattacgtcaggaaactgcgatacgaatttattaagcctaattaatccattattagcaaatgtttgtaccacatcgttaaatcatggcgcaattaggcttaaagattcgtctcgcaatttacacgtaaactgtataattagtttttttattttgtacacatttaatactccatacatgtttccaaacattcgatgtgataggtgaaaagtttttattttaagaactagacaagacctaagccaagcaaaccttttgtaaatcaaagtgcatatttatggttttatcctatgaagctctcagcaccaagtagtattgcgctgagctcggatgatttagcaagtccttgccatcttggacggaatctcagtgctaatattagtggcgttaagatgttatagcttagcgccaagcatgatgacaataagtaaaagatttattttttatttagtttttatcatggttcaatcttcaaataagatttctgaaagaaacattttgtcaaattttcggccgctttttccactgctcagcctgcacatgtatcacgcacgggaccagacgcagtgtgaatggcctgataagacaagcgagggcagtacttattccagcatcgtgtcaattggcaagttgattacaacacggaaaatcgaaagaacgtaactcacttgaaatatttttatatttttttatgtttaaattgggaagagtaacatttttttattattctctcttatttgtttcttttactctcctatgaaaattagaaagaacgtaactttcttaattctttttatatatttttatctttacagataaagaaagaaaacaaaaaataagctagataggagaaggaaaaaaagaaaagggcaaaatttgccacaggacacgcaaaaaacgtgtaattggctgggagacaccgtaaacacataacacggctaatggacactacgaaaaatgtgtaattggttataggacaccggtcgtattattttattatttctaggtcaaaagaggtgagaaaatttttaaaatagcgagattgcccctgacgccatcttctccaatccgaaataacaaaagttttgtagctgccggcaaggtagctggcggcggcgaccgcgcgccaggagcggcagatggcgcggaggcggacgtgcagcgatggctgctgcatcgcactgttcttgctggtggcagcagcgcaatgcctcgtgctgctcgctggcgcagccggagcggcggagccacgcacgcgccagggagactacctggacagactgcgtggctcgccatcgtcgagggtgtcgctggccgtcgtgtcagccgaggatcgtagcgcgccatcactctccgataggtggcatgcggcgccaacgacagcgccggcggcgcttgggagccaggaggcggaccgcatggtgatgctgctagggcagccgaacagcctgggcttcgcacaatacgttgggtatgtgtgatggtggacgaggtgacggggcgcgcgctgttctactacctcgccaaggccaacggcggctccgccacgtcgtccaaggggcccctcctcctctggctcaacggtggccttggctgctcgtcactcgggtacggcaccatcgaggagctcggcctgttccgcgtcaagagcgacggcgagatgctcagcgcgaggatgagatggccaccagtgtcgtcgcaccacgtcgcgctgacctcgccccattgctcctctgaggttaccatgccattcccgacgatgtcaacgggaaggggaaaagaatgaaggagaaggagaaaaagaagctaagagaaggggcaatccggatatttagaaaaatatctcacctcttttatcctggaaataataaaataatacgaccggtgtcctacggccaattacacattttttgcgtgtcctatggcaaattttgcccaagaatagaatagaggatacagagaaaacgaaagaaaaaagaaatagaggataaggagtgaaaacgaaaactaataagctagataggagaagagaaaaaaatagagaagaatatgggatacatttaaaacaaaaaaaaagaaatagaggataaggagagaaaacgaaaaaaagaagctatataggggatacagagaacgaaaaagaaaatagagggtaaggagagaacgaaaaaaaaaagaaatagaggataaggagagaaaaaaagaagctatatagggggacaattggggctcgaacctagcacctcttgtctcgtagctatgatatctccaccattaaggccttgtttagtcgagaaaattttaggtttgattatcacgtcagatatacagacacacatttaaagtattaaacgtagcctaataagaaaacaaattatagattccgtcaggaaactgcaagacgaatttattaagactaattaatccatcattagtaaatgtttgtaacacattgtcaaatcatggcacaattagacttaaaagattcatctcgcaatttacatgtaaactgtgtaattagttttttattttgtccatatttagtactccatacatgtgtccaaacatttgatgtgatgggtaaaaagtttttgttttggaaactagacaaggcctaatccaagcaaaccttttgtaaatcaaagtgcatggttatggttttatcctatgaagctctcagtgccatgtagtatggcgctgagctcggatgatttggcaagtccttgtcacctcgcatgaaatctcagcgctaatattagtggcactaggacgctatagatcagcggcaagcatgatggtgctaagtaaaagacttagttttgtaattagtttttatcatggttaaatcttcaaacaaattttctaagagaatcattttgtcaaattttcggccgctttttccactgctcagcctgcacatgtatcacgcacgggaccagacgcagtgtgaatggcctgataagacaagcgaggggcagtgcttattccagcattgggtcaattggcaagttgattacaacacggaaaattaaattggatgatccttaaattggaagtatgtcagaacaataaaagagtggcagccgtgcaaattagctttatgcaaaatctaattcgcgcgcgctctctgttttgtcttgttgcgccacatactcatcggccgtccgatccaacaagctctggtgcgtctgtacatagcctggtgattcacggacgtgccatcatccagaggaatccaaattggaagccatgtgacgctctacgctacgccggcttcaaaaataattttctcttaaacaaatcatccgatctacgatccgattacaccgttgtgttcgtaagaattgaatctttataacaagatctcatatgattatgttttgatgaaaaattagaaattacttttataatatatctaaattacttttagatttcactaaattacttcttagacccataaaagtaaatttaaaaaagcctaaaagtaatttacatatattatagaagtaacttagaaaaaaaaataactttatcacgacattaaaagtaaatccgttatggaggtaaaaacatgagtctatatagaaattaaatttaatcagcacaaattacatcattgactaaaaatgattataaaataaacaactcacaacatgaatgtatagatttcttttaatgccgtaacaagttacttcacttttgttttaagttacttttataatataggtaaattactttctggctttattaaattaattttatgactaagaagtaatttaatgaaatctaaaagtaatttagatatattataaaagtaatttctattttttcataaaaatatagtcatgtgagatcttgttataaagatttaattgctatgaacacaatggtgtaatcagatcgtaaatcggatgggtaatctaagagaaaattctataagaagaaaaaaaatacatgcacttttgaatataatagtagtaactagatatgaggttgagaggtagctggttatgaccatacagagaacggtctcgttgtagacacgtcctagctttatctattgttgccacgtttattttgtagtcatgtctgatgacaggtagctagggtggtggagaccatttgattttttttcacgaacataaaaaaatataaacattaatatattaaaaaatagaaaaaaataagtagaacccatatatcagtaacatatagaaaaaaaaatatttttctcctctcatttttcatttattttttcaaaattaaaaacaacattttattctttctttttaaatttaattgttttctatgtaactgacatgtggatcccactgacacgtaagcgttaccgtggtatgccacgtcatctcaagaatcaggttgaagtctatttgaacctatatggcattcatgataagtttagggattcaaaaatatattggtatgccacgtcatctcaagaatcaggttgaagtctatttgaacctatatggcattcatgataagtttagggattcaaaaatatattttaatagtttagagatctaaataacacatctgtaaggactacccgtgtatttcactctaatgttaattgtttagttatgtgatgttcttcataataataatagggatagcatgggtattctaattaaattaattttctcatgcatgtacttataccagcattgcatctatcggcaagtcgattacaacacggaaaattaaattggatggtccttaattatgtcaaaactataaacgagttgcagccgcacaagttagctttatctatcattgccacatttattttcctacatgcgacactgtcagcacctggatctggacttcacgacgccgacggcctcgagctcctccccaacctgtcctcacctcgtccatcacgtgcacggtgccccgttacctcaccaccacatcgtcggcttcgctgccaggaactgccggcgcacggtaccggtgaaggggtatcctcgccatcacgggcctcttccttatttgtttatagttgcgccaagccgccactgccaccggcgggggaggcggtgacctttgaacgacgccagcctctcctcgtcgcccaccagcttgctggccttctccgccaccagcacccagtgtttgaaatttcggttagaaattttcaaaatttcggaaattttgaatttcgccccccaccgaaatgctaacatctcgcccgaaaatttcggtttttttgtatttttttgtgaatttggttacattttattcaaatttattaaaaatctgtcaaaaattcaaaaaatttcatacgaattttttccgaaatttctgaaatttcaattctatcgctcagctgcggcagaaatgctgatttcgaaatttaaaaccctaccaacaccctctgttggcaccgccacctgctagcttgttggattaggaaagaagtttgatcctaagagcaaagctatcattttgcaaaaattatctctccaaaatagcaagaattcatacaataacgtgtatggtgtctaccagtaaattaccacgtttttgaagtgtcctcgagcaaatttacattcttgtggtgtctcccaacaaaaacaacattttttgagtgtcttgtagcaaattttgcctaaattctaataggtgttatattatgatagtgcttgctaaggcaaatttgcacatagcattttttttctaaactaaacatttggaaagttattgatagtcaattttaaaagtttgatcaaatcttgtgatatttgagtttattgcaatatcctttttgtgtcagatgattgaagaatatataattcttatgtgtaggagttacattagaatcgaaattttggttcactgttatgctttttctaacattactattctcagaaaaaatgcaaaaaatgttaatgctttttctacctttaggaggtatgcatttttaaagtgatagtagaatacccatgcaagtgatagtagaggtagtctcttcactgttatatatatctgctaaactgttggagccatttatatcgtgcaatattatatctgctcctgaaatgtgtcttaactaatggcataccattccatatgcatcaattaattggcatataccattccacaactcaatggtcctagcaaaaggcgagttaatttgcgagatgggcttttctgaatggccttttttgaatgagctaattaattctttcaataagtacactatataaatagcatgacagtatacctggcctctatataaatagcatgccgcagggtgatcagtgtgttgcctagaattggtgtgttgttcccatcagaaaatacaaccatgatcaacacggaacgtgatttccacatggtcggaggggaaggagaaattagctatgccaggaattctagggttcaagtaactactctatctatctgtctggctgtcaatctgcatatatctgtctctcttactcactaacacatatgcgcgcgtttcactgcttttttccttaaaaaaaagagggtaagaggtttgcctcatatatattgatatagcagagttacttgctattgtgatacaaggtattttgccaatcatctgcatgcaagttatgaggtctgttagaacaatagctttaatttatgatagtatcagcaaacaagtaaactataagttgtgatagtgcaaaggtaaactaggttgtacccatgatgcatgattgcatggagcatatttatgaatttgaaaccatataaaattcactgacttcattagttaccaggaaaaaaaatgcttgtacagcatacaaagacaagattggaaattctttttgttggctcctagtatcgtacctgatatgaacctagaagtacaatgttttacgtacttttcatccgaagattaaagtggattaaagtgtattccttatacaccagttagaatagagggtatttgcccggcgaaaaagaaaaatagagggttttttcctctatccatggcgatcaagggagctttactcaggaatcattaaaaagaaattctgatgagtacagctttttggcttcctttgatttgtagagaaaacgaagaaagcaataggttccttgatatagaaagtaacatgtttcattttttgacacgaatgaatcgatgttttctttctttttttatcagattgatcaatgcacaatatttaattatttgattatgttatactcgaatttaattccagctaatgatacatcatatattagtagcaataattaacaatcttttcacatgcatgtacgctgttagaacaaggctatgatggagactaagtcaatcctcgataaggtaacccaagaagtatacactggtcttttaccacgtaacatggttattgccgaccttggctgctcttcaggaccgaacacattgcgttttgtctcggaggtgataaatatcataactaagtgccaaaataagctaggacaacttgatttaatggatcttcagttcttcttaaatgacctacctggtaatgacttcaatcacctctttcggacattggaaacgtttaagaaggcaaatgaaacaaatcatgaaggagaaatagtacctgcatactatatttgtggagtgccaggttcctattacacaaggctttttcctcaacaaactattcatctctttcactcctcgatatctcttcactggctctctcaggtacgcaataaaattaatcaagtgtaacatctatatatagtactacaagatgttcatacacatgtggtctctgccaatgcaagtcaaatcatcagcatgatactttgagttaattagcagtgctatcatttacttaggtgcctgaggagctgaatggcaggaaaaaagtgtacctaaatgaagaaaacatatacatcacaaagactacaccacagtccgtggtgaaactattccaagagcagttctacaaggacttctccctcttcctcacgttacgccatgaggaactcgtgcttgggggccagatggtactgacattttgtgggagaaagaatgaggacgcacgcagtggatcagaactaaacaatctctttggtttgcttgcacaatcactacaatctcttgtcgctgaggtacatatacaattatctatgcgaatttggtgtcactctctcaagatgcgatacaagatacaccctctatccctaaatgtttgacgccgttgacttttttaaatatgtttgaccgttcgtcttattgaaaaaatttaagtaattattaatttcttttctatcatttgattcattattaaatatacttttatgtatacatatagttttacatttttcacaaaagtttttgaataagacaaatggtcaaacatgtttaaaaaagtcaacggcgtgaaacatttagggaaggagggagtatatcatatataaaaaggaaattttcaggtgaatacatgtaattaaaataaactctcggcatgtatataacagggcttggtggagaaggaaaaccttgagtccttcaatctaccactgtatgggccatccgtcggtgaggtagatgaaatagtgaagaacgtcaatttgttcgaaatggatcacatcaatctgtttgagtgtaattgggatccttatgatgactcacaaggtgatattgtgcatgacagtgccttgagtggcatgaatgtagcaaagtgcattagagccgcactgcagcccttaattgcatcttattttggagaagacatactcaatgcgttgtttgaagaatatgctcaccgtgttgccaagcaccttgagaaggagaagggtaagtttgcttttattgtcgtatctttgaagaaaagatgctacataaagatcgggagctagtactcgagtatatcactaaatgtattgctacgttaaacatatttcatatctgctacttgtttgtttctttcacctacttgcatgttattgtcctccctggatgtatatgtgcatgatcaaatatggtcattatatttgtgtttccttgtatctctatggatataaataaaggttaattggatccgtaccattataaatttatctgctaggaataatatcattgctatttaataatttgctctaatgtcattacaattttatacttatttaaaatatatatataccccgtacttaacccttcactatattttctaatatttttagaccaaatcaaccccttctccttgctcgtcctctcatctcttcaatgggtctaaatccaatccaaatccgcaccaacccaacacctcttcaaagcagctcactcaaccaatccaccccacttcttcacctctgggacccaatccaaaccagtccacaagcagtttcaggccaaaccaacccaaaccataatagtcttagtggattcaatccatttggaatcc

SEQ ID NO: 25188 - DNA, 3381 bp, Oryza sativa
cggtaccccactcctattcctgggttgaaccgatgggtagaatccatttttgacccaaaaaatttagggaaaattggaaccatgccattataattttgtaaaatttaagatatgtcatcctgacccacatgtcattgactcatgtaggtcctacatgtcattgagataccgatggcatatctcaaactttgcaaaattataatgacatggttccaaattacccaaaaatttattacgacatcgaaaccaatccaacccatatttcagtgagtccaaatcgctccaacccattccaagtcctaccccatttcaatccaaccgaagacggtccatttaaaaacccaacccattccaccatttacatccagttgtcgtcctcctgcatcaaaagcatcatacggatgccacacggcaccggaaagcttccaccaattgaggtgcttgaacagggtggattgtatcaccatttgtgtgagacctgcggcgaggagccctctcgaacagtgccacccccaacaccagcatgtcgaagccctagctcgtacagcgccaccacctcgtgcttgcgcctctcctccttcatttttttgcatgatggcgttgacgatgacgtcgaccggcacgaacacaaccttacttggccttactaaaactagactgaatttagaatctaacaatcgatgtcaaacgtaatctattcgccacaaaattatctacgacaactttattattcgatcgagataaagtttaagattgttattaggctgtaaaagctccttaataaaatctaagtttggtgaaactagtggtaagaaatctgatagagtaaggtgcgatctacgtttatcccaccaccaaacactacatcaaaaactgtaaaatcaaagtgtttttgattctttattctgtgatgaacaagtggcgtctgtgattattggttttgatacttagagattattggcgaagtggttttggagatgattggtttttacaggtgatatacaggtgctgctggatatgtggtccggttagaccgggcagtggttgctggtcagaccggcgtgtatcgcgcggtcagaccggctagcccgcggtctgaccggccgattctgtatttcgggttgtttgttgggatatccgtgattgtttcatgtttatggcttctagatggatactatgggtatgtaatcactacactggccacggtcacctgtgacgggcccaaaccatcacctttgacggctttgagcatggtcagtgatcagtggtcactagtgagtccagtcaccttttacgggtggccggccgtcacaggtgacacccacctctgacgggcaagttactagaaggccgtcagaggtgttggtctccgctagcctagggccagttgagacccgtcacaggtggctcatctctgatggccctttaagtaaaggccgtcagaggtgatggtctccgtagatagaagcggtcacaggtgatctacctgtgacggccccgaaagtaaaggcccatcacaggtaggtcacctctgacgggcctttatttgcgagtccgtcataggtgaggttacctttgatgaattttggttccgacccgtcactgatgtattaattccagaaaaaaaaataaatgctaaatattggctagccctaggatttgctagccatgccctttaaaaacagaaacatcacaaatatattccagttacccccctaatataacatcacagatccatctcaaacatcacagatccccaacatcacagatccatctcaaaaattgacatcattcacatatgcaattcaaatgccacaattttgcacagcaaattcataccccttgaaagccacaatttcggtcgttactcatagaactgcatatatgcttaacaaattgattaaagccataatgtccttgacctccacgacctgtcaattagaaaaaaaggagagaacaaatgaatagtacaacgtaaatcgtagttgatcaaatttgatgacaatttagcaaactaccataaatattgcacatatgaaagtaaattacattgcactccataatgtagaatcataaaaacaactttttttacatcacaagaatttatctagccaagtttatgagtctatttgacatgaaaacatcctttcttgttcattatttccgcaagaatgaaggtggacacttcgcctctaatagcgggagggttgatgggtgagatcttcaagccagctctacctttctgtttaataaatcagagattagcacgtttagaatagcaatgttggtattgaaatgagcttattcaccattagcaacaacctcagtgtcgaaatctttcacctctcttagaagtgttgacatgttgtggcacacgtggaaaccacactgatctccgatctgttgtgcacatgcaaacttggtgtcatgatagagttcgtccttaccctccttgtgcctaccacccttttccacatatgggccccaaaccatatttaaggccttggtgatttcagtgaaatcataatctttcgtcttattggagttaaggtaggtaaccctactccacttaggtacgatgactaaaagaatccaatgttgcctgtgcggtggttatgtagcattagtaataagaaccttaacttcaataacaatatgcacaaagggtattgtcctcttaatcctggttgtgtgtacacatgatgtactccttgtcttggtgggcccataaacaccggttgagatagtcaaccacatcagtgaagctctagagtaaattgacctcgttcaccatggatggatcatggaacccaacctaattaccaaggcgacgacgctcgatccaacacaaccttaaaacatttacgtattagaactaacttaattaggagatatagtccaatcatatcacaagtatagaaggtctgcacttacaaggagtagcattttagaagtccagtgtccaacttccggatcctgaacaagtcgaagaggtcatcaaagcctataattatataggcaggcgacgataggaacggctgctggtcgtgatgtccaactatggatgactccctcattttccgcttggcattacttagctccatgtattgcctatatagctcttagcaagcaatacccatcacggctaacacattgtcctccaccaatggcatgcctagttcaaattgggctggcgccctcacgacctttcccgctttgctcaccgacatcgatgtagcagccttgcccctttttggcaccggtgccaactccccgatcttccccttgccgcgttgacgcttctggcccttgacaagtggtggggaactatcggcctttcttgtggtcttaatgggtaccgagctcgaattcgccctatag

SEQ ID NO: 25189 - DNA, 812 bp, Oryza sativa
  unsure (1)..(812): unsure at all n locations
nnnnnnnnnnnnnnnnnnnnnnnnnnnnnnnnnnnnnnnnnnnnnnnncacctcttcaaagcagctcactcaaccaatccaccccacttcttcacctctgggacccaatccaaaccagtccacaagcagtttcaggccaaaccaacccaaaccataatagtcttagtggattcaatccatttggaatccatggattcaacccacatgcagtccacaacggtgctaagcgcatcgctcaatggccgcacagataggaatcgtacagcaaaggccggaccccaccatggacttcttcgataccaatcttgcgaggaagaacgtgacatccacacgcagcgatggcctgcttcttttttaggtggatgaaatcaaggcgacggcgagcaggacgaacccgacgttcgcggcgctggcgctgcgtttcgccgttcgcgtcgagctcgccggccaccacgcagagcccgaacggcagtaggtcgagccccagccatggccgcggtgtagtttgtcgaaggatttgggtaacgtgcacgtgaagcgccgcgacggcgcggcctccgccgcagcccgcagcaatgcaggtgaaccctcactcctgtccgcatctagccggctagcctccgaccgtgctgcgctctcccgctccgccgcgatggcccatcccgccaagcacgcgccaccagctcggctgctcctcgatgcgctccgcaccaccaccgccgctattcgcgtgcgtgcgccagctgcgctctcccgagccgcctccgagaagatcgccgtgccgcggatcgcaccaagccacgccgtgccgc

SEQ ID NO: 25190 - DNA, 1670 bp, Oryza sativa
  unsure (1)..(1670): unsure at all n locations
nnnnnnnnnnnnnnnnnnnnnnnnnnnnnnnnnnnnnnnnnnnnnnnnnnggttttctcctatgggagagatgcccttgccatgcatgttggattttgcaacaacaatgaggagtgaggatgtctcactgagagtccactggctggcgacaccttcacgctcgtcgcggtctctttgggcatcgtcgatgactactcaatcatccttgccggcactgcctccttcttgacgtgttctctccatcttcatcgccgcaggcgtcgcgttatgcatccgtgtggtcggggttttcccgtgaagccactggccaagtcatccgtgaaggtccccggagatgagcgcgtcatatatagacggagccatatattgtgacacaatcctcacatgctagtgttgtacactgcattgtgtgtatgcttgtgcatgcatgcaactgtacactacagtgacacacaaaaacaatcaaatgctttattactaagctatactcacttggctgtggggatgtgtatcgctatatactaagtggagtccgctatctgcacctaccatctccaacgacttctccctttcctaatataatcccgactcaactgttgtgacatcaagctattcgagctacgcagctccacgcatgtcttcatcaagcaatctacaccaacatgtcgtttaagactgaggaggctagacgacgagggcgggtgaagacgatgctaagactatttcaccaacatcggcgcacggaccgacgaggccgtggatcgctgctggctcccacatctgcacatctaccactatcacaccatgtatggagagtgcgaagcgaagaagaccacagacagcttaatcggacgttctctcgcagacctagacctacggaggtaattaactaggagcttctcgagcacccgcatcggctgggcaccgaagggtacatcggcaaggagctaatatgagcccaagaggatgcagccactgcagcagcgaatgtccctgccccgttttcgaacatccctgaacaaagagctcgcaactgggcgcgggcatgtggtaaggtcaacccgaacgactctgtcacatttgagaacaaaagtgctgccgtcatctatcaggaactggtgagttcactacttaacctaactaattaccgttcgcatgaagtagaagtttgaataaacgattcttgtttttatagttggggttggttgctgaacaagcttcacaaagcgaggttgagtccacgccgaagaggcgcgaagatgacatcctcacaaaggcgctcggaaccaaagaacatcctggccggactcggggaattggcagcgatgtgccctggaagcatggactgccacaatacagctcccaatataggaaacggaaagtctccaaggaagagagagacgctcgtttgaaggccgagcttaaggtagaggtcattcaagaactagaagcaagcatggacgctagggtggaagaaagggttaaaaaggtcctcgccgacatgaatatacctcgaggcacaacacacgctatgcatccaactcctcgtgcacaacacaacgcgagtctgtcacagcgtaggagtagttgtgcatccacagaggtgccggcacctggtctttcggtcgcaccactagctgcagtggaccacatagaggtaaatgatgtta

SEQ ID NO: 25191 - DNA, 617 bp, Oryza sativa
  unsure (1)..(617): unsure at all n locations
atctctaacgggccttaagttggggcccgtcacggatgaccgtcanccgngacgggccccaacttaaggcccgtttgagatatggaatgttatctcaatcgggcctaaagttggtgcccgtcacggatgatggtcatctgtgacgggccctaacttcaagcccgtttgagatatggaatgttatctcaatcaggcctaaactacggcccgtcactgataggtgtcatccgtgacgggcttaagttttatgtccatctaatatgtctgtgcgaccatatctcaatcgggcacttttttagcccgattgagatgactttcttgtgacggcccgctatttccatgcatgttagagcccgtcacagatagaaggatctgtactagtgacataaatttataaaatcttaaaaatagatattaattaatatatactgtatgtacaacatacactatttttgtgagcaacatataaagcaaaaactagtccataggaaattgctttattatttttgaaatattggattttgcttggaatacatttatttttcaattggtccannnnnnnnnnnnnnnnnnnnnnnnnnnnnnnnnnnnnnnnnnnnnnnnnnnnnnnnnnnnnn

SEQ ID NO: 25192 - DNA, 1207 bp, Oryza sativa
  unsure (1)..(1207): unsure at all n locations
nnnnnnnnnnnnnnnnnnnnnnnnnnnnnnnnnnnnnnnnnnnnnnnnnnnnnnnnntttttctttcggtatttttggttttttttctttttttgttttttaatatttatgtatataaagtttgtatacatacatatgtatacgaactatatatggtgtatttttttcatttatacaaagttagtatacatatgtatgcaaactttgtatacatgtgtatataaaatttttatatgcatatatacaatttagtatacatttttatacgtcaatgtgtgtgtgtatatatatatatagtgtatgtatatatatatgtatatactttgtatacatatgtataacattcgtattatctacatacgtagatacgtaagaggctaaagggaggaggtgcgccgcgcgggtgcaaccgctcgcggctgaccgcacttcagccaccccccttgacgtgtggtaggtcaacccgttcctggggattggttttttgcaggtgcagccacttatggcccaccggcgatctaatggatgctcatgcaagaaaatcatttatataatagtgtttagcaatttcataactatttaattagtacttaataaacaattatcaggtggacgtcaaacagctaattacaattccactcccactacaacggcacatgcactgaatgcaccgtgccctcgtcgtttgtccctgcaaggctgaacacgtagccacggccgcgctcgtccctgaccctgagcttaattaactccgaggtgtacgtggttcttctcgccaccgttgatggagctgccgatatctttggtgccacgctttgccctcggtcgccggacttccaagactaccctcgacgacgtagatcgccatgatgacgctccgacgccgcagcggcgccggcggcacacctccgacgacacgctcgtcgtccacgccggggagcggcggcgcgcgcgcgatcggcggcgtcgcggcggaggtgacggactactcgatcgcgacgccgatcgtgaccggcacggcgcgctggttccgcgactcggccgacctcgtcgccttcagggaaggcggcgggcggcggcggcggcggcggcacagcttcgagtacgcccgttacggcaaccccaccgtggaggtcctgaggacaagatcagcgccatggagaaggccgaggcgacgatcgtcacctcctccggcatgaacgcgatc

SEQ ID NO: 25193 - DNA, 745 bp, Oryza sativa
  unsure (1)..(745): unsure at all n locations
nnnnnnnnnnnnnnnnnnnnnnnnnnnnnnnnntatattataaacagagtctctaaaatgaaagaacttgctttctgctttcaacatggcagggactcgtggagaaggaaaagcttgactccttcaacattccaaattacgagccatctatccatgaagtcaaaacagtggtgataagcagcaagcttttcaccatcaacaaaatttacgtctttgagtcgaactgggatccttatgacgactcatcagatcaaggacaagcaactaatattaatcctatcaagagtggcttgaacgtcgccaagtgcattagagctgtgcttgagccgttgatcgctagccattttggagaatctatactagacgtgctcttctctaggttcgcacgtaatgtcacccagcaccttgagaaaaggaagggaaagcacagcgtcattgtgctgtcgctcagcaaaagaaagaattaatcacaagagcggatggagcatgagaatttagcccgtaatttcctcttattttgatttgtaatggtggtaatggcctggtcattgtgtagtttgtgcttggtcaagccttttgtgtgttctggaatgcaccatagtattttgtagtttaataattcttaaaattagaattaataggtattgagctgtatctgtggtggaaattgcttggattatattggacaaggaaatatcatttctctaaaattaatggatatccggttgtacctaacatgaactgc

SEQ ID NO: 25194 - DNA, 10777 bp, Oryza sativa
accccaatgcctgcgaaaatagttgattttcgcaggtgcgcgctaggtccgcctgcgaaaatagcttcgagcgctaaaaaaaaattgggcagccacccccgtttccggcggtagcttcccgttctcaatccagttcccaccccttccccatccaatccattcaattcatccagttcatccaaaaaaacaccgaatcaattcatcaacagttcatccaaaatcacctaatcaattctaaaagaaagcaaataaaaacattcaacaaatcacggccgctgcccagccttcgtccgccgctgctgcacgtccgcgccgcgccgtcgtccgccaccgccgcacagccgcggcccaccgttgtccgcgctgctgccgcacggccatggcccaccgtcgtcaatgcggatctgggagggaggggcggccgggagccgccgccgccgcagcagcacggccgcggcccgccgtcgtccgcgccggcgccgcacgggcacggcccgccgtcatcaatgcggatctgggaaggaggggcgcccgggagccgtcgccgccgcagcagcacggccgcggcccgccgtcgttcgcgccgccgccgcatggccacggcccaccgtggtcactccagatctgggagagatgggcggccgggagtcgccgccgccgcctcaaccaccctcgccgctgtggccatgccaccgcctcgaccctcctcgcagccaccgcccgccgccgtgctccccccgcccccctccggccagatccgccggccaccgctctccccctgctccctcctgccagatctgggaggaggggccgggagcgtgccgccgccgccctccgccgctgccgccctccgccgccaccgcccgtcgccagccgccgccgccgggaggggaggggagaggagaggtgaggtggggataggaggagaggtgaatgagagaggtgaggggataagcttgccggctgtgagtggtgaaggtgtggagacttagaaaaaatcttctcctatcccaagtctattttcgcaggcgccgcttaagtggtccgcctggacatcaaatttcacctcgatttatatttttgtaggaggtcatttgactctatgggtcatgtccgcctgcgaaaataggactcccacgttggaaaaaatgctttttctagttgtgtttttctcaatgtatttggtgacattgcttgcgaaccttgagaagagcaatggcattatagactccccgaaatgagtagcaaacaacctctccataactgctcttatggacttggcgacgttcaccccagactcaacagggtctagcacagtatgtccttcgaattcgtcatcttgtggatcccagcttgactcgagtattttgatgtggttgatggagaaaagcttttgttgcatgatggctgttctaacttcattgaccgatggtccatacaatggaatgttaaaggagtcaagcatctccttctccacgaggccctgttgtggaaaagtaagttactttctggttttatatcaaagtcttacatgtttctactcattaacttttttatcagttaaactttttaatgtttggctaaacttttagaacataacaacatttttaacaccaaacaaacatactattgaaatatattcaacgttagtcttaatgaaacaaaaatactgttataatatttttatattattatataaatttagcaaaacctataaaagtattaaaaaatcaaaatgacttgtaatatgaaaactagagagtagataaaatctaaaaactttgaaacaatgatgttgtttcaaacctcaatgacaagtgattgtaatgcttgtgaaattaattcataaagaatatttttatcttcatcaaatatgttgtcattcttccgtccaagaaaagttagcaccatcttaccaccagatatgagttcctccgaacgcaactcaagaaagttcaagaattccttttcaaattgctcctggtatagctttatcacttcttcaggtgtagtcaccgcaatgtaaacgtttccttcattttggggttccttttcacacctctccttaaacatctgcaagcagaatcattgtgatcacaagaaatcactggctttacaaatagaaaaagttataaggctgacttatatatagagacaacaactcaaaacatcaatttactcgattttcattatcacatttctcaaacttctaaatgatgtgtgtcatgtgcaaatattttctatataaaatcattaaaaacataaaaaaaactatttttaaacttgtaatggttaatacttaattaatcatgtgttataatgattagttctgttttatgagcagtaacccgctccagcttaaatgtggtttcgaactcaacctaagtctactttgcatcctctaactacgttatggttggcatttcaaatcttccaatcatcaaagaaaaaaaaaatgttagagagcggctttattatatgcatgcctgcgagtccatccatgaaagtgccaggatctggcaaatgacctgcactgacggatccactctcgatcgtcttccccctacacttcatcgggagcttcccagcggaacatacggagtgcgtggtcgtgttattctggctctttaattttgtatgatttggctcccagatctaattttgtgttctttaattggattttccatgacacgctatcacgatcggtgcatcctcgctttcataaatgtgtcatggaaaatccattaaaataacacaaaattaaattatacgttaagcatggggatagcggatagctagcatctttcttcaaatttttgaaaggaaatgtgtaaaatgtattaaaaatatacattataccatggactagtttagtcatccttatgggctacaacatagtgcaatgacaaaattatcatgttcagtcaaaaaagagaaaaaaaaatactcatatttgtcaaaggcgaagcgtgttgagggcactgtcctagaaaacctatccacggtctctgtaccaccaacgttgatcaacagagatactattgaagcttggctgcttagcagggccgcaacaaccctcatagataagtggcacaaactcagggctaaggtaaacaaagcccaaggctttaaccgcaccgggggccaactccagcaccttgcaatcatccccccccttcccccaacacacacgcacacaccgtcactaacgctttggttcttgcaccgaccacgccttgtcctagacaacattgcccatagccacggcgatcggatctcggagccttctcctctcccttcacctccatgacctcttcgggtgctttgtcctctgccaccctcatcctatcgttggcctcattgtcgctctcaccatcctcttcctcatcctctaatgagggtcctcgtcagagtcctttgggagggacccgttctactagtgatcgaggtagttgtccacttcatcgtcaggtatttcatatagcattggtgggagcgatgacgacaaggtgtccccaccattcttcacctctctctcgctggtggtgatatactgcagctgctgcagtgagtccactatgaccggagagagatagacaggaggtggggaggcgaggtgaccggagtgagtgggagacgaggtgagaggcgagaaaacacccattgccccctacttattggaacaaagataaggcatgggaggtgaggaggcgtgccgtggtaacggagcacatgaccagcgatcagctgattggtcttcaaaggaggaagcgaacgatgttctcgtgtatggtagtggatgtagttgaagacttaaagtagttgcacgaagaatatgaatggacacaaacaggtgtgcttttcaaagtgcgctgccaggaaaatgtcattgacatgggcggccgtttgtcctgcattgcatgtgtacataaacctacttttgtaggcggtgacttacgatagccgcctacgaaaatcgtgttactatgacaccctcaaaagtagaattggtttttacgggtagctatattcagtggcagctcgtggtattatatttacacgggcggctcttgactccctttattcggtaatctaagcatgcattttgcagttttgtccgtctacaaaattaagggtgagtggtatatgaaaatcatttttctactagtggttaagctttatttagcatgcaatcaggaatcaacttatcaatataatggtaataaaatagttaaattagagcatgaataggagtatatcaaaagttgatcacatatcaattaatttgtacaagcatgtaatcatagggtcaaaatgaattataatccagtgcttagttccgcacactaccacaattagaccatcaacaacatgaatgagaagtaccacttgtatcaatatataatatgcaaagactcctaataatagcaacggcaatggtatagcactttgcacaaataagaaaaataagtaaatattcagtaaaaaaaaagaaaaatgagtaaatagggtacctcacaagtcaaaggcaaagcgcgcgttgagggcactttcctagaaaacctatccacggtgaatgtagtctatataccaatgattcaccaatgttgattagggggtgtttagattcaggggtgtaaagttttggcgtgttacatcgagtattatataaggtgtcgcatgggatgttcgggcactaataaaaaaacctaattacagaatctatcagtaaaccacgagacaaatttattaagcttaattaatccatcattagtaaatgtttactgtagcaccacattgtgaaatcatggagcaattaggcttaaaagattcgtctcgcaaattagtcgcaatctgttcaattagttatttttttagcctatatttaatacttcaaggaggtgttcaaatgttcgatataacagggtgtaaaatttttgtgtggaaactaaatagggcctaacaaatatatattgaagccgcatcaataacccacatagataagtggcacaaacactgggtcaaggtggacaaagataaaaaaccaggtggtattatacttagggttcacttattttgtttgtttttgatatttgaggggtgtaaaattttcgatttcatagttgaggggtatttcttgaacctaatagttgatgagaggagtactatattactcctcacaattaatgcaacatatatatggagttatctctactatacattatgtaatgccgggtgcaaaacagatgtgattcctttatacttgaaaaagaaatattgtgtttatctaaaatataaaatgtgcatatttttatacataaaacccaagacttgtagcttttgactaataattatactaacaaaatatatgtttagttgcacacgagttgtattatccaatatttgtattggaatatacttccgtagtatgttgatttcataattaataataaaatatatttcatttcaaaggtcaattgtagaacccaagctagaggagaggaatgatttgattcacaaactagttgagtaacattaaatctaccattaaagatcaaagtctttacgtggttccatcatataaattgaatgctaacaaaaaaaaaacttggccgagaggaattggagggcaacaagcaatgctatttttaattaaaaaaatccaaattattccctgaattttttagtccaccaaattaccccctgaacaacaatagttcatggtaactcggacattttccctttttaagtatgcatgaaactattgatcatattttctttgactgtcagtctgccacgttgcttgtaatttcaaagttagttttggaaattggctatagggagtgcctaggtccataaaaaagttggctggttgagtacattatgttggtcattttgacattgccataatgataaggttttcaacaattaaaagttgtctagtataatgttgattatcttcacatgtaccacagttgactccactctttctccttgatggtatcacagcaagaatatgatactatgcgcagtgacactatacttgaggaatcgttagccaattcttttatttcacttttagatgacgtagtaccaaccaaatgtcgtgcttaaatgtatgtgattttggatttttttttcagttgaaacttttctagagggagttaaggggtttctcccatcaccttatgtctctattttaggtatcagaactcaatggttgtgtctaatggctgtggccggaaatgtaaacaattttcattatctaaaataatgaataaacataatgagaaaaagatcaatgtacaatagtgaagattgtatgggagttaatacgcttatactatgggatgaagagttagcaagatctaatttctcatggtttacaagctttaagtcaaaacattctagtggattggtgatctattagatccaagagttgtacatacagaaacggagtaacgcactatgttgtatcattaatgctctcagcatggatattcagtacaaatctttaagggttattaaccagtttgcacactttcacgtcaaaattacataactgaattaagcactcgatgagataatcgtgttgatgtaattaccggggaaagccaatgtagggaatacgatgaatggaagaggtgaacactcttgtcagggagcacccttgtatagtaggatcttggcaatccaacaacatagtactgcggcagtgtatctgcttcttggtcttgatctttggtgaccaaattatcaagttgttctaatgatttaaataggtaattaaagtcattaccaggcagatcattcaggaagaactgaaggtcaactgggtggtgacctatgcttgcacaatatttgctgatcacttttatcacctcagagatgaagactagtgtattcggtcctgaagggcaacccatgtcggcaacaagtatcgtcttagggaggagtgcagtatatacttcttgtattgcttcctcaatcattggcttagttgcaagcaaagcttttgcctagtaacatccatgtgcacattgaataaagttaattggattggaattataacagctggattttgtatatcctttgacgtattttataatgtacaaaacatcaaactttgtaaaggaataagtaataattaattaaactacaagtacatttaccgtattaaatttatatcaatcgattcatctttcaaagttcattaaagataattacttaaaagctatttcaaatacattgaatgataaatcgacagtcaacagttgaactatttcaccgaagcataaactttttgactcattttacaccttgaactattaaaaaggttcactttcactccccttatatatcagtcatactttacactgaaaatttggtaaaatatagatgcattcacaatttacatctcaatattattttgaaattttctcactgtttatgtaggttggaagcccttaagactgttttgaacatcaaaattttaaaggtcaagcaaacagcgatgaacaagtttgattttttttcaactttgataatggtgccatctatggctctaacaaatttaggcttaaaataaaacttgtgaaaagaataggaaaaaatagaaatattattagggagtaaagtgaatcactttcaatatagtttaggcgtaaaataagcaaagaaaaatagttaatggggttaagtgattcatttatttagttccagggagtaaaatagactgtatttcaagtttaaatatgccctatgaaatcaaagaagatagtatttacacaagctagaatgtcgaacaaaacagagtaaatttatgttcgaacaaaacagagcaattttttaaagaaattttatatgaaaagttcttttaaaaacacaccatttaatagtttaaaaaacttcttaacaaaacataggtaagttataatttagagtaaaagaagaccaagaaaaaaaagactaagaccttattaggcatacttgtttgatgcgcttaaacaggaagtcagtttccatgcacatggatatgcatacacaaacggaagcactcacgagattatattccccagaaagtacaaatagtgatatataatcccatgcattaaggaaaagattaactcgtgtgtacgaaaattttttagaaaataaggaagcatagtgtgtacgaacctgtatcttcgagttcttcgcatagctgttttctccgtcccctccagtcatgcctaagtaagtttccattgaaaaagtggatacttatcctccagggatttacctaatttcttattggaaggagcagtatatgcaatgggaaacttgacatacaaggagaaaccactgtatattaattggacgtgactccacagctagtttgtctaaaccagctaccacttcatctatgagagatattatccacatataatttaaatacaattttctcttaaactactaatcatatctatgatccgattgcaccgttgtgtttgtagcaattaaatctttataacaagatctcacatgattatattttgatgaaaaattataaattacttttataatatatctaaattacttttagatttcactaaattacttcttacacatgtaaaagtaaattcaatgaagcctaaaagtaatttacatatattatagaagtaacttataacaaaaagaaaataactttaatgaatgtcttttttaattggatgtgactacacagttagtggtagctagtttgtactccatctagtatctcctttcaacttgaaaaatacaatagtatcttcttttctcattctacatgaaaaacaaaaatgaaaggaaaaaaacaatcgatgattaaacagatttatagataattacttttgaaccatgcaaaagttacttccaattaacattgaagttacttttaaaaattgttaaacttatgtgtgttgatcagtgctgattaaatttaatttctagataaagtcatatttttatccctacttttagactctgttaaatttacttttatatgtctaagaagtaatttagccaactctaaaagtaacttatatatatgataaaagtaacttacatatataataaaagtaatttacaaatataaatattttttcatcgtaatctaatcatgtaagatcttgttgtgaagatttaattgtaacgaacacagtggtgtaatcggattatagatcggataagtaatttgagagaaaactttgttagaagaggaaaatgacgtacatgtatagtaaaaaaaaagcatgcatgtagtaccatgtagtagctggacttctccacgtttatccgtgtttagacgtcgctagttaaggcaaaatcaagaggcctctccaaacagatttttcaatattaatttatagtgccaaatggtggttgtttcttgggagaacacatcaacacaaccaccatatggaacagccatgtcactgttatttttctgaggaagacaaccaccatttgactttataattctcagttttatttttttcctcaaaattcatgatttattttttgttttcacatttttgcatgttaaacctaaataaactggaccaattgaaaaataaatgtattccaagcaaaatccaatatttcaaaaataataaagcaatttcctatggactagtttttgctttatatgttgctcacaaaaatagtgtatgttgtacatacagtatatattaattaatatctatttttaagattttataaatttatgtcactagtacagatccttctatctgtgacgggctctaacatgcatggaaatagcgggccgtcacaagaaagtcatctcaatcgggctaaaaaagtgcccgattgagatatggtcgcacagacatattagatggacataaaacttaagcccgtcacggatgacacctatcagtgacgggccgtagtttaggcctgattgagataacattccatatctcaaacgggcttgaagttagggcccgtcacagatgaccatcatccgtgacgggcaccaactttaggcccgattgagataacattccatatctcaaacgggccttaagttggggcccgtcacagatgaccatcatccgtgacgtgcaccaacttaaggcccgtcatagatgactcatcagtgacgggctatatactaatcccagtttgacatgacttaatcacttaatctctatcggacattaattaaagcccgtcaccgatgattattttttcatttttcatataaaatgtttatatttgtaagttgaactatagcaaaataattaacttgcagtataataattcattttacgagtcaaaataattttacgggtagtaaataatatcaaatggaaaagtcatcaacaacaaagttgtataactcatcaagatctataacttttattttggtcatttttctatataacattttttgaacagtttgaatttgaatttgaaaatatgacaacttcaaacaacattttcaaatactaaatgatttcaactgaaaaagttatcaacaataaagttgaataactcatcaagatctataacttttattttggtcatttttctatataacatttttttgaaccgtttgaatttgaatttaaaaatatgataacttcaaacaatattttcaaatactaaatgatttcaactgaaaaagttatcaacaacaaagttgaataactcattaagatctataacttttattttggtcatttcttcatctgataaaatgatagtaacattgttcataaattttacatat

SEQ ID NO: 25195 - DNA, 8566 bp, Oryza sativa
  unsure (1)..(8566): unsure at all n locations
ctttttcagttgaaatcatttagtatttgaaaatgttgtttaacgttgtcatatttttaaattcaaattcaaacggttaaaaaaatattatatataaaatgaccaaaataaaagttataggtattgatgagttattcaactttgttgttgatgactttttcagttgaagtcgttcactaacaaaaaattctatttgaatttctcaaactttgaatttcaaatttcaaattgtttaaatagagtcagatggagaaatgaccaaaataaaaattttgcatctcgatgagctctacaactttggttttggtgacttttccatttgaaatcatttattaaccctaatttttcttcgaagttgtcaaattttgaaaattcaaaatttgaattgttcaaataaacttatttgtacaaatgaccgatacaatagttgtagatctcgatgagttatacaattttgttgtttatgatttttgatggttgtgtatgtgaatgaatgtatatgaatgggggatgttggggtgtgacatatcccggcctagggcttaataggattaatagagctactcttctggaagccgatctctaaataactttgatattaagcgtgcttggcctggaacaatttcaggataggtgaccgatcgggaagtgaacttcgtgcacacgagtaaggaaaaaaaaatgattggcatgagaggggcggggatggcatggcaaggctagccaaaaataaaatttattttttttaggattatactcatcagtgacgagcattaacttaggcccgattgagatgactcatctgtgacgggctatagttaatgctcacggtgacgggctatagtttaggcccgattgagataggtcatccgtgacgggttatagtttgacatgtcgtctgggtcaaagctatcagtgacgggctttaattagggcccgattaagataggttcatccgggacggcatggcaaggctagccaaaaataaaatttattttttttaggattatactcatcagtgacgagcattaacttagacccgattgagatgactcatctgtgacgggctatagttaatgcccatcacagataagggtcatctgtgacgggctatagtttaggtccgattgagataggtcattcgtgacgggctatagtttgacatgtcgtctgggtcaaagctatcagtgacgggttttaattaggatccgattaagataggttcatccgtgacggccgtttgcccgattgagataacttttcacatcagtgacttctaacctgtgacggacgccgtgcccgattgagatggaggttgccgcccgattgagctgatggtattcgttctagtgtgtactgattttcaaaagtacaaataattttatgcctttaaacacagcacaacgtcacccaaaaccactacaaatctagtgaaaatataaaaggtgaatggtatggaacgttcaatataatgatgagtattgtgcagttttgaagtttaggaaaggctgctaacaacggaatatcatagacggctcaaaagatgagcttaaaatggactcctgacaactaactaaagatgcggtaacaaaaatagcatacatgcccacaaaaatacgcaaccaataacttctaacccatgtgtccacaggtaattaattaaattgtctggctatagtattcaaaattcagctgcacattcgaaagaaatactatatgcttaggataggaggaacagtttatgacagatattttactgttccatatccctatataagaaaaaaaacaatcgacataagatattgcaaggaaatgtcttatgttgtctttttttttaaagtatctatgttttaaaatataagacacattttgttttgttagggcaagctttgagcaacacatttatgtgatccaaaagcataatcatatataagtaagtatttttgaatatgaatttaataaatttaattttgacctaatatagtaattgctagccaaagccttatcctaatgaaacaaaatatggcttatattttgagatggaggggtaaaaagcatggctacatatgtacatacaaattttcaaactaaaaagtaatctgtgctcacatagtcacataaatgaataagaaagttgtgttaaataacatatgaaagaaagagaggtatttttcgtcaaatcatagacaaaaatgtcatctttgaatcttttgcacaaagaaaagtctgaaagctaggctctgagctgaccaacaacacgaatgtgcgataaaacacgtgatgttccttgcaaatggtccagacatcccaacaaatatggtctccatcaaccaatcatcgtcgtactaattaaagtaatagagagaggaattttgtagcatatgcttttgcctaatagctagtgagtagaaacattaattcagaggatatgtgttgcatttgtataaatagtagaaacagtgagaggactatttgtagcgttcgcataaaaagtagaaacaatgagaggaatctttgaatcattcaaaaagtagaaacagtgagagggatctttgcatcattcgtataaaaagtagaagccgaaagatcatccacaaaaccaagtaattaaggtaggacctaaatatattgttctttactcagttagaccagacaatctcatagtagaaattttgtgttgatggaaaacatacaacaccactagggtagattcaacacatatttttgttcatagtcaacttttatattagttgagctcccagcaaccaaaaagccacatagaaaaagaaaatagtcccagcaggacgaggcgtgcaagctgggagtggcggcggtggatacacaggttattggtgctgcagtggttgtggagtatcgcggacgatagccttgatgagtgtgcatggatcaccaatctgtgttccttgccaaatgaccaatgtgagtctccaaaatgagcttctggtgtttaaagaggggactaatgcacatttgcatgggtacaaatccctaagttggccccaatttgtataggaccgagtttcctttacaggaccggtttgactgatgatgtggggccagtctgatcacggtttgttggcctgtcagaccggagtcctagtccaagtcgaatttcgtcggttctcaggttttcttgcttggggaggaatttttcaagttttaattggtctctatcccgagttagtcatggaggaggtgttgtagaaggcaagaccaatccctttataagggccaaggccggttaaattgagcatgttaacctaaaactcaagaagcttgttggcatgttttagcttcagattcggcaccatgcgctacctcccacttggttttccctatgctcgtccacctctagcagtaccatcatgttgcctcttagaaatcggaatagtctgatgaggatatgaccatggctactttatgtattcattaattaaaggtgcatattttctctgtgagatttatgtgttatatatttgaacaagcgttactacactatgagttttgtgtcttctcatttacagaggttcttggttgggtgaagggaaagagaccaaacacaagcaatgcatggattatcaaataagttgattaggtactgttgacgcgaaaaatacacactggcctgggagatctgcttagctccagtgaaggaccaaaggttgatgagatgcggacatgccagccagtttaatcctacaactgacaagatatacaaatagcagatcaatgagtcgatcggctgacaaactgattgagtaattccggccgatgccgatgtcagccgatagcgatagggttttgagcaatcggctatatatccaatgtagattctgacacttgatgtaaataacaatataaaggtgatcggccgataataatataatatagcaataatgtagtccaatagaaaccatttggctaataataatatgataaataagcatcgatccgaaggttaaagcatacatcggctggaggttcgatgtcattaaattctcaagattagataaacagtaaaatctttgttatgatcgactaaatctaatatgtatgcaatccttgtaagccgatgcaacatatctagataactcatcggctgaaaccccgatgaaacccttattggcagtcaaaaagtaggctagggattatggttctaaacacgacttggtagattaaacttaactgatgttgcactaagtatgaaaaaaaacataatatctagacaatcaagcccttgactgatttttagggtggtagatgcattagctaatctaatctagtaaaacaatttatccggtaccggcaggaaccctaaagcgagaaacaaccgatagaactaaattgagatattaagactagattaactaaaatatatgataaatagatagacaaatatctcatccaaaccggaatagtctaagaggtcgaatatactgatgcagccttgaacgacgctgacatagacgagacaattgcctgggccagcggaacgtaggacttaccccttcgccggagatcgaaagtcgatgcagccccgcatcaggtgccaagttccaccgaatagtaagtaaaaacttcggtaaagagggtgacgatgggccgagagtagttgtattgatcgagagatagtttacaatgaccccgggtatacatatttatacccatggggagatactagtccttgtaggacaagaaagaaactttcctaaaagataaaaggaaaacataaagtgcttatgggacactaaacacactttcctaaaagataaaaggaaactaacaaactatttctaattaatagataacttgccatgccgcatcctccttaaactcggtcacttctggataagtttcctttaatagattaatttccttaaccgaatatagcaggaatccgactattggcgacgtgataattctcttaggggcttaccaaatttcactgttaacaggtaccaaaccaatacattttccaagtctattccaacattagcatattacttttggtccatagaatgcaagaggttttatacgttttggattcggatttggcttcctaacaacatcaacttcaaacggaccttaccgccaatctagacaaaatagtacctattgcaaagcttatggagtctacattcagatgattttgatcccacatcaaaattctgaataagttgtcaggaatctgcaaaacaagccacataactcatccaatccgagtctgatttgggccttcggtcttataattgtatcgtggctaagctcaagggatggaaatcctaggctaaccctatgataaccctagtcatatatattcagttgttgtcatagtttcgagttggttttgcttagattatttctgttattacagtttcgccgttactttggtttgtggaactccaacaaatgcaatagtgttgcaattattcttgcttgtgttctttgatttgcatgtggagattagccttctcggcgagatcaattgggcagtgcacagttgataaccataggagacatggtgttgcaattgtagggtttggatcgtgttgatcggaagtcggaccatgtgtgccaagcttccgctgaatcgagtgttatcaatacctatcggatgattgggacctagtttctcatcacggtacagttttggagttagataacctgatgaggacatcattggctcggatataaccatgcttattttacacatcaacaagttaatggtacatatgtgctctattagatttacttaattaatatatgtttgaacaaacgttactgtaccataagtttttgtatattcttatttgcagaaatacttgcgtggatgaaggaaagaagtacgggctcatgaagtactttaaagatcaaagaatttgactagggacataaccaagaccttctccaagtctattcctaaatcaccactttactttcggtccatagaaggcaagagatgaagttttacaccttctgaattcggatcccgtcctcctgacaacatcaacttgagaaggacctagccactaatctagaagcaatctcggagcctataagtacttgttggaaaattatggagtctactttcagatggttttaatcttacgtcaaaattcataccgagctatcggtaatctgcgaaacaagtcacatacctgatccagtctaagactaatttaagccttgtaattgtgtcgtgggctaagctcaagaggttggcgccctagggcaaccctagcatggcctaatgatatttatttagttgccatcatagtttagacgaggttttgattagattattctaccaattgcagtttcgctgcaaagttcggtttgtaaaactccaaattcgagtgattcatcattcatatgcaattgagttacaatctaccttgttcttgcttatgctcttcgattcgcatgcagggattaacgttcttggtgaggccagccaggttgtgcacagttgatacccagaggaaatgtggtgcttcaattgcagggttcggatcgtgttgatcggaagccatatcgtgtgtgtatcaagtttccgccaaatcgagagttatcaatactatcgaaagattaggacctagttctcatcaattggtatcagagcaccagattgcccgttaggtataccttgtctcttctaatcactggttgcttctctccacttgtaaacactcaaaagtagtattatctaatttgaagcttccggtctcaaggccggaagtgctctttcaacgttttcctagatcgcatagtgcgcaatgtatatgtatacagtaccggttgaaagacaaaaaaaaaagattatcttagtatcctataaaacacacactacggctgctcttggtgataaaaaccaaagtacatctcattaataacaacatattattattgaaatggtaggaacttatcgatttgtgaacctagagtagctaagaaggtactccctccgtaaaaaaaaaaaaacccaaccctagatttgactatgtccagattgaaactcaagattggtttttttttttttttttttttggggtggggggggggagagggagagtagaactgtactccttactctttaccaaagttagatggctgaaatcaagccttctcgggagaaaaaaatgtggatgtgtataagttttggtaacaattttgtgaaaaataatctatgtagctttctggctagaactatatcagcaacgttgtacgatggagaatgacatatagaatggatgttttcagccggtaacgatcaagataaagatatagctacaggttcctggatttagctagcgctgattgcaagtgatttgtagggtccaggctagttcagtcatgggttttatgtcgatcgtcagacttatcttcatagttcgacacgacttttctttggctgcagtgcaatgtcctagctagcttccaaaatacacatttcgattgagaagcagagatccatctgcaactagcatcacacttaatttgtacttttatatatcctcaatttatataaaaaagttaataagttgaaagggccgtggtttagagacgtagatttgtatgctaatccaaaaatatccaactttcatatggtagcgtaatttcatcaacacacaaccataaaccacggaattaagcatctattattaggctaagggtatttaccatggagaaattcctctctttttgattatcatttacgagcacatttattcatcgataggtaccccttctcattcaatagcctaaacatttgaattagacacatatatatataggcatagtaagttgcgcagtgcgagtatattaaccttttaggattttttgtcttgtttattttgttgcttcttataggtttgcacatcatagagaggctatataattaaatgcagatcaatatataccagataaacagatggtccacaattagggatatatatctatatggacatgagagtggacaacagtgggcagcaagcagcgatagcttggttccatgattgcatcaaaccaacagttttgctgctccaagtaaattcagataaggttagggctgagtattgagtggacaggatcaaaccaaactgtgcaatatatatattgatggtgatcctatcaaaggagttgcggtttgtgccttaattatctctaattgaattactatatatactaacatagctcagatatattctgctcgtgatctcagtacaagcataaaaaggattactacaactttattctgaaagttgtgaagtactgcattgaacttgttaacctaaatatgtaacttctaggtacacattgttagatttaattgggtaattaatccatttaaatcaattaaatcaaataaattccaaggctcattatgctaggaattcatgattgttgatgcttattcaacgttaagcatgctcatgttgattacattcaccactatcactggatcaaatcctattgtaaatatcatgattattnnnnnnnnnnnnnnnnnnnnnnnnnnnnnnnnnnnnnnnnnnnnnnnnnnnnn

SEQ ID NO: 25196 - DNA, 25311 bp, Oryza sativa
  unsure (1)..(25311): unsure at all n locations
tattgtgtagagaaggttttagacttgtgtttgagtccaataaatgtgtcgtatctaaatatgggacttttgttggaaaaggttatgacagcgaaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcatttctttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacagtgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaaaactgttgattgtgtgtttcttggttatgctatccacagtgtgggttatagattcttaatagtaaactctagagtacccgacatgcatgttggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactattggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgctttcatctgtaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaagatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggtactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaacttatagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctagcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagagctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaagaagaagacacactttcatccattttccaaagctgttgttgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgattattatcttgttattttggattaaaatatgccgaattatgaccaaatttccaacacacatttcagtaaagtgaggtcagaataggtgtaagctcatatagctaacttcacgctaggtttagccatggtttaatatatcgattgggcaatttctattgggggaacctatacgactgaaatttaggatattttggtccaaaaaaatttgaacaaaatgggtcaaatttgagttttttctaaattcatgaaaatttgaaaaaaaaagatctaaaaatttcgggcaaaatagtttcctatcccggggaccgataaaatgaaaatttccaaaactgaaattttgttctggaattttgaacccaagtttacgccttgagcaagttctaggctgcatacctacaaaactagaaaatacattaaatatttatttcttcagaaatgacttgcttcaaattgagacacatgagaaaacgacatacgcttcaaatttagtggtactaggtttcctcgtagcttgtgttttgaagctcccattgcatgcactctactagtgcatgctaaaacaaacattataaataagggctattaggcaattccttttgataaattagggccggcctccacatcttgctatggagcctgacttctgcattaccaaaggatatggagaagctagctatatgaagaactcaaagctacaattttgtatactacccaacttgttctctatgtaacattaccatagtgctattttagtagatacatctacgtatttcatgctaaataaggttgttttctttcattatagaaatagaactacatcaccgacctgtttgtactttccttttcatctttagggtgaaatcatgtgttcatgcaaattagccatctctttaaatgtcagaacctatttaaacatcagatcagcgttaccatggatgaaaaacatctatctatttattatatactaaaagtccattaaacttcctacaaacgctctcatgccgccacacgagactcttacaaacgctcccaagccgtcacgtgttaatctaataatctggtgaacccaatattatatgaaattaaatctatttttggaaaaaaaaatccacatcccacgtccagcttggtctgtgcgtacgggatatgtacgtacgccctcccatgtttcccctttaattatctcctatttccatgctacatgatctcttctatttccatactatattagttcctatttttatgatatattagtcaaatgtaaatcataatttataataatagttttcaaaaaaataactaaatcaccgtcatataaatacacatatatatgtacaaacgtacgtactccctccctcctgttccacaggaattagataagaagtgcattttatttttatccgttcgtgagtatgagaccatcacaaatgatttatcatggatggcttcgcttaagcgtgtcttaaattgaatgtgtagatcggctaaaaaagtaattatttatttatgtcaccaagatcattcatatataaattaaagttcatagatccaataatttttatagtaataaatgatggtgcataaccttaataaaaaataaaaaagaaagagaatactgagggggaggggagcagatgtggtggtacgtgcgtattatacgtacctgtgggtccaagagaaaagggtgatcggatcggtggatttaatctaatggttagtattatcgggttcatcgttttaaataaaaataaacggttagatatctttcttttttcttagaatttattagagtgccacgtggcggcttatgaccgtttataggaatcccacgtgacggtttgagagcgtttgtaggaagtttaatggacttttagtatttttaatttatttgaacagtaattttatttgttattaattatactatataaaagtcaataaaacttcatacaaacattctcaagccgctatatggacatcctacaaacgctcttaagtcgtcatcgtcatgtggcattttaataaattaaaaaatatcacactactccaaccgtatgtacgtatgttttcctccctctccctactcttctttaaattaattttttaatgaaaaaacaattaataatttaatatccatatcacccatattttactataaaaaactaaaatacattatttgaacagattgcaaccaaacaacatccaatttttaatttatttgtaattaattattaatctatctattaggtactaaaagtccattaaacttcctacaaacgttcttaagccgccatgtggcactcctatagatcctcctaagtcgccacatggcaatatctaatctcaccgttgattttatttaaattaatggacccattagtttacactattagattagatttattacttaaaaaataataattttctcatgtttataacggacaggcggtactactgtccgtacgtatgagtttgtacgatacaaatgctactgctgttctttccatacgtacaaacgtacatgatctttcctaatcttgctgaaaaaaaacatacacatgtacagaaaaagacagaaaaaacatacatccataaaaatcagcggtctttgaaatataatttttgataaaatatattacttcacaaatataaatatatttagttaaacaaagatctataataaatatccaatcaatattctttaaaccatcttctgaatctatctattatatattaaaagtacattaaacttctacaaacgcttttacaccgctatgtggctctcaaatatattagcgaaatcctagaaatctattatatattataagtctattaaacttcctgcaaacgctcctacatcgtcacgtggcgctttaatttagattaatcctagaaatttagagtaaaaaaaaagagaaaagcatccaatcttcaattgtcacttaaattagtgacacattattttaaacattggattagagctcttaaaattcccacgctgctaatctctatcccggaaaaaaacatagtgtgcttacatcgtacgatcgtctccctaccaagaaaacaaaacttaaatacctacgccatatacgatcaaaaaaaataaagctaaaaaataaaaaagaaaacatgcacacgtacatagaacaattggaaagaaatactaatcaggaaaaatcatcggtgtgagcacatatttgttgtcaacggcctttaatctacaattttaagatcttcctccccactctgttatttatagtcctggtgtagatagaacttcctttatggtttaattccgagcggtagtaaataccaggacttagcaatatttgattgatcacaactcattatattccatttattataaatcttccaaagtaattcattataggaatgctttcaagaaatggtttgcttttgcacatcgaaacaaaaaattaatcgcgcggatatgtataattcaaaagaatagatgagtgattcatacacagatatcgggatttttatttaaatctaagaggcattcttatcatattagtagtatattaaaatctcccatgtattttaggataatctaaattcacttacaatatatatatatatagtgatgtattattccttttttaataacaaataagatgctcgtacatctgtacgaaattcctttccgatttatattccggaaatgttctccagtttatattctgtcattatagtgtttgaaacacaaaatataatacatgcccgcgcgaatgcgcgggctacgttcctagttaaataaataaagataaaaagttactgtgtacagtctacagattatttcattctattcaatcgagcctctacttattcttgttgatttgtgttctcctgaattgtcatactttctccacttgtaccctttgccttagcagaagattttcttctgatctgttgcttcatatatatatatccatctcctattagcccaaccagtcacatgcatgggcttcttgaatactccttgttcatctgatccaagcccggttttttactcccttgtctctatttgtacctaattgatcagctctcctctttatagctcatagagctttgctctcatcccacttgatccctctatttgattgctcaagcttcccgttgaccacgatgggttgtcgatgttaagcccccgatggtgtacctttgggcactaggtttgtcgaaagtatatgtatgtagttgcaaaaatgctaccttaaatcgttctaatgattattattcaagtgagttccaatggagcaaaaggattgtgttctttattctagttggtttcttgtatttggtttgcatttaattagttggttgtctttatgctagttggtttcttgtatgttggttttcctttaatttgtaataatattgcttaatgaaagggataggtataactctatgaggatgatgggcgaccctacttggggatgagagaagtaaaataaatatgtgtaacaactttacattatgatataattctatgcccaacacgattttattagaccacctaccagttatataaactagtgatctcttagaactagcaaggtgggactaaataaattattttactatgtgtgcacatgcaaccatgttgtataagctatcagcataggcctagtaccaagcagtcacattatgagtgagagacatgctataaacatgaaaaagtggcaatctatatgaatatgaatgagagacatgctataaagatagggaaaaaatgcaattttactagttatataggctatgttgttgtaatatatgttaatgtcaacggtacaaattttgttgacggtaatggggtgcccgatcttccatcaagtagagattatcgatttggcagaaacttggtacacacaatctggttttcaatcaacaaatataggttctagctaggtcgatcaaggacctctagaagcatcattattggacttcaatacgatacatggcccagcggcccaaaagatggtgatgcagcactcagatagattctggacgccacttctttcagaagaatttttgacgtgagaccagacccattggaaaggtggtctcgttagctttccatatgtgagtctgaatgcggctgcgtgatgtttttagcgcagactactcctagagcctaaggtagactcaaacttgatatgagttggccctccatcttgacttcaacgcctgacatcatccttctagcctctctttttggtcttctccatagtttctaattataattaaatcattggttagtattttatcaaaatcacatgaagaaatacttaggaatgagctcacctgttattgcaatttatgaatgcgagctctagtgattggacctttcatgacaacttagagagttttgtgtgtatccaaagcagtcatatgttctcatcactagtttaactcaaagtgaaattatcttcagattaaattaattacatgtaccatgcatatatttttctagcttgcagtactggtttcccacagttagtcacaatgccatgtatttatgtttgctttgaatgttagggaaaggctctgcttcagacaaaaccgatgattgaaaaggccattaaaaaagtacacactgctcttcaaccaatgatgatacttgtagctgacctaggatgctcctcggggccaaataccctaatgtttgtctctctctaccatgattagagagatcgctgaatattataacaggatcggtcagtgccccgtggatgttcagtttttcctgaatgatctacctagcaatgattttaatcacctgtttaaatctttagaacagattgataattttgttgctaaagatcaaaacagacaagcaactacactgcctcaatactatgttgctggattggcaagctcatactatagaaggctcttccccaaaaatagtgttcatctgttccactcctcgtatgctctgcactggcgatctaaggtaatcagacaagcttatcacagttaattgcagatgtccaggtgaagcatacttttagagtagtgcatttagacatcaatctcatttgtatttagccttttgagatatatgctttactaaaattgtagtatttgttttgaatttatatatgaatatatacaccttggccatcgatatagatcatgcaagagtattgatgaataatttacctgctatcgccagatcttgtcaaaggagcatttttttgggatatattctaaatgttatttttatttggttttaccataaattttgatcatagtactagcattcaattattgagataactaggtgaaaccccgcgcattgctgcgggaatttagtattataacaataaaaaaaataacgtgtaagatagctatgatagctagataacaccagattaagtaaattaatgtggtttatgataatttaaatttaaatagtatgtagaatggtgattcaaacgtaaaaagtaaggtggtatgattttatagaagaagaaaaatagggagatagtttaggtgtgtggaccatagattaatcatctaaaggctaaaaacaattgatgggatatgacttaattagagggaaaaaggagaaagataatctggaccatagattaatcatttaagcactaactaagtgatgatgaactatataagtatataggatatcataaaacataataaagatgtatattgaaacattatgtgaattatgttggatgataatttaacatgtttgtatttgaaaagctcttaaattataaaaactataaagacatagcatgtttgcatgatgtttaaatgtgatgattgttagtggatgatgatgtggcatcttgttaattagtagattagtgaatgatgatgtggcatcttgttagtggatgatgatgtggcatctttgcatgttaagcttaagtagttagtgggggataactttatagtaagatagaataagttgggacttgttatcatactttttctttcacctatgatataaaaagagtaaatttcactttggcctacatttgtgaccgatgtttcacttaatttggatcacccttcaattaatgctttcactttggactgagtaattttacctttgtattactttggactaacctgactctttttcgagcatatatatgaatgatctcaagtacatcggctcctactcgtcaataaactctcacagttatacgcaataccatttctttggcatatgataaattggttgtagatagataaaagagttaagggtggttgaaagtgcctcaaaggtaaaaatacctgatacaaagggataacatagtttaaagggtggtccaaatcataaacaaaaactgatgtagtaaatgcgtatatcttgtatatgcaggcatgagatatagataactgttattattgagggatcaaaattgctgttagcactatagcaaaatatcaagattttgttcttcatatccagatgttcgaaatgaaaaatataaaggagcccctgaacgaaggcaatatttacatctccaagactacacccatatcaacagtcaagttatatcaggagttatttgagaaggatttctcaaatttcctcgagttgcgctcaaacgaacttatatctagtggtcagatgctactcactttccttggaaggaagaacgaagatgtatctgatggagatcaatgtactcttcatgtattaatttcacgagcaatacaatctcttgttatggaggtctacacaatccatattactcatgatatattaattactatacattgtcatatatatatctagctagattcttcaatgaattaatgtgcttaatttccactttcaacacattagggtctgatggagaagaaaaagcttaacaacttcaacatgccggtctacatgccgtcaacgcatgaagtgaaaacaatcatcatgcggagcaagctgttcatcatcaaccagatccaactctctgaatcaaactgggatccttacgacgatgacttagaaggagaggttgtgctctacccggcgcaaagcgggttgaatgtcgcgaggtctttgaggccagtgttgaggcggttgttcactacctattttggggaatcggttcaagatgttctcttcttaaggattgccagtaatgtaagcaaataccttgacaaaaggaagggaaagcacaatgtcattgcactgtcattggcaagaacatatggagatggagtgctatagatgatgatgatctggctggtacatcttacttcctatgtttcatattataagttcttttctaatcaagtttggttaagtttgactaagtttgtagaaaaaattagcaacatctaatatattaaattagtttcattatatctaacattgaatatattttgataatatgtttgttttgtgttgaaaatactactatatttttctctaaacttgattaaagttaaaagaagtttaactagaaaaaaagttaaatgacttataatataaaacggatgaagtaactatgttagtggccagaatgacgatttttggctggtttgtcgtttgtgccaatctgggcagaggtggagaccccacagtttcaaaatttgcattgtatttactggagtttgaacaaaatctgaaaaaaactaaagtattggcttcgttcaatcgaatatttttagtggtcctgtttccgccgctgattctggctattttgatccatacatattccatttttttttcctttttagtgattattgcaaggctcacatgcacaaatttatgtgacatcaaatttgatcataaaaagtataggttctacgatgaatttggtttattcatggatgatacaagttccatgacaaaatttgctgattcgtcgtgactaaacgaatgtcacgctccgttttttacgaacacgtacgaatacgtcacagaaattttcttatgacgaattcgtcatcgaccatgacattaaagttttatcatagatatgcacatttctactagcgactacaagctgccaccagcccaccaccacacctctgaaacatacgtcgagcaccttgtgtgcgtgcccaaagcactaccagttcaatgtacatatatgacggctagattcctgatcaattatttccgatcataccatatcgccgtgaagacccttctttcctcccacgcatggccgccatgcaccggcgaaactaggagtttgccgtcgcgccaacccatttggaaaaggaaaaattggaaccatgccattataattttgtaaaatttgtaaatttaagatatgacatgctgacccacatatcattgactcatgtggatgctacatatcattgagataccgatggcatatcttaaactttgtataattacaatggcatggttccaatttaccctttgcaaaatcaaaccaactctcacaggcgcaatatgctcgtgcgctaggttgaaattaggctgtttggttggctctcaaaggttgctatatcaaacgttaagcataccataatttgttagtatagtatttggttagttgccacacctaaatcatgcctcactttataaattattgggcctgcacgccatatactcaaattcttgccaaacttaattatacttgtggctaacaaattgctagtctcactttgtatggcataacacacttgtgacagagtgaggtgtggcaaacttagtcatcaaccaaacaacccgttaaaacctatgatccgagtcagctctgcgcatgtcgtgtcgccgtcgctacagtgccttgcgagggccatatgccatcactgtcctgtccggtttgtcgtggtcgcctcgtcgacatgccattgcgcgtgcagacggcgccatgccgtgcctgtgccgctcgtcatgcacaacatgtgcgagagagggcgagatggagaagaaacagatggaatgggagaagttggcatgaccccacttttgtcggcctccctggtttttttcctctgagagataaatatcatgtggaaccacctgtcagtggtggcaatattttgatcttagaaaaataaatcaagaaatctatatacctaataaaaaaataaggtaaggtaaggttcctaataaaagtttttgtccggcgtccatcgcaagcggaatcaccttcagtaatcggtttatttttacaataatcaatatttttggtaatcacatccgtttcctaatctgcaaatctgcaaagccatgcccaccatcaaacccaaataaatacggtaatcagttttttttagtaataacatttgttcatgatagcatcaagtttttgcaaccgtcggcttgtttggttttagggtttattgtttggtccacgttcaatttaagattgttttttaattcatgtttatttcttgtcaattgaggtataatttccctggtaattatgttatacttaagtttcatgtacttaatttccccccttttattttcaagttctgatctagcgtaattaaggctcaatatctatgtaagttgcatcttgcctttcaaattcatggcttgagtagcacttagaagtaggggatcacgaatgggattgaaatcaagcaaatttccaatattccccaaattcaaaacccaaaactttagttttcctcaaatccgaaatcctaatttcatttcccccaatatcaagaactctaacctcctaaattagacaatcccgaacccaaaaaaaccccaaattgatcaaatcttgaaacaattagggcctttgctaaccgaattaggacttacggatcgtccaagataactacacgaggcatgagctatgtcatcatgcgcatctccgatatcctcctccgttatcatgcgggtgatgtgctacttcagctgcgccgtgtaccggccatatttcgccgcctggacaatcccgcgcatgcctgacttggccgtgtgacaatgaggctcgcctcttatacagcctcaaccacaccaaggaggagaaccatggttggggagcggaccattgacctcaggccaccgtgcgccatcgccgccgtcgtcatcaccttgacatcgctgtcctttgtgcatatgggcaccctgctcgggtagacttggtgatgtcgactcacggcgcactatcggcttgaccttcgtatccgtgcacggcctaagcccgccacacacaggcacgccgttgcgaatcatcgccaccgtcgcctagctcccttgctcacaccggagaaatcggggaaaatgggagaaatggcctaagattaaggtttttcagaaaaccctgcttccatgatcagtttgaagcaccctgcaggactgatttattaaagtttaaccatacaaacagaaaactaagcgcacaactgtcatgtaaacttttgaaatattttgtaacgtagtttatgctgccatcgaaggatactatggaatttcaccctaaaatatgacctgtgtacaaggagattttttttagataatgtgtacaaggagatatcggctaaaaagagaaatatgctcataatctggagtgatttgtagcttttcctttcttttatttttgggggagtaaaatatgtcaaaaatagtttaggggccggtcaattgtaaaaaaagtaaatagattgaggtagttttttttttctggcgacctaacccattataaaaaaatcagcgacttacgtaaaatgtataaattaagcgcgctgctatttaacggcgactgatggcggaaacatgaattagagatttttttttagataatggaactttttattgaacttagactagatcgccatccatattcctgggtaaaaaacaaagactaaattgccactcatgaacaactcattggccatttcctctaaaagcacagagttttaagggccaccaattctaagactagatcgccatccatattcctgggtgaaaaacttcttaaccatcttctccaaatattgacataccacaactaccatatcctgcgaaccaggcaaccaaacttctataggatagcctatgtacgaagccaatggataagagaatatataaccttcaaatggatgtgaggatactaattaaaagtcatggaggaagcctaaacactgtatggcctaatcagtttgatgattatatgtgagaaaaaaaatgctggatcggagggcccaagctactgatcgttccaccctgcagtctccgccactatggaatgtacctcgttgctgtctagctgcctgaagcatgtggatcacacgccacaaagtttatatgtggatgagatttttttcaggattataatcttgggagtgttgcaaattaatgtcatatatatatggaccatatgtgatagcccttaattttcgcacttttcggtggtagagattgattgtcctgaatgcggacaaacacagcagcaatatatacgtggggaaacaacaattaattaccatcccactttgtaaatatatatttgtatatatatcattaattgttgtaggcgtgataaacgtgtacaatcaccatttgcatctataaatataatggcaccatgatttctatatctatatatgctacttgtgtgttgaacctcccagttgtatacactcctaaaaagaagttattaggtctcctcctgtatcacattatccacactcttagtcttagctatatggaaattgactttggcatggttgaaggggacggagaaaatagctatgcgaagaactcgaagcttcaagttagtacacactacacactaactctgtttctttgagaaattgcagattcatttcagtagatatatattatatatatttatagggaaatttacttttaattcggtatattatgttgatttgatttgtctaaattgggctacacatatttgtattttcttggatcaagttgtttcgtgaggacttctgtctatattatagtaaaatttttcagtccttccgaaagtctcaaggtagtttcctctggtaccaaatattggatggtaaaattgctcaaattttatactaaaaattttggtatctcgatacacctactacctgatactacaaaatatggtacatcccttaaggatggtaaaatcacttttatatgcatgcaagtccaatgtaaaatcaaacatcatggttctgggtgaaaaaaaaaactaaaaatagaaaacatgcataagctaggttttgtttagataagggattttcattaatccggccactatgcccacgaggggtatacatatccaaaaaggatacaagagtatttaaactcacacctcaatagagaggagaacacaaacccaaaaaatgaaaaacctacaacctctgcatatccctgtatcccgacatcctctagtgaacaaaattgacgagtggaagttgtcttctcatcaccgcccctaatgcgttctcgctgctaatctccactggtgccatcttcatccactttaagtgaaccggtgccacacgccaccgggtagcccaccttcatccatcgtcgtccagtcagaactagccgaccaaatgcgagatgaaaggatatgcttatgctttgccggattcctaagcctttgcagccgatagggccgttgccaacgttggaatcctctactacctctcggactctcagcctgccgccacctctaccggcgtcctctgccgtggtgatcgagcatatcatctttcgtccggacacccaggcctccaccacccctagggctgccatcaccgacgagatccaccttcgcctgtaccaccttgcaccagtccttatgccgccgccgcccctaagaccgcagctgccgtaactaaggagatcgctgctcggactcgcaggccgtcgcggcctctagggtcgcagctgcctacgacatcaccttcatcggaacggccttctccttgctgaggactgagcatcgaagcttaggccccctgctgtcctccgctgcacccgctgtcctccgctacacccgccgccgcagagacgtcgcggccgacccgctgtgacaccgcctcccgacccctccgctgccgcatgccaatctcgggttcagccactgctgctgtccaacgcttgcgcctccatccctcccaacaacctccgctggcacgcgcggccttgaccaccactgcccatggcccctccgcctcccacgtcgctagatttgggggctggaacccgcagacccgacactcccctccgccgcaccgaggtctcctctggaaaaccccgtcgccgctttcctcacagctgcactgctcaggtggtggcaaggccatgggaagaaatgagataccagatatggggaaaaagccgaatcaggccagtagtatgaccatataaaaagggttaattggatggatgtcattgcaactttactattttgaaagaaatgttactactagtcgagtgaaatctattagtatgtgctactccctctgtattttaatgttgacaccgttaactttttgaccaatgtttgaccattcgttttatttaaattttttatgcaaatacgaaaatatttatatcatgcttcaaagaatatttgatgatgaatcaagtcacaataaaataaatgataattacataaaatttttaaataagacgaatggtcaaacgttggataaaccactcttctcaaagacctgctaatctccccccaaagcatgtaatgagaataaaacatgcaaaagaaattgaaaattcatttcagtagatcagaatgtgccaaaaaaaagtgaagcctttatctcagtaaagccgggcgtgaagcctttgatctaaaaaaaatgtgcaaaaaaaaaacagatctggtgtggtttctttctttcctccagcaaaatgtagggaaaaacaaccatggataaaatcgttcgccgtttgctgaagaattgaaagccctagagttcttccgtggcggcggcgacaaaagaatgcgtgcttgtgcggcaggggaagaaattgattgttttgctgaccttaacgtattgttgcctcggctcagctcgtgtcgtcttgccggcatccgctcacagcacggatgaagaactgcacatcaagaagctcaagaatgacaaatggggcggtataacttgattgctggcccgtgatagctcgccggcgtctatgcacggaggcaactcttgccacaggaggcttcgcgcagccgccgcaggcaacagggcctccatgtgcggcgatggaagctcgtcggagtccaggacaatgactcaaggagtgtgatgtggaggaggggacgggggatgagggcagaagggggttggggaagaggggattcctagagcatacctgatggaagtcctcggccggagactcggcgagactggatggagtgccgcttccgccaaaggaagatgcaacggggatgcggccggctagcggcgagcggccgcggcggcggcgggtggcgattcggtcccgataactcttgagaatctggacgagaataggaggtgtcatacacacgtattggtcccccccccacaacaacccacatacgaatcttcaggtgggccagcgctgtatttcgagcgtgcactcaaaataaagaaaatacgatcctaaattcctaacatctccgtatactatttgacgcacgaatctttaaaccatcgtgtggtttctagcctaggtgccgcagcacctaggtgctaaaaatactttccgaactatctcctccttccgcacggccgcaagtctccagtagatcgtcgccatcggcttctcacaggcacagctcgcctcgtcgcggagctgcagggagacacctgccacgccaccaatggttgccgcacgcatggggtggcgacccgccgccgccgcccgagccgttcttcttcgcgaagctcgccacctgcgcccaggcccagcacactacgtacgacgtggctcgcgcgccggagtgaagctgtagctagccatcactagactagaaggcacgacgacatgtactctacccaacggcacgaacagctagcaccagcatgacgcgctccttgtagacccgagaagttggtgctgccgcacgccagcacactcgccatgccgatcgaacgtcgactaatcaaaattgaccaagaaaccatccacaaattcaacaaataagtggtagaaattgaagcagttcttgcgtgcgatcgagaggggcgttcgatcgaccattacatacgagaagctagggaagcgccggcagggggagctagcttgccgcatccacaccacgttcccgcgcgcagtacgccgctggccaccagctgcccgcgcctgctctcgcccttcttgccggaaccaagaagcagccaccagcggcacgaacagagcttctccatggccatgggattgggggaaggggacagaaattgtgacggcagtgacgtacggtagtggtatgttttcaaatttagaaaattttgatggcacgtagtaggttttcgttagtaccgatggtattttttctagaaaatatataagaaaaaggaaaaggtgtaactaaatttatagaaaaaaatagtaacatctacgacaccaaaatagttttattaaatttaatattgaatatattttgatgcaatttttgtttcgtattgaaaatgttactatattttgctacaaacttgatcaaacataaagaagtttgactaagaaaaaaaatcaaacaacttataatatgaaacagatggagtagtttgtttactagtatgcaactgttaattccaaacaatttaacttgatttaatataatgtgcacatgaattttaggagaagactttggttgctactaagcctatgattcagaaggccattcaagaactatactctgcagttcttcctaggacgatgcttgtcgctgacatgggctgttcttcgggaccaaatacactaaactttatcttcgaggtgataaaagcgaccagcgaatattgtcaaaggataggtcaccgccctgttgttttatgaatgatctacctggcaatgactttaactacctatttaaatctttagaacaactagataacttggtcgccaaagatcaaaacagagaagcagcaatactgcctaagtactatgttgtaggcttgccaagatcctactatacaagagttttccctgacaagagtgttcacctcttccattcatcttattccctacattggagatctcaagtaagtctgtctctgaaaacctatcccagttgagtggtaactcattaaataggccatgcatttttttttactgatcgaaagagtacaaataaactggttattagttgctaaagatttctactgaattctagtattctacaacaaataaagtagttatttctatatgtacattttgtaagttcccatcgattatatactcccataatttgtcgctttttttgagaaaataatttctctattcactcaattcatacaacatacaaaacagtgatattatgaaagtagtaaagtgaatgcattttttgctgcaatgcatgagatatccaaaaagagagaccgcattttctgtaccagcattaggagttcatagcaccaataattaatatgtgtttatatcttccactgcttttgtgcacagatgtttcaggagagcaacaatggggaattcctaaatgaagggaacatttacatcgccaagactacccctaaatcggtgataaagctataccaagagctattttacgatgatttctcaaagtttcttgagttgcgctaccaggaacttgtgtctggtggtcagatggtgcttagttttcttgcaaggaagaaagatgacctatatgatggaaacctaagtgttctttacggattaatctcacaagcattgcaatctctagttatggaggtacactaaaccactaaccctactaattacgaactagcattatacactcccattttcctatagcttaactaatttctatattggtggatatggaagccatgaaatttagaggtccgtgtatatatgaacatacacacattttccaattcaaaaaaaaaaactttgggctttcctcaggacatattctgtaaaaagaagattttcaaaccaatttgattaattgaaatgacaatttactcaggacaatgcagatttgtttcaatctaaaatgagccacttagcacttactactatttttttaaaaaaatggattaaaatccggtctctatatccaaacattattacaccttgttttctacgctgatacttcacatttccagtcttatgtacaggatgattggttgatagcaagaagagtgttataaaatgaacaatacatattattttcctcgcctgatcagtatattataaacagagtctctaaaatgaaagaacttgctttctgctttcaacatggcagggactcgtggagaaggaaaagcttgactccttcaacattccaaattacgagccatctatccatgaagtcaaaacagtggtgataagcagcaagcttttcaccatcaacaaaatttacgtctttgagtcgaactgggatccttatgacgactcatcagatcaaggacaagcaactaatattaatcctatcaagagtggcttgaacgtcgccaagtgcattagagctgtgcttgagccgttgatcgctagccattttggagaatctatactagacgtgctcttctctaggttcgcacgtaatgtcacccagcaccttgagaaaaggaagggaaagcacagcgtcattgtgctgtcgctcagcaaaagaaagaattaatcacaagagcggatggagcatgagaatttagccgttaatttcctcttattttgatttgtaatggtggtaatggcctggtcattgtgtagtttgtgcttgttcaagccttttgtgtgttctggaatgcaccatagtattttgtagtttaataattcttaaatttagaattaataggtattgagctgtatctgtgttggaatttgcttgtattatattgtacaaggaaatatcatttctctaaaattaatgattatccggttgtacctaacatgaactgctattgtttttatctcaatcatattcatctaatatttttttctttctttttttttgaatttccgttagtttgtacgtagtaaacttaattactttccatggctatttaattagtctgcatataatctttttgtcagacttttacaggagaaatctgaataggaatgctagcaaaaacgtcatgtgtattatcatatcagacatatagaagtttttctgtgacttctacgttggtaaaaaatcagattacgcctctatcaagcccacatttaaggaaacgaaatgtcgtaccgatatccgacctagtaagtaacattgattttagcgtttctcttaatccgttaatcgaatttgaatgaaacaagccacattacaacgacgaggacagtgcctaaaatttctgtttagactacataacccaatttcaaaacattttttcagcatactggttgataaattaaaatctgaacgtttgactatcgaatcaatttctattcattttttatacgaacagggatgaaaagtgtaagatcaatctgtgttttgattcttattctgtgttaaacagttggcatctgtgattattggttttgatatttgcagattatcgtcgaagtggttttggagataatcaattttcaggtgatgaacatggtttactgttttgttgggaccggtcagaccgggcggaggttgccggtcagaccagctcatgtgtagtggtcagactggccaggcccgtggtctgaccgggcaacgctgtgtcggtttcggtttcgggttgtttctttggatatccgtgattgtttcaaggttatggcttttagatggatactatacgtatgtaatactgttgtttgctaataatgagtcaagtgggggatagtttggtctcgaaatatagtttctttgtttgtttcatgtgtaggtgactcgatgcctcgggagagtatttgtggtgatggaccgggagtcggattggtggtaagacgatgtccgtgatggtcagatatcatgcgggatactaagactagagttgatgcacgtggttggtgaaaattccaaatggcatacgatagaggtattgtgtgcgtatgggatgcggagtcgaatttggaagtagtccaaatttggtatgattggttatgntaaaagttgtgtcttgtactaaagggtttcctaaggtgtttaagactcttagtatgagtttggttcgtggctttaggcttgctacctcatgtataaatatagggggagagtgaggcttcccggtatcgtttttaagagcaattaagttactagtttagttagggttccgagttaagtcgagatttttgtaaggagtgctattggtgcactttgtaaacacagagagaagcaataaagttatcatctactttaagagttcttcgatttgtgtttcatcgggttcggcggtctaaccggcgacatatcggcggtcagaccggcggcaggcggcggtcagaccgacggaggagaggcggtcagaccggtggtgacttcacacgcggcaggcaatctttaggcggttggaccggcggatcaacaccggtcagaccggtggcacgagctcggtcagaccggcggatcaacctcggtcagaccgatctacattgaatttgagagtaacttttattcccgctaaaagtttgggtttttgggtatatcaaccatttacaccccctctggttggcttagtttttgtgattcgatcttaaaaaaaggagctacccattgcaaattaaggacaaactgcatatttgaggttgaggcaaacccgctaaatctctgcagaaaatacccgaaatccttcagttctcgtctcgatctgtttcccagacgaaagcctctggctgttgcagcagctagcagcaaggatttacggtagcagcagcaagcatgcatcaagcatcattggcagcagcaactcagcgggtaaggaactgagtctaaaccaagtctaggcgattgattagtagttcgattttcattagactttatctttttaacta

SEQ ID NO: 25197 - DNA, 503 bp, Oryza sativa
  unsure (1)..(503): unsure at all n locations
nnnnnnnnnnnnnnnnnnnnnnnnnnnnnnnnnnnnnnnnnnnnnnnnnnnnnnnnnnctgacgagtgggcccagacatttgccacatcagcgaaaatatgtgaacatatgtggagagaagagggggagagagagggtgctgacgtggcatcctgacatatggggcctacactgactcagccgcacgtaggacaaaactagggtcaaaaccatcaaagtacctaaagtgaacggtttttataagttgagggatgacatatatctagttttacggttggaggacgattttgtaactcgatgacaagttgagggacctttggtgtacttttttcttctctttttcccttcccctaagcaggccgcccaacccagcccgcaactattcaccatctccttccttgagatagccacttgcacgcacacagggtgtttgacgaaatgctgacccagacgccgcaccgttccacatcatgtccgtgctgttcccaccctcccgtgcgccc

SEQ ID NO: 25198 - DNA, 522 bp, Oryza sativa
  unsure (1)..(522): unsure at all n locations
nnnnnnnnnnnnnnnnnnnnnnnnnnnnnnnnnnnnnnnnnnnnnnnnnnnnnnnnnnnnnnnnnnnnnnnnnnataagccatcctaccatgcaggaaagaagagaagcacatcatgaaaatgagctcttttcaagggtctcttcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgctagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggggtaccgagctcgaatt

SEQ ID NO: 25199 - DNA, 705 bp, Oryza sativa
gacaatcccgcgcatgcctgacttggccgtgtgacaatgaggctcgcctcttctacagcctcaaccacaccaaggaggagaaccatggttggggagcggaccattgacctcaggccaccgtgcgccatcgccgccgtcgtcatcaccttgacatcgctgtcctttgtgcatatgggcaccctgctcgggtagacttggtgatgtcgactcacggcgcactatcggcttgaccttcgtatccgtgcacggcctaagcccgccacacacaggcacgccgttgcgaatcatcgccaccgtcgcctagctcccttgctcacaccggagaaatcggggaaaatgggagaaatggcctaagattaaggtttttcagaaaaccctgcttccatgatcagtttgaagcaccctgcaggactgatttattaaagtttaaccatacaaacagaaaactaagcgcacaactgtcatgtaaacttttgaaatattttgtaacgtagtttatgctgccatcgaaggatactatggaatttcaccctaaaatatgacctgtgtacaaggagattttttttagataatgtgtacaaggagatatcggctaaaaagagaaatatgctcataatctggagtgatttgtagcttttcctttcttttatttttgggggagtaaaatatgtcaaaaatagtttaggggccggtcaattgtaaaaa

SEQ ID NO: 25200 - DNA, 473 bp, Oryza sativa
  unsure (1)..(473): unsure at all n locations
ggcgaattcgagctcggtacccctgtcgggtttcgccacccggcgatctaatggatgctcatgcaagaaaatcatttatataatagtgtttagcaatttcataactatttaattagtacttaataaacaattatcaggtggacgtcaaacagctaattacaattccactcccactacaacggcacatgcactgaatgcaccgtgccctcgtcgtttgtccctgcaaggctgaacacgtagccacggccgcgctcgtccctgaccctgagcttaattaactccgaggtgtacgtggttcttctcgccaccgttgatggagctgccgatatctttggtgccacgctttgccctcggtcgccggacttccaagactaccctcgacgacgtagatcgccatgatgacgctccgacgccgnnnnnnnnnnnnnnnnnnnnnnnnnnnnnnnnnnnnnnnnnnnnnnnnnnnnnnnnnn

SEQ ID NO: 25201 - DNA, 38931 bp, Oryza sativa
  unsure (1)..(38931): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagaaacctacgagaatttcgactggggacgcccagagcagataaggtcttgtcagattctaagagccgaacgaccatgtaagacctagtcatgtaagagttctcaaaaggtgtattaactaagccgtgtaatcggaaattgatttttccaacttcacggctaggggctaggtaaattgcattttcagctaggcaggttacgggtcatcgagccttcccctccgagaacaggtttccccgaggacaaggcttagggctagggagagtacctcactcgacaacgggccaaaggcagcctgtaaaaagagtagtactcgctcacaacacaacctgtttaagcatttactagatagatttctactttgattacaagttcttaatagagataacaatgtattataaacccccttttagatatttttctatagggaatgaagcctaccacgacggccactgccagttcatggaagcgaaaacgtcctcggctaaaggagcaagggatcacgccaactggtcgatctcatccgccgataaccgagaacggcgaaaacccccgcgcaagaatctgaggtacatttgcgagcggcgatcttggatgcaggcgaggacgtgacctccggcgtaacggctggcgcggcgacactcctcttttaggctgatgtcgatccactgtccaatgccttcaagctgagcacactgttgatagtcgttatcaatcagtttcgaccgtcaatattaccaaaatagaggagaactagtgatggttgcaatgcatatgcttgttagaataataatattccactagtattaggtttactaaccttttgcagagaataacaataaagtgaaggagaatcgagatcaactccaatgataaatcaatcggacgatgtcgagaaccaaacttgtgtatgaatgggccaagaactcagaattgacacgacaaactgggccaaaattcacaagtctgcggagaagaacaacagaggaggctgccagccaaaccttgggcttattgggccggccccaggatcggccgaacctggtggttcggccgaacctggtggttcggccgaacccccctcttcgccgctggatgcagggtttcttctggacagtgtggattagctcccaatgacggttggagggtatttccgaccattccaaccgtcacaaccgtcattgggaggctatataaacccctcaccttctcacttcactcacacacctcaagcaagagctctctcgttcctctcaagtttagtttagtagtatatagctggtggaatagaattagaataggaatcaggagtccggaagccttcggaagagttcgggtatggctctagtagctttcctttcctcttttgtaagctttgtacttttattagaatactcttctaaatacatttctggtattgaaatactttccgagtatatgagtaccaactttacattatgttcttgttatactgaatatattgctagcttgtctgggagatgcatgctttggtgcgggtatagtgtttgcttatgcaattactctatgtcatgacgatgatattagagtagtatctggtagtttagacgtggtgtctagattacaggatatcattatttggggttatatattgcggatgagaggtgggcctctgatggtgacagctcagtacgggtattcctccacgcctatatataatcctaagttaatttcctggggagggtactcctccatatttagccccagttggatggtcatgacgagctgtcgtaaggaactaggcagtcaggggtggcttctcgaagtaccaggagggcatcggatagaaggtattagctagtatatcagttaactagaatgtatgtatactatgtatattaaaagtatagaaatagattctctttctcttttcttttcgcctagcttagattatttattatgagtagtaatgcatgtgtgtcactctacccttggattatcttaacccctacttagaatatgattatcacaagtattatataaattattagttgagttctctctacgtgatcttcccacgggataaaatgaatacgatacccttggaatactctcaggcgaaatgctacaatggtatatccatgcgcttgcggatgaactctgtaaccataatataccagaagtatttctgcgccattgctgggaattatatttctagtaatgtcgttaagaaataccaacacacacgcccccctcagctagaacaagtagcccgtcgtgttctcctcggggtccgcgcgatcgaccctcagctggtggtagatgtcggccatggcattacaacagctcttgaggtacgagttcatccagacctcgcgacctcggagagcctccacggccttgtcttttttcacgaccacgagcgatagcccaagttcggtgacctcaaactttgtcctccaagaagcgatgcgtttgtctcgttcggcgatgacaccttcgagatctgcgaaggacaaggatgtaggagatgttgcctccttaataagataataagctcaaagggacaatttctctatgacatcacacctgagttctcgcgagggagcccgactatgcccggactaaacgggccagaggccgcgcccacgcctccgagcacaaccgcatccgtaacgacatcgggagcaggcatatcgcccaaagagggcaagtcgatcatcgcgacatcgggacatccgcattgctggacatcctcggaatccacacagctatgaagaataaaagacgctacagattaacaagtgacgtgaagagaaggaagtcactccgcctaggagattaacagaagtacttgtacaaaaactacaatacaaggtaaaaaaaagtttactcctcataaagggggaggacgcactccccgagatccatcacactagagacatgtcctcgcgcgtggcatctgctgcccccttcgacaagatctccttgagatcggtgacagggagagccagcttcacgcacgcgaggacgtgacacgccctgtgtgaatcccgttggagatttccttcgagaccttggcagtatgccgcgacgggatgacctccatctcgcccgccagctccgacaacgccaacgtcaaggacgtctcgtcgaggtgcgtcgggatagaagacatcacaccacacgccaaggctagctggtgaaggcctatgaagctcttgcggagggagtcgcggagggagaagaggtggtcctgcaggtcgttcatcttcttctccaagccctggtgctgcatcttgttactggccacgatctccttcatcttttgaaggtcgtcgttggcgacttcgagttcaatctccagccgggccacctttccgtccgacgctgttgcacgggccaccgcgcgatccatctgggccgccacctcccgagaagtgttctcgaggaggcggcggcactcggccatcatatcggaccaagttgttagttcgggcgacgacgcggccacaggcgcgacggcaggcccggcggactcagtgacaacaggagcgacctccacgcaaggaatgacaacggcaggaaacccactggtcaccgcctagtccccgctttgcgcggagatcgccgaggctttcctgccaatgtcaggggacatcattagtaaaacttacagatgtgacgacgaaaggagtcaagagtttcacttacttgccggcgagcagctttagcacccttctcttcggaggaggagcgagactgctcgtatcctgagtaagatggcaaattatgacctcattctaacacttcaagaaagaagctaaaggacgacaatgatacgccttacctcggagccactagatttctgtcgagaaccggcgggagcgctcgacctcgcccaaggcttcctctgggtcccgctgcctcctgcgatggctggaacggaggggatgttggcgacttcgtcggcatccttgtccttcaacgaggcggaggcctggtggttgacaagggggccgataacgtccgtcaacggcagaacctacaggagttgaagtcactttgcgccttcagggaatagaaacatgaggaggtctggttctcatttacattgatagcagccgccttgtagactgccgacttgccgcaacgcggagccggtgtttcatcgaccgtagaggaaggactgatcaagacttccttgacccgctgcgccacgatgttggcggggagatctgaaataaatgaagatatgagaggatgagttaggctttggcctcgaaatcatcgtcgaaagcaggaagaagattacaacataaggacaaataccccgcgaagagattcgagttatatcctctgctcccgtgtagtcgaacacggggtgagcacgggcttgtagcggttggatccgaccgctgacaaagtccttaatgacttcatagccggtcaatccttgctctcgaaggtcgctcacagcgttgacaaaggcttggagagagggtgtcaacggaggtttagaagtccagttctcggaatgctccggctgaacctcgggtatgacaagaaccggttcaagttctttgagctctagatagaaccatctcgacctccattggctccgggatgtgtggcattggaaagagatgtatcttgccttcatgccatcacgaaggcgaaaccatcaacatcttgaaacccgattggcttccatccaccggagttcatagaaaaagcaaaaaagatctaagaaaggcactacctcgatgtaggcctcgcaaaggtgagcaaatatgctcaaaaaggcagtggagttggggtttagatgcaagagagaaaggccgtaaaagttcaagatcaataaaaggaatttagaaggaggaggcaaaaaaccacagcggacgaaatcctctagagctaccatgcgacctaggatgggggaaggatcaatacctcttgcttcccaagccatggtctgcttcagagggacggccccctcggtgtacagcttcttcagcgcgccgcatcggagaaagattggtcgaggtccgccatcggaagaagatcgtcggaacaagatcgccagtgggagacgtggaagattagggattttagggaaatggaaagtccgaggaagccgaggaacagtgagggttttttggcaaacagacttgaaatggatcccagaattccattaaataggcgcaccacctaacggttcgtattttgaggaaaggagagagattgccgccgaaaatttctaaggcccgttggaggtagttgttcagacttcaatttaaattcaaattttgcaccgttggactccctctagcgttgtcgatagctccatgtctctacggtcagtaaccgagatcgacctagcgagcacgacgagacgctattaggagaagtcgtgggcgacaacatgaattcatttaagttgaagtcgggggctactgtcagggttaccgataaggcataccttctatcctacgacttatggaatataccaataaggcataccttcacgtacatggattgtttccctatacgtcgttaggaatttgtcttaaattacggaaaatatccctacgagttaaagaaactaccaaagtcctactcggaggggatagaatctctgttatattgtatcatattacatacctccaggccttacttgcgggtcaagataatccacggtataaaagtggacccctagggggaggtgaaggacatctaatatcatcgccaacacacccaccatagcttacgaagccagagtattcggagccaagtcgccgggagatctcgtcgaatccatcaactacgatctcgtcggtatcgtctgttccatctactctctttgtactctgttatcatcgtcatcaatctcatataaactagactaaggctattacgtgttagggggcctgatccagtataatccttgtcttctatttgcttgatgtcgtactacgtagaccctctttcaaacataccccaatactcaacttatccggtccacgagcatcacttgtcgacaatgagaatttcttaagtgtatcctaaatgataaacattagggtagttatttatctacggggtatattctatatatgtatcaaatgctttatttttgtacttgtttatacccataactatttaatggaataactctatacttttaacatttttttagaactttaacatattttcaaacgtatatcgccctcgtatattgtatattgaagtgattatatgttactaattcttgccaagatttattctacccacacaatatcatattattataatttgcgtgaaatatatttgatatacgacataaaattaattaaaactcaattgcacagatcatataaaatactttttgctaacatgaaattttaaaagttattaaagataatagaatgcacagtagtgtttagcatgggcatattactagtatatgtaaatgactaaatgttatggctatttggctaaatagaagaaaaaatgttgcaacaatatatacagttttcagtactacatatgaaaatggagtccttattacctagaaggtatgtttacattatcacgagatatagtttttttatatatattcatgactgccatcgaatacttaccatagtagataaaagaagtagctccttctagctgacttagtggagaaaaagaattaaattttaaaaaacaaaaccaagagattctaaatatatcggaacgaattagcttaaattaatacacacgtgaccagggacgggctgttcggtggctcctttttttatttttgaggaagacctagtattcggtatttcgttatatttcattatagatatgtactatttttaaagcttcgattagactaatatgagtgctcattcatacgatggaccgggctgtgactgtgcgcactgctctgggtggagagcatatatattgatcgatcttatttatttttcatgagaaaatataacatttatttatggcaagacgttattcacgtcaactatggctgtgttagggagtagcactctaaacaaagccgcatttagcgcataattaattaagtattaactaaaataatttttaaaaatgattaatatgttttttaaaacaactttaatatagatttttataaaaaatacactatttaacggtttgaaaaacatatgcgtgaaaatcgaggaaagtgagttgggaaagtagagataagaatttaagcatatatctatcagtcaatgtggtactccctccgtcccaaaaaaacaaaccaaaccatgtgttttcgtgtccaacgtttgaccgtccgtcttatttgaaaaaattatgaaaaaaattaaaaaaacaagtcacacataaaatatcaatcatattttatcatctaacaataataaaaatactaattataaaaaaaattcatataagagagagagtcaaacattggatacggagactcagcgtttatttttttttttttatggagggagtatatagtagtacaacaatgcaacagccaatttccagttcgatcaggcgtgtgcgtgccgttgcgtccagctaaactccacgacttagatgtcggctcgtgtgtcaaatgcaaaattctcaagaatctgccgcagccgatcgatttcatcggattcttcgtggtttgcgtacgtcgtgcgttgtactatcgcgtgagtgctaacgagcgcacatccaaaaaatagaaactgatgcagttctcccgtacgcgtcttttcaagaaaaaaaagaatcgcgcaacgcaactgcgatcctacccttgtgcgtgagtttttcttgctagcactctctccgtaaaaaaaatcaaactcgtagtacgatgtgacatatcatatactccctccatcgaaaaaaaaggcaaatactgggttttcgtatccaacgtttgactatccgtcttatatgaaatttttttataattagtattttcattgttgttagatgataaaacatgattaatactttatgcgtgacttgtctttttaatttttttcataatttttttcaaataatacggacggtcaaacgttggatacggaatcccaggtgtggagattatgggtaccacatacccacacggcatggttatccgactggttataggggataacttatatctatgaaatatgtaacagatcatgacttgggtattacgttttcccgtatattatggaatggcctaaagtcctggtttgataagattgtaaagtagatttaggaaaccgataccgtattgattaaggtttctatcttgtaatcctgcccccatcctatataaggtgggtaggaggccctctagggagcatgagatacaactagatcgtcagatctatactacacccggcggattcaaatccccaaacaggagtagggtattacctctcattgagagggcctaaacctgtctaaatcctttgtctccgcatccatccacttttaggtctcgtgcgctaccccttttattattgcctaattcatgtttcgacagttggcgcggcaggtaggggtgcgtcgaattacccatcgaaaagtgcaatggaatcaactgcagaagaaacggcgagatcaatctcaccgacgtcgatggctcaactcttcaaccgggtttgtcgtttcaatctatctagtgttttttaacaatgtctatgacagattgatttcctggtgtactattattattgtagtactactgtcgacgagatcgtcgatagcatatggagccacctgggagtatacacggcatgctgcaacccctgtcctcagaacaggcgtagtgtgcggttgccggttggttgcgaatgttttggcccggccgactgctttgattgccaaagtaacagtctagcacgcttctcctcgcggcgacgtaatcaggggcaccggaacagctgcgttgatcgcatgcatctactgatcaccgccatatatgcaagtatacatgctggccaataggccaaccaatcaggagtcctgcgtttataggctgctaccaacatgcacaggcttgaatccaattattcaataagcagctatcgacacatatgagtcaattaatatataggagtgtatgtagttgtatgcatgcatcttcttttgtttactaatctgatttgactcgtatttacatgtacttccatggatcgatggccatggccctgagatatcgttctgatccaacaagccggtaaagcaatccttctactattactgggtgggttgtcttcatcaccggccacacattggagcagctgctacaatttaccagatggtgatcatatgacaaatatcgtcatgcccgcaactggcgccgtcaactcatcgagttttatctcttccaacttattattctatattattagattgatttctaatttcagattaatctcttgctatttttgttgttgtttgcatataattacacggcactactgaggcgattggcgttggtcatggactcgaggtgtctcgctatgcgattagttggccatgagtctactccaccggcttgccttcaccactgccgttgctaatggcaacaacgtcttcaccgccggcctgcctccgtcgccgccgactggtgtcctcgcctatacgattggttggtcacaccaccgttcatggacgtctacgtcttcatcgaccggctggcctttgccgccgccgactggtgtttccgcctgcacggccggcctattatgccgccgttgttgggcgtcaacgtcttcaccgccggcctgcctccgtcgccgccgactggtgtcctcgcctatacggttggttggtcacaccaccgttcatgggcgtccacgttttcaccgaccggctggccttcaccaccgctgactggtgtttccgcctgcacagccggcctattatgccgccgttgttgggcgtctacgacttcaccgccggcctacctccgtcgccgccgactggtgtccttgcctatacagttggttggtcacaccaccgttcatgggcatccacgtcttcaccgaccggcgtgccttcgccgtcgccgactggtgtctctgcctacacggctggcctattatgctgcatttggtgggcatcttcgctttcaccatcgaccaccttcgtcgctgccgactggtgtctttactgttattgatggacgactttgttcccacattggccacctctgccatcaccaaggggaatattacaaagctaagtcatcattaattttctttatatgatattttccttttcctctgcctcactacatcaactggttcgccgttgactagtgagtcgggggactatagatgtcatatcatattttttaacaatttttcataatatttatcttgattgcttgcgaaataatccgagtaacaataaagttcctatcgagttatggagttctattttcctatgctttccatttggtttgtcgatggatagttgcctttgggccgattcctagcacccgggggctcgttggatggaccgagtaacgcaaggtcctaagtattattcggaataaatcaaaagcatagagataagataaatttattttctgctcttacaattgcaaaagtacccgagtagtaaattttgattcgtgaaactttgttccattaatgacgaactcatgtcactcatatgcatgtttgggaagtgcctaaaccaactcccgatgcttgggggctatgactagtcgggcagagtgtttaaacgtacggagtcatctgctcggggaaatcaaaattgacaagaggagaaatacatatttataaatattttaaaatacttgaatttttctcaagtactgtgcttgcatcagatactactcattctatatgtttgttctgcaggatccagatccagatatgcataatagggatttatagctttaagcttatctcctacgcttcaggaatggattagtcagaatatcaccattggcttgctgtcgtcgtcgccgactggtgtcctcgcctatacggttgggtggtcacatcaccgttgttggacgtcatcgtcttcaccgccgacttgccttcgccgatgtcgactggtgtctccgcctgcacggctggcctattatgccaccgttgttgggcgtctacgtcttcaccgaccagcttgccttcgtcgccgccgactggtgtctccgcctgcaccgctggcctattatgccgccgttgttgggcgtctacgtcttcaccgcctgcttgccttcgccgccgccgactggtgtctctgcctgcacggctggcctattatgccgccgttgttgggcatctatatcttcaccgaccggcttgccttcgccgccgccgactagtgtctctgcctgcacggctggcctattatgccgccgttgctgggcgtctatgtcttcaccatcggcttgccttcattgccaccgactagtgtcctcgcctgcatggctggcctattatgccgtcgttactgggcgtctacatcttcaccgaccggccacctcgtatgacaccgactggagctatcgtattcacggctggccatatcgccgccgctaataggcgtcatcatcttcaacgtaagctgtctacgtctgctgctgactggtctcttcacttacatggctgcatgattctgatactgttgattggccttatcgtcttcaccgccggtcgtctcgtctgctgggattcgagcccaggtctccacgaccacaacgtggaattctcaccactaaactactgccgactggtttgttcgcctccatggctgcgcgtcttcgtcatcattaactggcgtcatcatcgccggtttgccttcgccgccgtccatagtgttttcactttaatagctggcctattttgccaccgttcatggacatcttcgttttcatcatcatactacttcttccgtcgccgactggttatgtcgccgctgactggtgtgtttatcttcacaactacacgccttcgctaccgttcgcaagatttgctacttcaccaatcacgacatctacaagagcttcgacatctcgacatgcgtcaccaaatatgatgccttattattttactatagcaagtggtgttctaatcatcaatatttctactcggacatcttcaacacgtatcttcactcaagcaatggctactcgacgacaagctagagttctcgactctatgttcagttgttttccaactaaccaaagagtcgggggctacacaaatacaaggctcaaaatttgacatgttttttgtcaaaatgaagcaatcaatgaatcaacaagtaaattttgggagttattatcttggtcttcgcttcagagccgacattttacttcagcgactctagttatttcgtcgattcaacgagttggacaacatcatctatttttcttcaagtgaagcatcttctacagctacaacaccaagttctactgtcatcttcataaatcaagaggcgttgcatcaatctacattacgcgcactctagcgtcaacgaaattactcgagcttcgatatcttctcaacagtttgatggattattgtcactgacctcattaccaacgcctctactttatcggccctgacgtctacgccattgctaatgggtgactacgtcttcgccttcggttgcttacgtcattgccgacttgttatttcgccttcacggttgacctactacgcaaacgctgatgagcgtcttcgtcattatcattagctgctacactgctattgactggatcaccgacttgtcatcttcatcaccatcctgtcaagcttcttcgacatagcctactctactactatcgatgggcaacttcgtcatcatagtcgatcatgtctgttgctgctaatcgtcattaccgtcggttgcatttgccgtcgccgactattttcttcatcttcatgattgatggatttcgccattgccattgatgagcgtctacgttttcaccaccggcttgcctccgccgccgcccatggtgtcttcgctttcacggctggcttattatgcctttactgatgggcgtctttgtcttcttcaccggctgtctcgtctgtctccgactaattatttcgtcaccatggctacaaaactccgtcgctattgctgggtgccttcatcttaattgttagttgatctgtctgccgccgactggtttcttcgcctccatggctatgcgacttcattacctttgattggtatcattgtctttaccaccaccaacatcttcgtcagctttgatgggtgatatcatcttcatgttagtcatttcgtctccatgtcgactgcatcagctattgccaatggacaattttgactatgacagaaggacaagctatatattctcaggggcttatcaactcaaacactaggatcataccttcaagttggattttgttctgagattattttctatgctcgaagactgaaccaatcattattctccgtaagggctatcaaccgaatacttgcgccagtcgggattcaatttttatatctattttggagtatcccataagggataatcactcagatcagaagctattcatatgagctacacttggtctatattacccggaagatttattactcgggagcatgttatatgcgtcatcctttaaagggtgtcgaaggcatttttttttggcctaggcctaatatgtttgcagcccatattttcatgtgtggcctgtcacgttcttttagggacttaggcactttttgcttaggccaaagtgtgcgtgatcaagtgcccaatatcttaaaatccttttataccgcagttactcaactttttaggagttggtacaatgcatcttaaaaggtgtcaaacagtaaagctttatatagctgttccgctgacttttttatataagtcaaggtgttgtttgggtttttaagcaatcgattggatacaatatcattgctttttgccacgtaagtgtgcgtttttattgaccaatattatggcttaggctgattatatatcttggtcattttccaggcggttggtaaatcctttatgagtttatttactcggattttacaccacatatgccgtatatttccgggtgtggtgaaaccatgtgtcttttagggacttaagcacatctgttaaagcagtgtgcgcatggcgtatgcccaatactttggaaatttctttattcacaacattcaagcttttttatagctgttttgctatgtgtattttcaatgatgtagtcaactttaggttgctctcatcaatttttacaaagcaatcggtatatcacttggatcatgttattcggggattcacaccgcatatgctatatatcaagtcatttggttgattacaattatcaaaaccactcggttggttggattatttattccttgactatacgcttagtttgttcagctaaccacatagtcggaggctacacctattaggtgcatctagtcgatgcacctaactttattttccaaccctccacagtctagtcgaagattatcttttcgactatgaaggtctcaagggctactatggagattatgggtaccccatacccacacggcgtggttatccgactggttataggggataacttatatctatgaaatatgtaacagatcatgacttgggtattacgtttccctgtatattatggaacggcctaaagtcctggtttgataagattgtaaagtagatttaggaaaccgataccgtattggttaaggtttctatcttgtaatcctgccccccatcctatataaggtggacaggaggccctctagggggcatgagacacaactagatcgtcatatctatactacacccggcggattcaaatcctcaaacaggagtagggtattacctctcattgagaggacctgaacctgtctaaatcctttgtctccgcatccatccacttttagatctcgtgcgctacccccttttattattgcataattcatgtttcgacaccagagtttgtcttttttttttggaatggagggagtgttcagattcattgtactagtcacattatagtactagggcctcgtttagttccccaatttttttcccaaaaacattacatcgaatctttgacacatgcatggaacattaattatagattattttaaaaaaactaattgcacagttagaggggaaatcgcgagacgaatcttttgagcctaattagtctatgattagccataagtgctacagtaacctacatgtgctacagtaacccacatgtgctaatgatggattaattaggctcaaaagattcgtctcgcagttttcaggcgagttatgaaattagtactttcattcctgtccgaaaactccttccgacatccggtcaaacattcgatgtgatatctaaaaattttctttgcgcgaactaaacaggccctagttgtctattttttttgggacggaggaagtacttgcttgtgagcctttttgttgctatagcccaaattaccccgtgtccgtggcccatgaaaaccagtcgcttccgtcctcctctgtgtgtcgggcatcatgtaggaagtctaggaacgtatttacacggtgcacaaaacactcatcaattctaattagtgcacacattgtttaacaaaaaagatatagcatatcttgtcatcaatacaacgaatctagacaacgggtagtctagattcgttattctaagaggggtcgtatccccttagagattgagttttctttagaacggaggaaataggtggcagtagaaggccaaaaagaagagggaggtggttcagcccatccattgaagcccatgtttgtcagccaccaaatctatgaagccaagagtaaaagattattatctgtcttatagtccatgcattcctccataaaaccaatatatgattcatatattgatcataattcctcgttactagtaattcgctagtacagttgaatgcaaaatatattgctgtccactgctataaggaagtaagctaagtattgaaaggaatacgaattaaaagtaaagagagaaaaacgataggaaattcaaacatagatccggcgagttttctctgaggtataagagattcggcaatctccactaatactcgttggagcactctacacaaagagtacactgtctctgatagtcacgaagtccattggcgctctcatcatggtggttcttctccgctctgaaaggtgaaccccgaaacctccacaaccacaccggctctcccacaatcttcttgacagatcaccgggttgccttcgagactggctaggcatgccaagatgccaatagttaacaggaagagagccactcctcctgttaagaacaggattcttgttggtgcacactaagccactcttttttgacgtgaaacagtaggaaaatataatttacagggagggtggcaagcaccagaaaaaagcatactctcaactcaaactagcactaaattagtgaagaaaattatcacaattagctcaatgatgctcttagactctcccatcaattgctcagctcaatagggttccaaaggacaccggggagtcaagccaagggatgtataaagccccaatcaagctccctagcggtttgcagccatcgtaaagaagcagccaaaactgcaaatcgtcaaacagtatggcaccgacccgaactattctgcccttcatacttttctgattgtaactgggcaagtagttgttgggccataaagcataggacaatccaacatctcctagattgcccaggacccctttgtccacacggtgtcggacaatccgcaatgttcaaaaaccaatgaccagtaacaatcgaatgaacatgccagattaaccgacgtcgtgtcgaactgtccgctagttgccaaattaactaggcatcagacaattcgagagctgccggacagtctagccagttcatttccactatctagtcaacatggtcagacaatgaactggctgaggatgtttcttttgttgcgtacatatgattgtaaggatgttcagtgcagggttgtccctagtaatttggggcctcgtgcctaatataaaataaggccttacctttagaaaatactattatataatagattagaattatatattatttataatacattaggtgggtatgccctctcacagctcatgagtcatgaggagaaagagcggatgatgggtcccaatcatatgattctcacaactagcataccccctcatctactctaaacgaacctttggctgcctattgcattcttaaagtaagaaacaacaataacaaacaccttccctgaatcgagtggacctagtagccagagtcttagatggtacaaagaagcccatgatgaggaggaggtagtccaatccctgtattgaaacctatgttattagtttttttttaaaaaaaaggaagaaacatatgctattaactattagatgtactcacctattttacctttgtattaatatatttgccgtatagttgacgcatttcaatgtaaaccagcgattcaaatattgatttttttgaaagatccaaatatacaaacgttactaccaatctgtcgttgaagataagtcaaaaacaaattcccatccacctatttaagaaggtggacaagtggatggttggtaggcccaccaacgtgccccctcacacctcctgagtcacaaggataaagagcgaacgatggagcctactcatacacttctcacaccttgcacacacaacacaacccatctgttttagccggacctttggccgctgcactattaaaatgtagaagtagtgcaacccctattaaaacccatgttattaaatactatgtctattcaaccacattaatgttgtatttatatttttctctatagtcgttgtattctaaagtaaacgagtgattcataaattgaatataatttttcaatagatccaaatataaagtctaacaataatttgtcactacatatgaatccaaaacaaaattttcatccacccatttaaggtggaaaagcggatggctggttgccccaccaacatggccttcacacctcatgagtcaatgaggaagagtggatggtggatcccagtcatatgactccgacaactaacatacccactcatgtagtttagataaacctttggctgcctagcaatatcaaaataaagaaacaatgttaacaaatacattccctgaatagagtggacctagtagccaaatacttattaggtggtataaggaagtccatggtaagaaagaggtagaccaattcctctagtcaaacctatgttattcactattaggtatattcatgtatcttatctttgtgttaatttttttataattgatgaaagtaaaccaacgattcactaacagattttttttgaaagatccaaatatataaaggatactagtaatttgttgctaaagattagtccaaaattaatcacctatttaagaagttgaaaaagtggacggttggtaggcccaccgacacacccctcgaacctcatgaattatggttgtgtttagttcacaccaaaattggaagtttgattgaaattgggacgatgtgacagaaaaattggaagtttatgtgtgtaggaaagttttgatgtgatggaaaagttggaagtttgaagaaaaattttgcaactaaatacggcctatgattaggaagagtgaacggtggggcccactcatatgcttctcataccctgcacacccgcccatatgttttagccggactttttggctgttctgctattaaaagaaagagtaaatcttccacgacgtgtcataagcaggatggcatgtactaatcatatgcctattataactagcatacacacttatctagtctagaaaaacctttggctgcctattacattctaaattaagaaataagtaacaatagtaaacaacttcccttgaagacctagcgtattaataaggaggtagtccaacccctctcgttgaaacctatgttatttaacaattagatatactcacctactttacctttgtattaatatctttactgtataattgatgcaatcatcacatattgtatatatatatttttcaaaaggtcccaatatataaagacaacaatccgtcactaaagataagtcccaaaagaaatttctatctacctaactaaaaggggtaattgcacattgactctcttttgaaagctaactatcaatttgaccctcttttatcaactttaattatttaacccttttcttaaaaattgaagatatggtatgaccctattctattaagggcatctaacgatgttaactgaagcacaaaatgtcccttctgcccttactcatttgaccctattacatgtgggacccacgcgtcagttctctcttgtcctctcctccacagctccacacgcagggagaaggccgcgagcagcgagagggcgagccagcgccgaccagcagctgtggagcaccgcctccactcctcgtcaccgccgagccgtcgttgcccctcccttgccggatccagccatcacagctccatcgctgggttcgccaccttcctttcttagtgcatgccggtggcgcctcctcttccctccgcgcgctgaccgccgctgctacctccctccttccgtgcgcctgccgctgccgccgcggcctcctccctccttcagcacgcctatcaccgccaccgccaggcccggctcccctccctcccttcgccgcgcgccggcctctgcctccctcctcgctgcacgcgccgccgcctcacccgacggtgcgcgcagctccactgcatgctgccgccaccaccgcaggggaactgtcgccgccgtcgcagaggctcggcgcagccgctcccttcctccgcaagccgacgccggtgcagatccctccatccgtttcccaccaccgccgctccttcccttcacaagcgtgtgccagcgaggatcccctccacgcgcttcccatcaccgcggcccctgcctccacgagcgggcgccgccgcggatcccctccgcgtgcttcccgccggcgccgcccccttcctcccttcagacaccgagtgccaccaccgcaactcgctggcaggagagagagagatacacatgtggatagggttagggatggatatggtttcctcaagggtattttggcattacgaattttatttatatttctttgtttttttaaatcaaatcttaacggtgtagtggaaacagggtcaagcggaaggttcgtttttgaaaaacatggtcaaataagcaaactaaaaaagtagggttaaattggtagttagacttcaaaatgggataaaataagcaattgtccctattttaaaagataaacaagtagacagttgataggtccactgatgcacgccccctcacacgtcatgagtcatgatgaggaaatgcaaacgctgggacccactcatatgcctctcgcaccccgcacacccacccatccactttagctggacctttggccgctctaccctctatcaaagtaggaaataacagcagcaacaacagctcacagccgtaaaagctcacacacctcctcctcctcctcttccacgcgcgtcagtgggccgcgctgcaccgcgcattgcttcacctctgcacacctgaaaccgaaaaactcaatttggagtgaagcagggagagagagagagagagagagagaggagagaggtgtcgtggagggaagtttttgaacaaaaaatttccccaacccgttgggcacgatgccgtcatgatccccccttacctcactgccaaaaaaatttcaatatctcacccacattaatcaccttcctcacgagtctaacgagcaaaaatcccatttcatcatcattcatatcaatcctctcgatttcttccacgtccccggattctgtttcctcctcctcccccgtctcgatccctcctcctctttccctcgctccagcgcgctcgccgtcgcccgccgcccgccaaccatggaagcagctggactggaggaggaggaggaggaggaggaggcgatgccatggtggtgttgccgcagcaggaggaggcggcgtccgtcgaatccaagggagtccacgtcatcggcagccgaatctatgatccggagaacctacaggtggtggcaactagagcctacaggcggggtaagctctactgcgataagtagggacgatcttggcaggggcttggtttgatggaggggttggcggcggtgtaggaaggtgactgggtaagggggtgtgactgtggaacggtgaacttgagctggcacacggctggctcaggctcaacaacacgagcaccgctccatgcacacgaactcccagtctaccacaaacgccacactccctaacgacattaccgattgggagggtgagggagagatgagaaagaggctaacatgtggccctatcctcgtcttggatccagatcaagtccatgagggatccatgtggcatatgcccacgttgtctcatggagcggatcaggggctagtttttgaccagtgatgatgcacagtatacaactcatacttgaagggttgatgcataaaaaaataattttcatgatgtcattcagagttcaattttgatcccttctactccaatgaaaaaaaaagatcggttgaaatgggacaggagagacatgttttttttgtggcgtacatatgattgtaaggatgttcggtgcagggccgtccctagcaatttggggcctgtgccaaatataaattaagaccttatctttagaaaatactattatataatagattagaattatatattatttataatacattggggtgggtatctaataccacttcttttttcttgatctgcattgcaatcaatggccttctatccacatcaagaaagctagctttaatctaatgctactttctttagctatatccacaataagcatgaattgtttttaaccaatgataactatatctatgtcaaagaagttcaccaacctacatctgtaaatgttatggcaatccggctaaatagaagaagaatttatgggatctgaaagtgcattttgagaattcagggacttcgatgacatatacgaacaagtttagggactagtcgtgtactttactaaaaaatactagtaatttggtactacagctgcgtccaatacaaatttccatccaccctacttaagaaggtggacaattggacggtttggaggccctcacacacctcgtgtatcatgaggaggaagagcaaacggtgggatctactaataagcctctcacatcctacatgcccatctgctctaaactgatctttggctgcctaccaccttgtcaaagtaagaaatatgcatcaacaacaaaagggatgtttagatccaggggtgtaaagttttggcgtgtcacatcaggtattatatagtgtgttgcatggagtgtttgggcactaacaaaaaaataataattacagaatccgtcagtaaaccgcgagaagaatttattaaacctaattaatctgtcattagcaaatgtttactgtagaaccacattgtcaaatcatagagcaattaggcttaaaagattcatctcgcaaattagccgcaatctatgtaattagttattttttagcctatatttaatacttcatgcatgtgtttaaacgtttgatgtgacagggtgaaaaattttgaggtgggatctaaacagggccaaaaacacattcccaaaatcgaggaaacctagtggctagggcctaaggtagcatatttacattaattattgattaggtggtacaatgaagacaatagcaaaagggagaggcagtacaactccctattaaactcatgttaatatctattcgactaacttagtaatatctttgttctatagtcgatgcatcctaaagtaaaccagtgattcatatattgaatatatttttttagttgattcaaatataaagtctctactagtaatttgaaactacatatgaatccaaaataatttttcatctaatcatttaagaaagggcgaaaagtggatggctgattggttatgccccctcatagctcatgagtcatgaggaggaagagcggatggtgggtcccaatcatatgattctcacaactagcataccccctcatctactctaaacgaacctttggctgcctattgcattcttaaagtaagaaacaacaataacaaacaccttgccttgaattgagtggacctagtagccagagccttaggtggtacaaagaagcccatgatgaggaggtagtccaatccctatattgaacctatggcccgtttggttggagggagtttttaggagggattgggagtttagagggatgaggctattaagtgttttgtttggttggaagacatgtgaattttgatgggatggagatgggtaattgaggaaggaactccctccttttcaatacctgggtaggggcaggtaattgggagggaattcctcctttactttgtctaagcaaatatcagccatccgtttttattaatgacataatctccaactaaactccctatcaatttccatcacctctaccaaacaagatattgggattaaaaatcaaattcccatcttaatctcatcatcaattccctcgtgtaaactcccaatccccttccctcgagttaccaaacaagttgctatgttattagttttttttaaagaaaggaagaaacatatgctattaactattagatgtactcacctattttacctttgtattaatatatttgccgtatagttgacgcatttcaatgtaaaccagcgattcaaatattgatttttttttgaaagatccaaatatataaacgttactaccaatctgtcgttgaagataagtcaaaaacaaattcccatccacctatttaagaaggcggacaagtggacggttggtaggctcatcgatgtgcccccctcacacctcatgagacatgatgataaagagcgaacgatggggcccactcgtatgcctctcgcaccctgcactcccacccatctgttttagctggacctttggccgctatactattaaaatggagaagtagtgcaacccctattataacccatgttattaaatactatatctattcaaccacattaatgttgtatttatatttttctctatagtcgttgtattccaaagtaaacgcgtgattcttatattgaatataattaaacgcgtgattcttatattgaatataatttttcaatagatcaaaatataaagtctaacaataatttttcactacatatgaatccaaaacaaaatttccatccacccatttaaggtgggaaagcggatggctggttgtcccaccaatatagcccttcacacctcatgagtcaatgaggaagagtggacggttgatcccagtcatatgcctctgacaactaattacccactcatgtagtctagacaaacctttggctgcctagcaatctcaaataaagaaacaatgttaacaaacactttccccgaatagagtagcccgagacttatgtggtataaggaagtccatggtaagaagtagttcaattcctttattcaaacctatggtatattcatatatcttattctttgtgttaattttttttatagttaattctaaagtaaaccaactattcactaacagaattttttaaagatccaaatatataaaggttactagcaatttgtttctaaagattagtccaaaattcatttctatccacctacttaagaaggtgaaaaagtggacgattggtaggaccaccgatgcacccctcaaacctcatgaatcagagcgaacggtggggtccactcatatgcttctcacaccctgcacacccgccccgtatgttttagccggaatttttgtcattctgctattaaaagaaatagtaaatattccatgacgtgtcatgagcaggatatcatgtcttgatcatatgcctattataactagcatacccacttatctagtctagaaaaacctttggctgcctaatatattctaaattaagaaataacaatactccctccgtcccaaaaaaagtgcagttttgtactattcatctccaacgtttgaccgttcgtcttatttgaaaaaaacttatgattactatttttattgttattagatgataaaacatgaatagtactttatgtgtgactaattttttaaaaaaaatttataaatttttcaaataagacggatggtcaaacgttggacacggattttcacggctgcacttattttgtgacggaggtagtagtaaacaccttcccctgaatcgagtggacctagagtattaataagggggtagtccaacccctctcgttgaaacctatgttatttaacaattagatatactcatctactttatctttgtattaatatctttgctgtataattgatgcaatatcttcacatattatatatatatattttttcaaatggtcccgatatataaaaacaataattcttcactaaagataagtcaaaaataaatttctatctacctactttaaataagtagatagttggtaggcccactgacgcacaccccctcacacctcatgagtcatgacgaggaagagcaaacggtgggacccactcatatacctctcgcaccccgcacacccacccatccgctttagctggacctttggccgctctaccgtcaaaccaagcaagctgtcaaaggaaatagtaggaaataacagcagcaacaacagctcacacagacacacacctcctccccctttgacaattgacaccccctcctcttccttccacgcgcgttagcgggccgcgcggcgccgcgcattgcttcacctccgctccgcgcggctgaaaccgaaaaaaacccaatttggatcgaagcggggagagaggacttgaggagacgcgtcgtggagggaagtttttgaaaaaaattttccccaacccgctgggcgcgatgccgtcatgatcccccccctcgcctcgctgcccaaaaatttttcaatctctctcgcccacattaatcaccttcctcacgaggccaacgagcagaaatcccatttcatcatcattcataccaatcctctcggtttcttccgcgtccccggattcagtttcctcctcctctccccccctctcgatccctcctcctcttcccctcgttccagcgcgctcgccgtcgcccgccgccgtccgccgaccatggaagcagctggagtggaggtgaacggaggaggaggaggcgacgtcgtggtggtggtgccgcagcagcatgaggtggcggcgaagcaggcggcggcggcggcggcggcgaaggggaagtccgtcgaatccaagggggtccgcgtcgtcggcggccggatctatgatccggagaacggcaagacctgccaccaggtaacccctcctcctcctcccacctacctgcctgcctaccatctgttcgacaccgtgtctagccggtgtcctatgaggagtcgtgcgtccctgttcttcctccccggtggttgggtcgggttggatctgaggaattcttgctcgcccccccttgtttttgcggggaattcttgctcacccttgggtttagcggttgctctgtttcttgctccctcgcagtgccgtcagaagacgatggacttcgccgcgtcatgccacaagatcaagaagaacaacaagcagtgcacgatccagtactgccgcaagtgtctctttaacaggtgaggggggaatttcttctcgtcttctttcttagcttcaggaggcagagcaaggctggctgaccatgtgatttctgagtgattcgtggcgcaggtacggccaggaagccgagaaggtggccaatgacggcacctggacttgccccaagtgcaaggatatctgcaattgcagcttctgcatgtgagctgaccaaacctgatgctctaccggtcatgctgattatctgtggctcgcgttttgttgtcagaagtgatggatggactttgatttgtttggcaggaagaagaaggggctgccgcccaccggaatacttgcccatgctgctaaggcttcaggttgtgcttcggtccatcatttactgaaaaaggggaaagaagcggtggctgccgcgcagaggagcacccagaaagtgagatctacacctgtgaaggtgtgtggtgttcaggattggcacgatcctttgtcacattacaattcgctgttgcatggtacgattgttcactatgtttgatatgttttgctgatcctttttttatgaacaagcagaagagcccaaagagggccatacagccagatgctgctgctgatgaacctttggctgaaggggatgagaatgtatgcattgatttcaatgctgctccagtgaagaagcagaagagaagcaggaaggtgggtaatggtgtggctctgacgaaggatgaaagccctgatgctcccaaggaacaagttgttctgcccaagggcactccagtcactagtgttgccggtgcagagtgggagcctgaagatgttggtcttgcacttcagttcttcgaattctgccgcacatttgctgaggtagttacgaaagaaagatcaaggatatttaatagtatgattgcacatgccttgtcagagtaatatcttactagcatttgcaagagaataatagatcgagttttttttttctatttacatgtctgatgcatgttatgttttggtatgaagtatgacaatgtaaaaaatgcttttactggtaagcaccgaagtgttgatattagagcttcctacaagtttggaatcatatctatgtgtttatgtaggtaaggcatgcaatgccatgatgggatacaaatcataaagggaataggtattcggattagaatttggagagggagatggtggggtgaccgggtgacagcaaatgggcaaaaggaaatatatgactacctgttgagttcattgtacgcattaaatggatgcgatttctctgcgtgcaacatgctaacacctagatacaggctatctgttaattgccctttaatgtgtacaatattcgagttcctatttgtaattatgaggtttcttttttattgcatggcacttcttgtccatatgatatacatgttaacattgataaactggtcgaaaccttccaattatatttcttggtttgtaatttaagccatgtagtagctttcatataacccaaattaaatgttattatgttctgtcgaatttttttatttgtgataggctgcgtgttcaactgaactaccaaagctatgttttaaagttttttttttaaggaaactaccaaagttatgtttcatcctatacaatatctcttgcaaaaggtatgtataaagctccattgttttacacatagtttgagcaaagttcaaacttctgagcaaaacaactatctattccatctgttccaaaatataagcatttctgactatttacctgaacggaaatgcttatattttggaacgagggagtaagtgatagcgaagcttattcttttctgtgcgagtttataatttatttcttctgttatagaccaaacatccaagtccttaaggcataattttggtaaccagcaaaacattgtaacagttgttttattaggcgatgtgatagttatcttaatcttttatgtttatttctaacaagtgtcatggaacaattagtgtaaaatttttgcaactaccgtgagtcctgttccattacaattgttgcatcatacttcctccgtttcataatgtaagactttctagcattgtctacattcatatagatgttaatgaatctagacatatatgtgtgtttagattcattaacatctatatgaatgtggacaaacctagaaagtcttacattatgaaacggagggagtaacttcttagtgttttttagagttttccttttgaattcgggcttaggatcgctttgcgttataatctgaagtatttagtcattgccgcaagtgatcgctgcgatgcaatgcgagcagagttgagcgaacagtctgtcatgtaagagtacctgtatctgagcacaaactaaccatgggcgcgtcatgcttatatctaggatgtactcaataatttacaaccccaagtgtatcgttttacggtctgatctcgtgcatatatcgtgcatatgctctctttttgcttctatgtaaactccttgtttcaataataataatacaaggataacgcagtaattaatttattgagattgctgtgggcgttggttttgaactattcttttttctgctattttgttttacatatataaagcatgcatttattttctggtgtacttaacaatttgagaaaatagtcacagtttgctgctagcattacaggctttttaattgaatcagatattttaaaacaatatcttgtttccttagttaatatactaatctgctctacatgctcacatggtacattgagattatattttgtattgcaaatggaataacatactgatttttccccacagattttccaagtacgcaagggtcaaccagaaagaatccttcgggacatagctggaggtcgtggacttcgagtggtgtcctcagtcatcgctgacttccacataactttgttatccatcatccaagaaggccgaggaatcaagtaagtagatcccaaaccgagccttttttttttctaaatgcagttgataaaattataattatgttgttttcttctcaggcctatcacatattcaagagataatgatgcatggattgttgatactggaaaatgcataagcgagtcaatctttgtcccagagggacttccccttgactccctaagtcagggggtatcgggatataaaaatctgagcccttcttgtaagctcagtgttctgaactttttgtgtgatgaaagtctttctactgagtaagtattgcctacacatttgttaatacttcccttcgctattgtgatgttgttatttctgattttttaaattactcttaacattgttcaggaagttgaggagctgcatattatctgaaacaaaaaacccctccagagaaaaagctcattctgcaaaagagaaggttttgatcttggcttgcctttcccaccttgtcacatggttctagaacaattgacaaaatatctcctgtttgttaggaggagccaaaagaagaaactataaagaacacagatgaagcagtgcttttgaaaactgaaggagcagctgttgctattgaggaagataagaatggcatttctcaacaaaaggatgtgaaagaagtaaagaatgcagacacaaatggtatgaattatattgctaaacatgcttcgtcatagccttttaaacagattactttagaacattttgcatgatctcctgcactgtttatttcctgtaatgcgaaggaaataagctgatcattgtattaattttgttctcaactatgaactatggcaacatcagaaaagaagcatggaggtttccttaggactaatcctttcatggtagacaaaaaggtaatctattggaagctggatgactattgtaataacacaacaatgatgctccaaggtttgttggaaagcgttattcaacatccttccactaatttcagttctgcattataaaattggagacgattaacatctgtctgtatcagaggttgatgctgatgatttaatggggaacaaagacaagtggtttatgcttaatgaagatgaaaagaaaatagttgaaaactatttatccacaaggtaaggatttctccatatcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttgtaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgttttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaatttgtagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcctgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactctgagttaccttctagttccttgcacgacaccttgtgcgcacggtggccccttgaggtgcttgcgggtcccgtcttcattggaccctatttgtcgttgtcaaccccatatcttacaagaactgactagatctagtagcctcaagtttggagcaaccaaatctgacactacaatgcctctcgctttgccactcatccttgtcacccaagaccatggttgttttgttgcttgttcctaggccaatcgccatcatcaccatcacctgcgctcagagcacccagatctggcaattagatctagcagccgtaatattgcaacaatcaaatcaatcaacccggagctctggctagatagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaaaaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgtgtactctctctctctctcgctctctctctctctctctctcctttgtgggcaagaaaagaaccactgggtgggctcaagactgtagcatggagctgccggccgagctcaacttaagtgcaatgccggagctgttggggctaaggccgagagctgagctggctgctgactgggctcaaggctgagcatgacactgagccaccaatgactctcgaggccgagcatggtgtaagccctaacagggctcgaggtcatggtcaagtgcgtagtctgcttcgagcggatgccaacagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatg

SEQ ID NO: 25202 - DNA, 2899 bp, Oryza sativa
ccgccatttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttggcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggatcttctctttggcatgcgtcattagtcttgaaacctctagcatagcgggcttctcatcgccatcaacaactcttagcacaataagtaatggggttgaagctctgatacaatcttcaatagaggaccaaaatttcttagagagaacaatgccagtcacttatattattgcctttgtttttgctaatttgatcccagtccattgttcactcacaaataggcttctcaattcatctctttggctataattgctcttcaaagtaagataagttgtggcaaatcgagtgacagctggtcttaaaagattctttccacttgtcttctccctcattgcactaagaagcctcccatgtctataaatgaaagtggtgacacgcttagcacgggcaatggggtttttaaattccttcagtttccctatgtccttcaacataagatccaaacaatgtgcagcacaaggagtcctatacaatgtgagaattctctccattagaagcttatctgttgcatgtattagcaccattatcagtgacaacttgaacaaccttctcctttccaatgatctcaattctcttctctagcaaattagctaacatagttgcattatgtgtttgtaacattctgaaaattcctaataataaaaatcactaaaatttcgaactttttaaaaacttttgcatcatgctgggtgttatggttgtcattgcttgccaaatataaattgtaacaatggagaatcaaattaatggcgtacacctgaacaataaatatatacattagtgcgcaagaaagcaagccaaataaaatattaatttctattataaatcatagatcaaatattaaatattcgaaccatgttgatagctcgatgtcatgtttaactaatgggattgtaagattaaatctaatgtatttggatccaatctcacatgaagtattataaatccacatgaaatgatgattactactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttatagaataaatagattgaacccatccgtgcaaaatatattgctatacaactaaactcgaccaatctgctaatgtattaatcatgacaagtcgttatattaaattcaatattaccccaaagtcttcaaaaatatataagttcaccttagggtcaataacccaaattaatctaaaaagaattcatttgtgcgataaataaataaatatgggtggtaataatttggataaattttcatgaggatttagtacttaaatttagttaacatttaactaagtaaaattagagtttgtaggattaaaattgtataggagataggctaaaatagggtttaattagggatagcactattcattgcacatgaggtgtttgatggagttcctagccaccttagccctcttcctccccactgccgcgcctagccctggccctggcctgccgcgccgtgcctagccctgccgcgccgctgccttgcgccccgcgtcgccgtccgcgtcgccgctgtcgtgccgcgccacc

SEQ ID NO: 25203 - DNA, 5177 bp, Oryza sativa
agaaaggaaaaagaaaggaaaaagaaaggaaaagaaaagaaagaaaagagagagagaaggaaaaagaaaggaaaagaaaagaaagaaaagagagagaaggaaaaagagagaaaaaggaaagaaaaggaaccctgggtcccacctgtcggtcactagggttatggattagatttcggattaaaaataaatcatttatgaacagtagctttttacaatttctcgggttaattcaaatttgaatctttacactagcataacttattcattttagctccgatttgagtgaatcttgaacctaaattcatctaaattcataagctttccaatggtatatagttcactatttaataaaatatatttataattattaaataattaataccacgatgatgcataatagtcaacttaaaaatgtgctaataaataaaattgatattgtactataaagtagatgtcaaataattgtccttaacatgctttctcactgtaaaacctatgtaaactaattagcagcattgtttcaaattaattaaagcataggaaatactagtgtcaattattaatatatgtcaatatataattatactcatgacgtccgaattgtataaataatgtttagcctcatactttgtgactaaaagttgaacacacgtagatgagtctttaacttgtttatgagagataataacagagctagtgtgactaaaatcacccgcacgaaattaattaacggcatttcctgtacagtagtatatgtttaggttggaaatcgacccttaagttgtatagacggtaactcactcataaatccacttaaaatcacatgtactgtgtagctcgtagtaaatagcaactattcaaataaatgattcaatattaagatattgtgcacacacctatactgtacatcccattatagctatacggtatagtattaatttgcttgttgcatatattaaattagagggactatatgataaacaggaatattagataaatactagttataaatcttgatctcatataattatagttcaattgtaaattaggattattcattgtaaaattatgtgatgggataatttgtaaccataatatgattaacctaaacaactctaacatacaaagcacggataattattaaccttttctaatttattgtgacaagtaaaatatgttgataatcaaagtaaagcttccatcaataaaataataatacaaatgattcactgtaattatttgattgatcctaaatccatctgacaacataatctctaggatatgaccattttatttagatagatgcatgtgtaaccataatccttccatagccattagctagactaaaccaccatgacaacagaaagactaagaaactttagctcttaccttgattagaatccattagcaagcgcgaataatatgagcaaccctaggttcgacctcaacaaatatattttgtttgtgcatatttgattgttgcttgaatattggtttttctcgcgtattatagaaattgtgtatcggtcagtcgtgaggcaacgtctgcaacttccaggaggtgaaggttgatcaagattgtatcaagaataaggactattctgagcaggcaagtcatcactattccttgaacatgttgatcccaattgcgaaattgttttgtttacaaataaaattgcatgcaatgatgaacatcctacttgtgattatgccatgccttgattattgtttacccttaagatccttgtaaccatgattacgtataagtccctagtcaattatgacaattgcttagaaatgctattctagaatcatgcatactcatatttatcaaatgctatatgcttgggcaattacctttgggaagataattgagatacggcatgtggagacatgagcaccacattgccatgatattgatgacatgatttgtgaaaggagaaatgaaactaaacaactgtttttgactggggcggacggaggatttgggtggtatctggaaaaggctagtaccgtccccggtcaattaaggaccgagtcatgaagttaagcatgaaacgaaccccgtacaaccgcacttctcgtatgggtatagacctagcggagtagatagctgagcggaggcagtatccatgcatagtggtttcttgatgtgtgaggcaggggctctacggtggggcagccattggtaggaccacgaggcgggtgtctacagtggtgtcgccatcggtaggactgccatgtgagaatctaaacataattataacttaatgcatgtgtgagtcttcccttcccgggtgcgctagaactcctctcactgctagaaaccgtgtatgcctagagtgcatgaggatgtaaagttcatggagcggatactgccaatgcgaggttatcgaaaagctttgtcgtgacgcgtctcatgtgttgggatgaggctcatgtgttgggcagtcgcagagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcatgatgatttttatgctgttgaagccacttcctgagaggagggaaggtggacgtcctcagaaaaccatgaggattcaatggcgggaagctatcattgggatcacaatggatggtggacagaaccgtcgttgtttaatgtgaacactggaactaaaatttgatcagtctatgctaggtcttaggcttgtaaaaatatttgcaaaacgcagctttacgcaaaagaacctgaagccattccttgaataccctttatcatatgcattgctgttgtggtggtttgctgagtacggttggtactcacccttgctatttatatatcttttaggagagcgctgaagagaagcccttgttagtacgcttgcgtatccaacaagatgatcggagtgcggtcttgttctaggtctcgttccccagtcgactgcctgtggcatgttaaccgggcccttatattattttgtcttccgctgttgctctctgatagttgttagcctacctggccctaatgtaagtattaactctcttagcctgaattcattcgtgatatgttgtgatccaactatgaatgtgtgtaccaactactgatccagggattggtacggataaacacagaagatttccgatttccaaaatcgggggtctacagtgtttcacttgatgcatcaaaagactccaagaagtaagcccacagcatgcaagttaattaggtggcgcccctcctatctatccatcgatctgacataaaggtggagccatactacttccatgctagctctgtagctcatgatcaacctttattttacctttattttacttgtgtcttggacatagtcctaaatcaaggtctcccttaacatgtgcttactcataggcttgtaacccgaaccatattatgcggtggcctcacaagcaatctcaaactgccttgaggttgcaacattgaatggtatgccatactcatagaaccacaataccccttgcatatccacataatgcttatcttcctttctctttgtactctccatggtgctttggaaccaatcaaagcgcgtccatctacaatcttttcaactgtttttctaaccgtagcaataattgtcttggtctcctttggcttggctttttttttttactattggagctctgaaatcgtaggttgctcttcttctttttgctgttatcccactagaaggtacaactggcatagaaaaggatgttgttacattttgatctagcagaacctccacatttccccctttcttcatctcccaagaatattgtccgttttttttttgttcttgtgcaaccgattttgcatttgtttcatgagttctttatcaattttgatacaaactaaaacatctccatagccacctgctagatgctgcttcagccttgtagcccctccatttgtcacctccccacaaagattacatgtcactaagtttgtgtttctaattactatcaaatagccgcacttccaagctggatcctttgcatggtggcctccgttttggatcagttataggatcatacccagcctcaggggcagcagcaatagttgttatcgtggttgctgcataaaagattgcactttgataaaatatacaaattgatgagcaacagttgagggatgggctccagtgtcactctgaaggatttctggagcctgtctccataggaaagatccctcccttttgcgctagatggggccccacccctccatttcgaagaagcggaggcctctagccagtttccactggcgcgcataaccccgtgctccagttggggggcatgatcaagactactccgaggcttcagctcatgagccattaaagacgagacaaggcaggaggcagttaatgcccacctactagccgctttgctccaacaagtcgtgcagcgggaggcaatcgagatccttgcgacttgggcccatcatgacacatcagatcctaggatccacaggatccatgtcggcccatgcaacatcttgggccacccacgacggtgtctggtgtagttacgggtgtgctcctaggtggagcccacttgttagtaggaagttcccgggcctacttgtaggaggcctacatgatcaatgatgtaatttcccatgtacatatgctaagcatataaatgtgcgatgtcgccttagtgaaggcaggattctcatcaatctcataagtctcactcttctagtagttcacacaacttgtacactcccatagctattggatttggttccaacaacaactagcaaccaacaactagctagcagatcaaggcagcaagtattaacaatttatacatatgcatacttgaatatactaatctgccacttgcaaaaggaaactttgcaatagcataaaccctagagatcagccactagatgggtataataatcagataaccagaaaaaaaataataaccaaaagaaggtacaagtgtatacaacaacaggggatttaacggagggaggggcgggggggggggggagcagagatgaagcaagcgatcagcagtggaagaaaaattttggaacagagacacacatctgctaatttggaactctatcaag

SEQ ID NO: 25204 - DNA, 9433 bp, Oryza sativa
aagaaatgagaacaaaaattcaacatttatatatttttaaaaagggaaacaatcagaaatagtatgacttatatggaaatgacgctcggtcggttgggaattttcatgaccattttcatcctagcaaggtatatctgttcagtggaatctgtttgaaagaacaatggaaaaaaaactcccaacactagataaatcggtttcttttatttgcaataatcaacagatccttaattaaataacaagtaattgaaggcagaaatttagtaaaataagaaggatgctagagtggatagcgtccaagccaggacactactagaaacattatctggataaggacactatcaaaaacatcatccacaatctgggtcagcccaatccacacatttgtctattgctggccaccttaggcccccaaaatctcctcccatattgggcacttaattcttccttcctacgttacatttggactgacctctcacagcatgagttaacatacacagcaagcaatttgaatggatttgtctattagtacttaaacatgtacatggcagcaatttatctgtcaatatattgaggatccatggtcctgaacaaaatgtattgtttcattcaaatcagaaattacattcaacatttatacatccacatccaactaagccccaactgcaatgaaatttgttgttctaacaatgtacacaatcatgtaagcttaattgggctatgttcagactgacagcaccatcaagatattacttacaataactaatcgatgataaaccccgggttgactttggttgataaagtggctgataatctcccggggtgggaagcctccctcatgaatatagctagtaggctgattatggtcaaggtggtcctcacggcggttcatatttatctcatgatggtaatggatcttccaaaatgggtgatcaaagctattgataaagagtaaaaggcgaaggtgtttcctttggaaaggacaggaaaatgctagactgctagtgatggtagctgcctagtctttgggatcatgtttaccgactactccaatatggtggtcttggacttcataactaagagaaactaggatgggctctaagaatgtgatggctatggctccaaaagaccgatcccacaaggccatgggctgggctgcccattcaagtgccgcaaagtgttcacgcacttttcaacgttgtggtggttactacagatggtaatgggaggagaccaagttttggactgactgctggctgaaagggaaaaaaattgtagaatgggctcctaacctctttcttatgatccctaaaaagataaaagaaagcagagaacaatagtgcaagctcttataaatagaagatgggtagatgatatactaggaagcctcactatgctggtcatttatgaatatttacaattatgtgacttggtggatgggttaattttgcaatgtgttggagcagtatgtttagaaaatctctgggtcgggatcttacacaagtaaatatgcttatgatactttgtgggatccatcagatttgcaccttggagcagaatatggaaaagttgggcccctaccatgcaaattcttcgcttggttggcagtaaataaccgagggtgaacttccgaccgccttgccaagttccggttgcaacaccgggagcatgcacactttgtgatcaggaagaagaaaccatttaacatctcttcgtcaaatgtgttttctcccgacaactttggtttttgatccttgagaagattggaatggcagctgcagcacctcagtcctcttcaactcgtttctctaactagtggtttaaggccattcaaaaagtccctaagaaggaaaagaagggcttgaattccttgtttatcctagtggcttgggaaatttggaagggtcataacgaccgtgtttttaatggggtacacctaatattttggtggttgttcaagcaggaaagtaccctttggagtattgctggggccaaagctccacgagctttttgtaggtcgctacctcttgatggctaattcctcttaggcctagttctttttctcaacttcaaactttgacttcctcgttttccgttagcacgtttttcaaactgttaaatgttgtgtttttggcaaaaagtttctacgtaaaagttatttaaaaaaatcgaataaatccattttttaattttataataattaatacttaattaattatgtgctaatgagttttctcatttcatgtgcaccggaaatgtccctctaatcggagagaacgaacggggccttagaggttgttttagtggtgtgtcatgttgtgacgcccttttcttttttggtgtcgcttgagggatactttggttctctctcttgtaaatatttcttttcttcttcatgaaatgaagcacaattctcatgcgttttcaataactaattgatgatatattattatgtggcattggagttgataattcaagttacaatacgattataacttgcatagaacttcctttaagaaactctacgggactccatccaagttatctttcccacccattgagttgaagctcttcacaattttcattgctacctcaaaattggtgagtacacatcatttattatttccataattatatacaccatttattattttcataataatcgtcaagattaatttggagtagccaaagcctcgccaactggagtctacacatctttgtttgtgatattttatattattgtaaaacatgatccatgttatttatcccttcattatttgtttgcagaataaattacatctaatcgacatgttattcttttaaaatgttattaaggcatagttttctcaagcctatgctcgtatataaaaattgggtgaagatcataagcaagaccaaatacatcacaaaaggcaaagagaaattacttttacgtattgcagttttttactaatcccttctagacctgcgagttttgctcaattctctatatacctctgagttctggtttttttcccttagatgcctgatctatctaataagtatgaaaaggcctgttttgaccccttttttagtcaagaaaattaacttctagctattttggttgggcacttttatttttattgttgataataaatcattttacaaattactattgcttcggtgcttcccttcaaatctgtttgtaattcattgggtcaatgccaaagcggttaatgggacaagaaaatgattttaaatttaaaatccagtgagaaaataccaaaattacaaaatttatgtatttttggcaatttcatcctcttgattctttttttcaaaattagaaaatagttactaggtgtggttttgatctaggtagggtgtcttctttctttgggtttctagtgaggggcaataatgatagatcatggttggatccaggacattcaaggtgctatttctggtggagtcctagcggattttctcaatctatgagatatgctttctaagattgttttatagctcggcatgaaggatattcatagatggagattctcaactttaggcatagtggaaaaaaacggaccgggctggtggttcaacaggaaaaaactagaaccaaaggtctccaattttcggttgagcctaaagaccggacatgcattcaacccgaatagaaacgactgaaccgaccgggtttagatctccatggttcggttgagcttaaagaccggacatgcattcgacccggataaaaaacaactgaacggactaggtttagactataccgggcactaaaccactttggtacaaccgggtaaaaggagataaatgggccaaattaaggcccagtccattgccttcaggcccacgcggctgtttttttttacaaaaatcataggaaggcttgtggtatagggactcgaaactgggtttgtgcattgagagcgcttggctctagccatcctacccttgttcccttgtattttagagcaaatacacaccgtatatatttgctattgaaccacggttcaaccggcagtccaccggtcagaccgtcggacaggtgcaccaaggggtcatccaggtcactcaccagtccagttttttgcactatgaatttaagacaatattcagctaaggatgcttatgattcctccttccaaggtgccactaaattttcaggccatgggaacgtatttggaaaacatgggcatctggaaagtgtcacttttttcatgtgacttgtcgtgcataatcactgctagacaccagattgtcttgcctgacaaggtctgccacatccagacctttgcgctcattgcgaccaagatgatgaaactattgatcactttctcacaaattgtgtcttcatgaaacagttttggtactccctcctgtagaggtttgtcctaaattctttggtcccccttgaatgacgatcaaaataagtggtggagcataatcattgagggtgcaatatggcctgaattctatagtcattcttggttcttggacgctttggatgcatcgaaaccattgtgttttttatgggactgctcctaaattggccgatgctcttttgcttgccaaggaggaagcacaactgtggtttttgccggcctcaggggctatcattattgactactcaagagccgggtggttagtctcacatcatggtttggtttgtggttgtggtcttgtgttgtggtttggtttgcaacatgtatggttcctagaactcattatgtgcgtgtttggttctgtactcagggttatagcccatctttttttcttgttaatatgatgataaacagatctcctacgtattggagaaaaaaatgaggggtgatatggtcattctagaacaaccaatgatataggaacaaaaaggtatgcatggaatgaagagccaaacatattggcatacatgatatcgagctaaacttagaagttgtatataagtaatagaataataaaataataggcagcatacaacgaattatctcaaagataaattaacaggacaacaataccaaataaaataggcattctcatttcagataaatatgattttcaagattgcactttctgatacttggattatgtcactttctactgtgatatatgttcaatcattttattatgttcattgcacatactggatgaaacaacaaatcaatgacttaatcctcatctgcaccaacatccatcacatcaaatacttgtccctgcagtagcatattcatattagtcaattcctttgccatggtttggttcttcacccggtcttgaatgttcactccaataatcatctctactgcttcaagggttctcttttcctagtaaatagtagaaagtgttccaattagttttctttacataatttttaatataataatatataattttcttttcagaaataataataatacatataagtcttacctctaaatccaagagttgctcagccagaaggttggaactattgaaagatactatgctagaattgacatctttggagaattgagatggcaccaaaaatgccattgtttcatttgttggtttgcatatcttctctaatttagggaacttgatgggacggaaatttctttcttgatgaacagttgagatcgctcgctttggaaagactagcaaatttgttatatgcccacctagtgacgaaatgacaaggcaaaaaaaatgttaaaataagaacctttcggaaagaacaaaagtgaccctttcagaaagaacaaaagtgaccctttcagaaagaacaaaagtgaactaaaatggacttcatgtagacttacctattttgttttctattttattaataacttgccatgctcttgtgtcccaaacaaggatagtgcaatcctttgatgcagaaaccaaccttactcctttagacaaaatgctaatgcagtaattggagcgctgttgacaagttggaatcagccaattagttttatgttgtgctaattattttatggattcacaacacttaaaatcaaatattttatcaatgttaggtatagattagatatcaagactttatagacttttgttaaaaaatacttcggaccaatcataatctaacatagaaagaaactaatactcaagattggatacaatagaaactaacgtatagatacatattacataagtttagaaaagtctaaatacaccccgcccaaaagaaactttgattgaaagtccatttggcaccctaatctattaaaccaaatacccaaccctccgaactatataatatcatacataaaccaaatactagtgcattttgcaaactggtttttatgtaatttgcatatacgttcgatgactgcatgacattggacatatatgctaatatctccacctaaatctttcattcttacccacttttttcttgaacttacaaatgaatgtcgatataatactagtatggcataactatatcttatatattgatgaccaatgactgatgatgtgtaacaggctcatttaagcttccaaatgcacaaagccactatccaaaatcactttaggaaataatatgaatggtattccaaagtctgggggttatgtttagggtgctacacggaattttacccaaagtttagaggttatgttcaccgtttccttgaagttttaattgtgataaagaaatgtgttctcattttggaaatccctataattgttttatattcttgataataatatttgttctaaatttaaaatagtacattgcatcttattgtcaattattgatatgtcttgagtaacatttgcaaaatttaccaatcaatgctcttaattcaactataacttacttgtgtcctgaaagaatttgacaattatcctcaaaacatgttaaactggatttttttgtcccaattccattcaacacagtgacatatatacaagtatcaccagccccacaaagtagaaattgttccaaaggatcaactgcgattgtagtaactgaactggagagtgaaatggtgtgaagtagtaacccagacaatagatccgtaacctagaaaaataacatattctcaaagttgtcatcagcgccaatggaaatcatgctcaaatctacattcaaaaagtgtgctaaatcttacgagtaagtgttctgttgcattttggtcttggtactattattgaatatattttaagcaatgaataacacaagcacaagaaattgaccacatcgagttttgtgttgatatgagatctagttataatattgaagcaaacatcagaatagtaaattgtatagacaacaaacatatatgtaagttatattgtttaaaaagaactaagcatatagaaccattttactgaataatatattttgaatgtatggagtatcagtagtcataattcattgctaaattatgaaagtgtacatgacatttagtacaggaactagatttcaagtttcatataggatgctgataaagttgcaatattgatcactgcaaaaggaaacaacatatttcatctgaggtgcattaaaccttgcaattgccatcgagtgagctcgttattagaatgggacattgaccccttagcattgttaaaatgccagttattgacgccttgtgctcatttttctttacattataaaagttgggatatatctctgtaccttcaatgggtcgaggttcctctgcttgaaataaactgcaaagttcatatgcagagcgaaaaataggttattgaaagcatgtgttaacttaaatgcttagttgattattcccattggagggtttggtgcctcatctgatatcaaatagccttacataccaacaataatatactggtaacactgttctttttctgaagtggagcatttctcaaatatttattgtactgcttttatgagatgtttggtatgataatatatagttagaagagtgagactttgtctctggagtggagtgagaagaacagaggacaattgttgacatgatgaattgtaaaaatagcttattttcaactacctacatacatatcattgaattctggaaaattgttgcatagatgatttcaatggtggagatagtgagacaacggctcagttctaggaaatgtggtcatttgtctcatggtggttgggaaacattgataaaaatatatttacccaacatccctttacggcttatatatgatgggttttatcttatgcttgaatgagtccacaaacaagttggttctatcagaggtagcttataggtgaaatcatcctattggactaatgtgattgcattgacatttaatgcgattcattaaaaatgatctatatgttttaatacttgcctgtaagactcctttccaaatcaaactgtaaaaaatagtttgtgtagtgatagtgactaatggagtgggaagagcaagaagacattgacaccttgctggatcaactgaatatgagacaacttgctaaaggggttgtagcctagtggttacagtgctcaagtagcacctctaggtccttcattcgactttccaagggagcaaatttcatgcttgaataaaagaaaaagatgccgtgagggcctccctcgctatttccaataaaaaaataaacaactctaattgcaatccaaggattgtctcaaatagtctacaagcctgatgagactgttgcgcttatatagtttgcaagctatttgggacatttttctctttgtcataagtagttctttagctacctattcttgctagttggttctggtagtgctgaataatgtagtggtgctttgttcctatgctttgaatggcaagcctgcgtgtaatactagtaaacccaacaggaaaagttgggccttaaaaaaaaggaaaaaagtacaaattaccccctgaactatcacggtcgaccgaattaccccccccccccgaactcgaaaaccagatatcgctcaccctaaactttcaataccggacaaaacacccccctactcaatatcagagtggtttcagtccaacgtggcagtccagtcagcaactttttatttaaaaaaggcaaattttgctacagaatactacttatgtgtggttttagccctaggacactgctcaaactcacatttggggaaaaacactccataaacatggtaatttgctagtggacaccgcgccgattaaaataataatatccagttgaagaggagagagaaatcacatgaaatgtcaatgtcaaaaatacccttcggcccacatgtcagcactcatatctctcttcttttaatttctccctatcttcctccttccagcgtcactctgagaggcaagccggcgtgcggaggaccggcacgggtgcgacggccttgcgggtggcacggcgaggcgaggtggcgagcgccagcggggtgcggcggctgtgcgggcggtgcggcagtgacagcggctcgtggcgacaccatgcaaggtgcgt

SEQ ID NO: 25205 - DNA, 19842 bp, Oryza sativa
aagatagggagagattaaaagaagagagatatgagtgctgacatgtgggccgaagggtatttttgatatttcatgtgacttttctctcctcttctaccagatattattattttaattggggcggtgtccactggcaaattactatgtttatagagtgttttcccccaaaagtgagtttgggcagtgtcctagggttaaaaccacacataagcagtgtcctgtagcaaaatttgcctttaaaaaatggtggggctcacatatcatagtctctctcctctctatcccctctcacctctctatctctctctgatgtcgctcactcgccgctgagaacgagcagcgcatgcgccgacggtggctggcccgacgcagttggttggctgcaaaggccggcgaccgcggaaacgaaggtagcgtgatcgaggactagcggcgcgccagcggttgcgagtctcctcgaggcagaggccgaggatgtggcgtgccggcggtggccggcccatcaggctcaccaggcctcgtcctcctgtggttaggggagtagtggctcgcgccggacttacgcgagaaggcagccatggcgggggagaggggtgacgcggcggggcggctgcaaaggctgacgaccatagaggcgagggcagcgcggtcggtggcgaggctaaggcaactcggggtcacgggtgaggcagctcagggtcgcgggtgagcagtagggagaagagtagacgagtggttcatcgtcgccatcgccgtcgacgtcattggccggcgctgaggcaaaagcgccagcgctgttgctgctcccttccctggagacggcggtgaggcctctctctctctctctcaactcaggcaggcggcgagcgatgagtctgtcgatgtttaagatcgcgactagggtatttggatggtatggggatcgttggtaccaggtatatgcgagattgaggtaaaagagatggagacatggatttttatacaggttcgggcccctcatctgataggtaatagccctacatcctgttgaccgaagccagtgttgctcttattcatctgaatcacacaagtacaatatttgggataacctatctagttgtcgtcaacttggcggctagataaccaactcgtagtcgacaacagggcagtcttcctcctcgaatatgaacccgttgagatcagagatgatgctagatccctcttaccggcctccgtaggcaccggatggggtatgtctggctaatctctgatgtcgagatctggcggcgtgtgttagcgtgtgtatatgttggtcttgtggttttgtggcgtttggcttctgtctcctctcctcctaggggggcttgtatttatacccatagatgcccccttgtccaagtagaactagggagataaacatagatacgatccgagtagtccttgtagtttacatatagaactctttttgtccttccttatccggaactccttctatatacgaggtatgattccatataaaacatggtatgtggtgggccctgccgagcttagtcgattactattgggtatgtgatatccataaccctgacaaagtcctcatcggggaaggcgcgacacgtgcggtggggagggcgaggcgggcggtgggcgccgacgaggacattggagacggcaggctatggcgacgagtttgcagcccatccccgtcgtcccagcgcccggttgctcctcctccaccgcgtgctccaccgctctgtcatcgccgcctccgctccaatcacctctccttcccgacgccctcgttggcggctctacccctctagccccgtcgcgacgcgccctacccaatctcaccgccgcaccagagggaagaaagagaaaggagagattttagcagtactctgaccgccactgggtcctccgcaccgccctcgcctccgcatacttgccgctgccggcacgcgccgccttcgcttccgcctacttgccgctgccggtcgcgtcgccatgttgtgtcgcccatctccccccatgccacgcgctacagaagaggagggagaagagcgccgcgtcacgccctctccctagccaccacccacttcagaaggggatggagaagagagatgtgggcggggattccaacgagtgggccctagcaatttttttttaaaaaaaactgatgtctggactgccacgtgtgctatttgaatcctaaaccgcttgcaacagtgctcggggggagggggtgttttgtccggtattaaaagttcaaggtgagcgatatctggttttcgagttcagggggtaattcagtcgaccacgatatttcagggagtaatttgtatttttttcctaaaaaaaatgcttcaccgacttctagcttgtagagagtacctgaccattgaccaagtataaaccatcccttctatagatccagagatgagaaacgaactatcttgagagaaggctaaacaacttatagcatttttatgtccgcaccatcttttcaataatgctccacttgctatctgaaatgaacaatattttcaagtgaaaaagagttcatattaaacagaaatttgtcactaagtgtgtgatgcaaaatttaaattattactctttttagatatttgtactatttgcaagaatatttcccatagaagatgcaatctttatttatgaatttggattaaaaaatacactcatacactaaccatccaagtagaatatcaaacaatgcagtaggttaaaaaatgttagtatgtcaagtgaagtagaatgagaggcattaagattttgttcaagcgaaatcatacatacaaaagggatattcaactgaactgcttctcaaatataaatacaaatcattatatatccttgctggaacagcactaccaatttatcgctaaatgaactcgtaatgttatttttagggaagttaacatagtgactagaagtataattaacttccatggtcataaactttcttccgtttgtcagttacatggacctccttatttagatcatccaaactaacattaacaaatggagcaaaccaatttatgatcagagtggcatcctttcgataaagatggagcataacgaatactaggttataaatgaaagaattggcggggcataagttttgatgtgatcttttattagttcaaacttcattttgtattgctggacaaaccagttgaagttcggtagattcatacatgtttaaataggaaatccccatgtctttcataaatcaaaataaaagaacttggtattgttggatataattatgcattagtgatgacaggataattcgtagaatgatttaaaaaacaaacataaacacaagccataccttcctttaatataaagatacccaattcaaacatcgaacaatgcatcaagagtctcttgttgatcataatctagctagaatagaacgacgtatgaatagtttaattcttttgtagaaagaggaagctttttttatttacctcccaaatataagtatgtccagaactagcaccaccaaccaaatacaccccatcttttgagcaagcaatgggcccaatggcttcagctacataacttttttgcacttccttgatctgtaaaaggaaaataatttaaatggaactagaataggactatagggtattcacaattgagatataaacactcacatgtttgagcattaatcctttgggcccatatgttaaaagtaatgccattttgttttctcactaaatgttaaatttgaacacttataatattttacaatcaatcagttttagtcatttaccatatagaaacatacaccgtatgtacttgttgtgtaagggtaatgagaagttgtagttagttgattctatgtcctcggttgattgagggaaaaaactattacatctagaaatgagcaatacatgccgagttttagatgaaataggaaaaatggacttaatgtattatcactttagcttgtaacttggatcacatttttcatctgaattatgactcaccctaatcacaatcacacttttacatcttgaatcccttctaccataatctggcatatgatttctgactaaaattgaaaaacctgaatttgtcaatactgatcgaattagatctactcctacaaacatgatagcgaaaaatctaacaaaatttagagtattttgataaaataatccatcttattttttaatgaaacatataatttaatttggaaccaatcataacacaaggaccagttctagccctagacttctgcaattaattcattctctagactaatttgctgccatgatccacacaatccaacctatgatctacacaaaatccattacctgaaagggcaaagacgaagaaaagacatcacatggcacaaaagaaatcttaccttacttggagcccagaaatatatagcacttccaaagattggttgatccttgtctgtccgagatgcagcgaggagaaatccatcaacaaaagcgaggccacatggaggagcaacgcagtcgtgtatgtacataatcttctcgcatgtgttgatatcgtacaccaaccctacatcattagcacacaccactagcattgcctctttctcccccattctctatcttaggtaggcaatggttctggtagagaggttaggaaagtgaagatattgtttataatgattttggtcttggagtactaggaagtgaaaagaggttaataaagacaatccaaaaaaagctccaaaaagtctgaaactgaaattcctttttaggagagttaaagatgtgcatctcatgaggcaaggaccacagagtttgctgagtacaaatggtccttatatactccatccgtttcacaatgtaagtcattctagcatgtcatatattaatattgatgttaatgaatctagacatatatatctatctaaattcattaacatcatataaatgtgggaaatgctagaatgacttacattgtgaaacggaggaagcagcttcttctataagggtacataaaaacttccttggttatctatggatgtttttagatgcagaaggccttgtttgttaaaatgggtcaggattttggccaaagaaagttctaggagattacacaagcatttaatagagaaaaaaacattttgatattgaaagttaattctttaggataaattgttctctaattgatacatccagttttataactaaagcatttattagttttgaggatttagatcatccactacaccctaacgagtcaacattttagagatatggagagagggttcatgtggtaaattcgaaaggccacttagagatcatatcttgtcatatatcatagcatcattcggtggcaaaggtcaacaaagatggcattgaaatgaacaacagggtaagtgcaaaaaaaagtatgcaatctcaccattgagcccctctctcgcgcaactttcccaccctcatccccctccttccgtcccctatgccactaagttgagaccctaaaaccatagagtagccactcattgtcatcctgctaggctggtatacatgccatcattcgcgcactccctagcaggcactaagtgccgccatgctgtctccaacccctcctaagctcctccacgctgcatatgtgaccgcacctcccccatgcctcctaggctagcagtcgttgttctgccgtcccaacaccacaagacatactgtagaagctcggtgcatctgcccgtagctgcacagccaacttctcgagctcctcccttcacactaaagtcttcccaatgctccttgatccatgctgaaggctttcccgagctcctcaaccactcccgtgttcctccccaataacgcaaggcatctgtggaagtcctcccccccccctcccctcccgtgctctagttgtgcaacttcaaggtcccccaacatcgttttcacctctgcctgaggacaattctgaggtcccccaaccgtggtttttcattcaaaattggttatgtacgtggaaattgaatttccttgtcaactaggaatcgtgaatttatatatcctacactacatagttggagccaaaagcttaacaatcattgagccacatcatctataaaatattgtcctttggatccatcttatgcttttatcttaatcattcatatgccataacatcacatagaaaataccagcctttggatccatcctatgctttgatgtcaaccattcatatgccatatgaatttaaaatccactacgtttattgccataaggcttaatgtacattgaaccatgacacctagaaaagtaataatcattagattactctcacacttataaaattgcaatttcacatcaattactatatagagctcaaaatattgtccatttaggtattacgagtacacgatttaaaaaaatacaagttttctttaaaatatttctaaattcccggttgcaacgtgtggggtatatccactaattatgcaaatattgtgatgtagattgccttctctgatgatgatgccaaaccttgggctaccatggaccatgctagttttctttcaatgattatttttcacatttttggggctgcaaaaggaataagccactttgactccctcaaatataagtacagacccgtttggtagagctccaactcctaaatttaattccgagggttgggtctggagtagagttgtggaacagtctaaactcaactccacctttctactttattttgtgagagcgctcaccaagctccactcccattttagatggagctgaaactatttggctatgctccaattccacgagaggtggagctggagctagagttgtgccaaatagaccctacaatccgattcgtatccctcaaccgcaataccagatatcttaaccctaaactagtaaaaccagtgcaaaattactccctcggtggttttgagggtggttttcgctgacgtggcatgttgacctagtccaccttgctaagtcatcatgtgggacccacgagtcagcgtccttctttcactatatcttttctctcttcccacttcctctccgacctatccatttgacgcagttgtgggcgccgcactcccttcctctgccccgggtcttcagccttagcttctgcggtggccatctcgcggtgccggagacgatgtgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaccaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcatgctccaccagcttggggcacaccccacatgggccccacctgggccggggtcccaaatgaagttacaagcccataggcccattataggtgatgcaacatcttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaacaaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatagaacattggttggatatggcaaatcagacttagcaaataatttctccttgaaattatcgagctcacaaaaatcatcaaactgaacatagcccatagtatttaaagaagatctcaattcacgctcctctacttcattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggtggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatggaaacataaacatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtctccctcgaaataaggcagtgcagatttgatcttacctagaacatcatcacttacctcataatggtcatgttgatccctcctcatgtctcgacgaagatgtcgatgttgagcgcagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttctttccttttcttttctgttttttttttgtgcggcttttttttttgcacctttctgccttttttttcactttttttcttgatttttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaatttgccaaggtgtttgacacaactcggaaccgtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaatcttgactacttccaaaatcagatatggtaattcaccttcctcctctcgtgcacgacataggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctggcccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatctttttgttcatccatgatgtgagcaatggttgcatccgtggtagccatggtcacatcacgatgtcacctcgccgacgccaccgtgggtggtgctcccttccttcgctctgtatctttgtcctcgacctccacggaggctagtcgacgccggatgacgtccagtagcgtgaggcgcctccccaacaccaccgcggtaggagccagcttgcggcgaccaccgccctcgccctcatcctcgtcctcatcgcagaggttggacaacgtgaccatctgcgcggctaacatgatgcctcgttgcggcgacgtcatcacccacacctttatctcctcctgtgcgaattgttccttgaggttgccggtggacccccgtcaccattgaccagggaggagtaggcggcggctacttggcagccgacgaagcacacggctcatgtgacaaggacaaagtgacgtcggcatggggtgttggtggctcgtggtgaggtcgtggtggtggaactggtggaactacggcttgacggtggtgtgccctaacccaacggccatggacgaaggcagtggcctcgtcgcccttgactggtcagacggtgaagaagacccacccacccccctgcatccatatctctttctcctccctcccctttctccccctacatctccctcggcacagttcctctcgtcatgtgggcagcccggcacatgacagggatcgcgtccaccgacacataactctcttctcctcccccaatgtcgttgctgccaagcaagccgaagcactgtgtggctactcgctcttccggcattctaccgtgagaggacatcacgctggtgttgctgctcgcctcgttgctcttcctcgcgatagatgtgttcagccgtcagcccagcgacgttgatgcttttccctggccattgccaccacgacatgggctaaccttgtgaatggaggtgggctcggggctcgcagcggcccgcgcgaaggacagggacagcgacatgctacggcacctcgtcgttgcttgcgcctcctctcgagggaagaggaggagctcaaccacggcggcatggccctgctacgatggggagatgtggtggtggaggaggagcccgccatatttgactacgcaggatatcgttggtgcccgcaccatcgcctacccaccggagaggtgtgtgaaggaggagagagagagagaggaggacatgtaggtcccacacgctggctcagctgattagactatgtcaatgatccatgtcatcgaaatccaccctcagaaccaccgagagagtcattttgctccggtttcgacagttggggggtcaatatatctggtattgcagctaatttgagggactcaatgtagacttaccgcgctgcaaaacgcaggaccgagcctgcccggcccgattgggctgccgggtcgggcggcccacgagcaggtctagccgcccggtctcctctcctccacgatgagacgaggagccgaggagaggaagggtttaaagcgcttcttcactcgatctcgccgcgagagacccaccgatctgccctccgccccccaacatggcgacgccaccgccgctccgccgcgtcgccgccctcctcctcctcctcgtcgccgccgcctccacccccaccgcacgggccgatctcgtcgtcaccagggcggatcggaaggtgagctcccgcctcgcttctttgtctctctgcgcgccctccagatctcccgacgagcacgccgcgccttctgcccccggatctgaggcctctttgcccttccttttcttttttgcaggttgacctgacttcgcacatcgttcgtgtcctcacttcgctcaaggtacacgcggttgttgttgctgtgttctctcgaattttgtttgtctagttggggggagattcagccgttccccggttcgttcgtccgatctgttaagggagcttctcatttcatcgtgatatagttctggatgggtagatgtttgtctcttcatcgctgataatatgataagagcgctgtaatgtgtggatggatcatggatggagttagcgtttcatcattaatggtgtcctgtataggttcatcgcctcgacgtgtgctcacgagtgctccaaattcttaacgtctcaatttgggatgttcaattccatgtctcgcatgatttggcctgcagattctttgggttgcaagctctcttctggttgatttgaagttggggtttaactggcaataggggttctgtgtttgtcagtgccaccaccaattctaaaatctccgagtaactctttttgaattacactttgtctgatgccagtcctcactagtagatagagtaatatatggggttttgtctatgcacatgtgatatgctgaggttttgcttttgttgtaatctctgttttttttaggttgagaatagtggaccggaggctgtttctcaatttctactggcgtttcccaatgtccaagcaaagaacttagcagctataagagcatttggtactgaggaaaaggtgaaaggtccaagtatggtccttccgattgaagttgttcagccttctggagtgcccccagaacttacattcttttcggcatctttatccaaacctttggagaaggggaagactcttcacttagatgtcctgaccgtatttacgcactctgtccagccattccccgaagaaatcacacaagctgaatcgcagcttgttgtctatcaggacagtgctcagtatctgtcaccttaccctgttaaggtacagacacttagtatcagattgcctggtggaagagttgagtcctacacaaagtacccaaacacaaaacttgcagagtcagaactaaaatatggaccatatgaagatcttccaccgttttcctactcccctatggttgtgcactatgagaacaataacccttttgcagttgcaaaggaagttataagggagatagagatatctcactgggggaatgtacagattacagaacattacaacattgctcatggtggtgccaaactcaagggtgaattttccaggttcttctcccttctaacttgtgctttaaatagctcacctttagctggatagaaaaaatttgtccagagataactgatgtgttcaaatttgcaggattgattaccaatctagaccgtacataagaggggtctcatcttttaggcatcttattgctagactgcctccaagggcacattctatatactacagagatgagattggtaacatttcaacatcacatttatggagtgattccaagaaggtacacttgctttttattatctcagtttcaaggctataatattcccagcaaaattgcaaaagtgagtgcatatgctgaatatttatcctattgcagactcaacttgaagttgagccaaggtttcctttgtttggtggttggcaaacgacctttaccattggttatggtttacctcttcaagactttgttttcaattctgatggaaagagattcctcaatatcacatttggttctccagtggaggagattctcatagaaaagcttattgtgaaggtatgttctcctgtacccatctggcacgcacggtaaaatctttcattttttacccttgtgttccatgttttgttcttaattgcactgatatagaattttagacaccaaacataattccttgtgttgcctatttctttgatattgaaattagatcttcatttattgctgggaacctgcaactaacatacccttttgttgtcttggctatcttctggtgtattgtccttcacttagttatttttattttatgtttctaaaaaaatgtagatgacatgtcatggttagataatcaataagaaatacatttgcacatatttccatgaacgtgatgttacatattaatttccctccctgcataaaaacctttctttttgaacaggttgttctgcctgaaggttcaaaggatattgatatttcagttccatttccaacaaagcaagagcaagaggtgacttcttgttggatgatacacacacacacacacacacatatattctgaacaactagctgatcctgttcttttgttgtaatgacaatgatttgtggtgcaggtgaagtattcacaccttgatatttctggaaggccagtggttgtcttggagaagcttgatgttattccagagcataatctatatttccaggtttgtcttcagacttaatttgttgtgcaactaattttacccctccatgaaaagttgagcgttgctaaattattaacctgactgaagagtatgtaaaatctgctatgcaaaaggcttactgcaccatgaatactttctgtgagttgtctatctcatggtgttttatgtgaaccatagcaaacttatggtgttaatgccctacaatatgcaggtttactacaggttcaacaacatctctctactcagagaaccgatgatgttgataactggcttctttctcctcttcatggcctgtattgtttacatgcgcactgacatgtcaatctctaagaattctccttcttatctggcaaaggtgcagtgggatgaggtatggtcgttttagtcaaatctcccctttgaggattggattttgatgatttacgagaaatgtttaaatctatcttgccataacctttcttctagtgaactacagtttgttactatactgctgctatgtttaggatgagcactaattacagtgaaataaacttatgaatcataattcgaattggtttgctagctcatacggagtactatgtagcggtgttatttttatgggagaaaaaaaatgcaatgataaaaacttgaactagtaaatatcagatgacaaacatattagggcctgagcaaatagctaggaaaggtctcaaaatgtgcagggttgaatggtggccttaaattttggggagggcttgtttactagtaattttagttggataagtgacaagtttactatcagaatcatgtgagaacttttagttggataagtgacaagtttactatcagaatcatgtgagaacgctgtcctttctgttaaagattggcttttgagagctttggtccaaaaatggacaagttacaagtgaagggtcttaaccacggtggaatagaatctgcaaaacaagctctaaatgaatctggaggtaaagagcagtccatgctgtgttaaaagcgagcttcataattgacagggaaaaaaatgttacttgaaaagtcctaaatcttcaatccaaacttcaaagttaagaagataataattgcgtatcattggtttaagcagttaagctggatcaacattaattgtagtgtttctggaattgaagaatgctttaaacttgtggagacctcttactttctgcagactaacctctacaatctatttcatactttttgtacaggtacagagcatcatccagcaaatccaggctatcttcaaccaatgtctagcagctcatgataaactggagacctcattacacgagttatctaggtcaggagatgttaaatcatgcaaagtggctcgtaagacagctgatgcacagtttaaggaattagcaaaagagttgaagccattgttgacatccctgcagtcatcctctcagtcttaccagatatggccaaaggtttgctcaacgtcttgtgcatagaccacctagaagagagagatacttactagtgcatctttattcaccatttaatttgaatttgagttctttgcccacattctctaattaagtatatgcgccatagtggttacagttggcctttttttctttaatgcaggtagaggaattggttgccaaggagagagagttgcaggataagctcatgacaaggcattccactgtggttgacagctttgaaaagaagttgcgagggcaagatgtggagaacaggattgctgcccagcagcagaaagttgctgccctgaggcaagaggtcgaatctcttttagagtacatcagtgagatctgagcgaatccggcgctgcatggtatgtcaatttagcaattagactggagaatggatcacctggtttctcattgtgcgaatttgatatgctcgaattcgaatcaaatactcgtagatttcctgttgataacctgtctcagtcattcaggctgggagtttcaaaggaccttgtaacatgataagcacttgtgaccgcctgaaactgattgaaattttgcacttaatagcaaatcacgcgacctttcaccttgtttcatatgtaattttcatgaagatgccataatacctttcacgaacattgcaacgtttctagacagcaactctttcatggtagtactaagctaattgctccattcacctaatagggtcatcatgggaagttgaagatcaggcaaaagaagtttgacagctaatcatattttattttttttcttaataaaatataacgtctcatgtgtttttcgagaaaagaaaaaagccaaagtcatttttcgcagttgacagtctgaaataacaaagattgaccaccgggtgtatcatcttcatgttctggactcctaaaagctcatctaatatgttaaaaccctaataacttgaattaatggattgtacgtagtatcaactctgccacggactggctcgtcaaaacgtccagtgagacatgtgagatctcaaaagcaatattatttctctttacctatggcggtagacggtgctcctaacgaatgaattcactgtgccaagagaaataaacagatgaaaataggcttgtaaacatcagacatgggatcaagccagctaaaatattatcatttttgtttgcttgtattacaagatcaactaggattactctgctgggttaattagatccgtgccattaaaaatattccggttttaaaatatgccacgagcatttacatatttgaatccatgccatataatttacacatattcaagatatgccactacctacctcttagatgcatttacgaaaaaatgtggaccaaattgcccttgtttccttcttcctttttctccccttctttcttccacagctcagagaccagtgatgcttagtgtcggcagcagcaagcacaaccagcgataaacatacgagtgttgcagtcattgtctcctccctctccagcgttattttgcacgcgacatctgcatctccctccacctcacactgccgttagggggacgcctgcgactgcagcgctatctccacctcggggctccgcaccctcgccgcggccgccgcctgctgctgctgctgctactgggggacgcctgcgacggcgacgggcacacggagtgcagtgttgcggttgcgacggcggcggctgaggcgactagggcagcgactgctggaatcggatgggctcgagcagcgagggcgatggcggcagcgatagagcaagttgtggctcacaacggcgaggacggcggcggagagagcggagagaacggagcggcggtggagcaagaaagcagcgggaagagagaggtagaagacgagggaagagagagaggtaaaagatgagtgcattttcgtctaatacatgcaaaatacgtatctttgtgggtattaacaccactgagattataaataagtagcagtggcatcgttacaaatacgcaattgaaattacaaataagtagcagtggcatcgttacaaatacgcaattgagattacaaatagcagtagcattgttacaaatacgtaaatagtaatagtatatttcgaaaccagcaaatttttaatggcatgtatctaattaaccctatctattttcatgtatgacataatatcattatattaatatttaaaaatacttttaattgttaatgcttcttgttttgtacctatattaggaagaaattaatgatcaaaatatttattcaatgtcaaagactatattgtacgcctcaactcttgtgactaatgagaaaggagcaagtattcacggctaattatttttttagtagtagataatgtatctgtcgataacgagacacacacgataacttggtcgatacgaaaatttaccaacccagttattttatatgataatagagatgaggtatgcgtgtatgatttcatagaaataagtggatgcgtattgtgatcatgtttgttctttataaaaagaagtattttaaaggaggtgaacaaaatcgtctttgcctttcatcaccctttacaagtttgaccttttcatgtcatgaattttttttaaaaaaatggataaattagcaatgacaaaaacaacattcacccccacctcttcccctgtttctgaccaatcccctctgctctctcctctcctctctccctctcccgcgatctgcagagccgcttgtgccc

SEQ ID NO: 25206 - DNA, 5013 bp, Oryza sativa
ctctctctcgcagctggtagcccccctctcccccatccctcctccttccgcgccacttcatcagcggggcggtgtggactggagatcccccatcccggcgtggattggattcgattggtttgatctcgtttctctccctagcctgtagctttttcttttgttagaaacggaaaacggaggattaaaccccatatgcccccgcgtgttaggtttaggtctgcctgcacctggattcatcgttctagggtgggggatttatgatcgagtaccaaaggatttatgatccgcttgtggtttttcgccttgcgataaagctgaacacagttgacaataattctctctgtagagatagtcgatgggcgatcgtaatcctgactagaaaatttgattacactgccatcccgcactacttgtggttctatataataaatgaattcgttgctcgtcattgcgccgttgctcattctccattcctgagcacgcacaaactattgcgcaccatccttgtagctggtgggtataatatatgcgtattgatgcaagtgtgtctagtggccatcgctaccaaggaaaatcagtgatcactaggtcatggctgacacgattcagcagtggagctgtgttgttgattaagaccccatgaaaagtcagttaacctaagatagttattactaatggttcccttgtaacaagaattggggatggtacccagtgtgcccccacatccattgatgcaggccaaattgtttgtgggctgcaaaacctttctcttatcataacagacaaatgaaaaccagaaaatggtctatatatatatatatatatatatatatatatatatatatatatatatatatatatatatatggtgttggtttttcttctcagtattatgaaatctacacacatccagaagagtaatttgtgttggatgatgccaatatttatttctatagtgtatgtaacgttgtggcaacatcagcatgtcacaatttgtgtgtgtctgtcttaacacatgctaattttgatgtgtgtgtgtgttgtgcgtgtgaagggcaggggtatcctaccccttctgactactatggaaccatcactctgagctggtaggagcagtaaccattttcaccagttaatccatcgctgctgctaaatgtatcactatgtttattttttctttaagccaatagcttgtctcgacagcatactatgttcaaaatattgtggtgctctctccaagctgggttagttatgcatttatagattgtcctgctcaaatatctttattgatcttcagtcactgcaagaccattcacctccatgcacatgatgcactctctaaaaaagttacattctaccagttcattatctcatttgtcatgtgcagaaaattgtttgattaactttgttagtattatgagtcattcgggatcatcaacttgagatgatattaagtcgtgtcgatatgttggaactgggaatttgcacgtgctttcctatcttacacttatgccactgacagttgggctctgttttaatttaaaacacaggaatttcacagatatcagttcaattcctacacaaaccagaaaaaatctcacattacatttgggccttaatgttctaatgtttttaccgtatttgcatatctccaactatatgttattatttttctttctggcatcatgcatcatcaattttcctgcatgaaaacatgatgaagccatttaacattatatgactttggcagctttcgtgagtgaggatttctcaaacttcatttattttccatcactgggaggtgttgaagcttaatcatgaggtcaattcttgcttcctacctttggacatatttctgctggtttgcataccttaggcccacgcccataacacgttaccaagaagtatgtttggtaaattctgaggattatttgttattttccagttgctatgatatgtaaattaaaaaaacaaaactcggccggcgggggaaagaccgccccctcatcttttcaagctaagaagaaaccacagacaaagctagtcaagaaaggccacgaaccctgggcccttgacaaagaatcaatttaagcagcacctctttgtttacagttgtttttcctttttttttcctttttaccttacaaaagttaaggttccagccaggcagttattaatatgaggtggtgtaaagattcagcagtttcaatgatgatgaaatcagtggttccattccggattacttcagggtcaaatattgtttagatgggactcaatgttgagaatttagagctgtatgattgtatgattgtttagtaaaatcaaatattactataaatactaaaaagttgagaatttagagctgtatgattgttgaagtatgatgtctcaatcttttaggcccagaaatagtagtttgttgatttatgctgcttggatttcagaacctgatacgttaaaactgaagggatgaaagggcaaacagagcttgtcaaagttttgtgttaagaaaaaggtgacacggctccttttgatgatggtaccatggtggaataacttacaataaggccctaagtgcttagacagatacaccatagctgctgatttgtacatgaattttgtttcgaaaaactgtttgatttttagattaaagaactttatggagttttagattcatacaccatctttttttcttttttggtgtggaaatgctggactgttaagagctagttgaaaaaaaactactgcacaagcgtgagtttagagtttacttaatttgattttactgtttttctttagctctcgtcgtgtgaagtggaatgaagacaacctgtatgagattgaatcaaataaacctgttaggcagaagataactgagcctaagacaccatatcaccctatggtagatgatgatggtacatgttttcctgttctgatctcattatacctttacttgaccatattagttactgtgtcgttgttgaatatgtcttgccattgctttctttatagggtcattgtcaccaacgcgtccttttgacaagtgtctggatgagactgttaatgctgaagctattttaactgctttaaatggtgtggcttcttcaagcaaaactgatccaaaggatgatggttgggcatcctcagatgatgatgcagatgccatggaacaagatgatggttgtgcctcttaccctgttcccattttcatatatctaccctgcatgtagtaatttgctcttatattttccctgtttcagttaaatgcatttgaagacatcttgtttttgatggaaaaattaattaattgattatcaggaaattacatgaatatgtctgaaaagtcttgtcattggataagtagcgcaaatcttactggaagttatagtatgttaacattttgtaatagtaaagcacatacaccgaccaaacccttagcattgctctactaaagcaacgtacatatctggagaggaggcatttaatagagattctgagaaccagttcaaaataaatcttgaaggttatactttgtaccagctcaaaatgatgatgattaaaacacattttttgagtttgatggtcagaaaagaacagaagtgattatcaatattcatttatttccacatgttaagctagctccaatttatctattaacttccaaagcaaattcaattttgacctagatgcatctgatgacagatgacacagctcttcttaatatatctgttttatataattagacaaatgtttagttcttgcttcctcgttggtaaatttcgtcaattcatcttaaaatcatgttgtatacggagtactttcttttgacgacataagcaagggatacataccatcattacgaattggcaataatctgttattcaccatagggaacctgaaatcttatggagtatgatagttcctgtgggatgtttcctggtatcatcggagagttagttatatgttggtgttcatgtagatccagaagctgaaaagtcaagactgagtttcaaggaacatcgtcgtgctcactatgatgaattcctcaaggtgaaggagctgatgcgctccggatcgctgattgacgatgaggctgatgaggatgatagaggtgcaaaaggcagccaagccaaagctgtaggaaagaagccagcaggctgtgacagcacacccccaccgcaaacatgaagcaatgaagttaccgttcctttttccctgttgtttgctaagctaggaaaagctcaacatagcagaagcatgtggtttgtctaaattgtgtgaagcatgctttgcctgtgtgttagatccttgtattcaaaatcagatgtgcatcctgtaaacgacgcatgccattcatcttccctttgtgtttaagatcttgatgtacctagaatggctttgatttagtttgagttgcctagctacatttacttgctgaacggtgagctcctttgcatgttcatttgagactatttatcaagagctgatactcaaaccacatattggataaggccagatatggcaagatatggccttgatttgtttcacgcataaagtgtttttttcctcaccatatatttctttaatattgtgactttgtatttcagtatttttggcgatactagtttagtttagtagcggcaaatatttctttatttattttaggtgctctgctcatcctcgaagtatacataagatgagtggaggaagacagagaagagtgggttcagccagatgaatagaatgggttggaaagatttggcctgacagggtttagggaattttttccccggattacatggaaacaccactccactacacacgcaccattatattcgacaaagacctacagtaaaatggtacttcctctggcccaatttataaatttctgtgttcagctttaattatctgtcttatttaaaaaattttatgattagtatttttattgttattagatgataaaacatgaatagtattttatgcgtgacttaaatttttaattttttaaaaaaa

SEQ ID NO: 25207 - DNA, 13444 bp, Oryza sativa
agtgactcattagagtacggctccgtttggctaatgggttatacccattgggaaatggatataatatcctggtaggatgtggtggtagtttatacgaaggaaaattttatcccatatttggttggatggattggaaaaggaagtttctagaagaatgactaaaataccccttcaaactatgctaaatgagtaaacaaacagcacagctattagctataagttcaaatggtgagggtaattcaataatttttcctagtagtcaatccaccctcaaatcaagcaggattctatatcccactcccatccacacccaaacagtagaaatatgaaaaatggaaataacatccatttcccacactcctcatcccatttgccaaacagagcctacgagttcaggtcgatgtaaactctactcctagccattgcaaaagtgagttgtgacaaatgttaaatttcgtttagatgtatcttctgttacattagaccgttcgcaaaattctgacagcatagtacatgaagctaccggaaaaaaaataccaaattggtaccgcttgacatatgatatgcgcatgacaataccgatgtagcttgagcgcgaatgaacgcatagattcgacacagaacttgacaaaaacacaaaacaggacagttcaacaggcatccgtcacataaaaacgcaaacccaaatcatcagcgtgctcgaaacaaatgaattgtgcacagttcaaaacataaagatttatgaactttagcagttctgttagaagcttgctggtaccattcaggtaacattgacaaaaattgcaagtgctcccatgaagaaaatgcttttgcagcagaggaagaaaacagaaaattctaggcatgggaaaccccagtggcagaatgtacatcatactcattatttgaaatgcttccgcttaaatgctcaaaacattttaatgaaagtaagaaacagtggtccctcagttgacaacatcaaggaccagcttgcgtgacttcaggacggaccacctcatgcgacggtagtatgcggcttggagaagtgcaagtgacagtaggaagatccatttcactcccatctacatcaaattagagtagggtggtattaggaaatattgcgaattgaaagtatatagaaatggacaaaaggtgagctgattaccagtttcctctcttcatctcaggttcagctgcccatgacaagaacgaaacgacatccttgcccatctgtggtagaggatgacaacaatcatgcttagggccttaatgctaacccaacatgtcacaactttaagagcccaacaacgcattagaaacttacctgggcttcagtggcagagtaccatcttcatattcacagctccatctataagcatcttgggcatagctatggcaccaccaggaaagtagggattgtaatgcaaaccctcacggatctagaatacaaatcaaccagagagtttactaatgttgcacactgcagaaagcaaataacagaacacaaccagcttgaaaaattacagctagaaaaataacacttcgtgggacaggttaggtttttttcaaaatagagttcaacatcataattatgaacaaaaatagtgattatgtagtgaattccaaacaataactgacaacaaatgagaggctgaataattgtaaattaacagagaaaacactcaaacaacaatgggacaacacaacttgaagctgagcacctccaagttcaaccagtattgcaattacagagttacaacagtgtcaaatttgatgtcaatatcatgtgtctgtaaaatatgtatccctgtgacacaagtgattcaatccacatgcaagagcatctttattgtttgtaaaggaattaagggcgatacacatagcaagtagcaactgcaaatgcctaaggtataactgacagagaatgagatttacctgaacaccggcaggtggatcacggtaaccagtaagaagagcaaacacatagttctggccattgtgccttgcctgaacatacggagtcaaacagtaaattacaacttgaaggtggaagattaaacaatgcaacgccaatggcataaaatatcattaccttcgtgataagactgagatctggtgggtatgccccaccatttgcaaaacgggctgcttgctcatttggatatggttgtgggaaccggtcacttaacttaccaggacgtgtgaacatttcaccctcatcattaggaccatcaaccacctcaatctcagcagccatagcctttgtttcttcttcagtgtaggccacaccaaccaaatctcggtacgaaattaatgacatggaatggcaagaggcacacacttgtgtataaacttgatgtccacgccgaatactgatcatagaagtgttcaaatataagacaatgagtaaacagcaagaatagggtagtagtggttaaaaggattttcttgggagcaaaagaatattgtgattcttttcgctatcctactgggaaactaaattggtgaagtaggtttgaaggattggggtaaccaagagcatggatcaattaataataaccaaataccgtatgcaaagactctgaaatattgcaatgagctaaactctattttgtaaggaagttgaaaaaggatgactcacgatgcatggtcataagagctaagaatgccagcatgtggccagggatattcagctgctgccaaaccatgctcagcttcatctgcagaagctattgtagcaaagcttaaaagaccagaagcaccaactccaagaagagccaatgctctcagtccagcggaggattcttcatgctttatccggaacgaggatagcagagatgagccctgaaaacatgattataatgttttaaaaaaaagcaggtcaccacactaaaaaggagatgatcatgggtactgaaacttatggtgaacaaatggttactgtcagattataaactttgtcaaaattaggataagtagttgatatcatggtctaattactcaaccagaacagcaaaaataagcattgtatgcataatgcaggtttaactgtaaaaagtagaataaagatcaatcctgccaaacagaaacccctaaaaactgtgcagtagtaactagtaagaatgtgaactgtgatttctttccaaaaccccatctgatacatttcacgttatagtgatgtccggtaatacctttctacatgccatttcaataatcaattcaagattggtataccataacatttcatacaggcatcagacagaaaataaatattaaaaagattggtaagcgatcggtttttgacagaagtaatacaaaataaatagttcattaaaattcttactgaggactgattatggagtgttctccgtaggagctggttaatgccccgaccagcagccatccaggatactgcatcaaatattgaaaactgagatgtacaataaaagaggttatggcatcataattagtagaagcaactgtgcatatttcatttacagtatctaaccatccaagtggagtgaatttgagtaataaccaggaggattcaccgcaaatttacaccctccgtcccaaaaagaatcaacttatggagataaatctggacatgcatttgtctagatttgtccccagaagttggttttttctggaacggagggagtatatgtcagaaaatcaacccccaatgtcaaaattaaaacaactgaatggtatttttttattaactcatgaaaagaaataagcatacatttggtgccatgcattacaatctctgaaaaaaactgtttaaattgaccttactgcagaccttaacttactacatacttgctccttgaaagaagtatgtatgctatctcaccacaatgctctacctaaacaagttacacaggtcgaaaaagggaaccttgttattgcatagacaaagcatagatttgattgtctagctacaacccctagcccccttcttatatgcaaaccgtggaagaccgcgtaatagcaactaggccaatttatccatctatgtggttaacacaagaccattatatcaataacctaattagaggatagtgctgttactgcatttgcagaagacctaatgcatgcacgtaaaccatgacggcaacatcctatattgatgtgcctatagtgacatacctgacatatcgatatcatgtaaactaatttgctaaaagtaggatgaagatagtgaaagacatatggtgcaaaacttttatctaacacctcatctaggccataactcacaaattgcagtattctaatcagtgtgtttacaagaaaatatacaaaaagaagtgtaccagatacgccagtgacctaaaacatgatatcaaagaaacaagatgaaacttgcatcgcaaaaagtttagattagtataaatggagcattgcactattgtcgataaataagcacataccatgcgaaatcatctcaattgttaggtgccaactgtaaggcacattgaacataagtagccacaggaataaatcatctcaatttttcatgatgatgtagtgatatctcagccgtgcctaatctatctagcgaaaaagattacttggtacgtgacaagaaaaagggaaaaaaatgggtatgatccatgtggtacacgatgcgtgttcacgtactggaccatatgcccaaatccacagcactagtccgtccctcatccactaggggttccattgttctaacaacaagtaccaaggaaaccaaacagagcgggcagatctaggcggttcacaggcatcaaacaaactagtcaaaatggcatcccatcccatcccatcccatggcggatggtagatccgcgtgattctccaaagcacccatttgggggcagatctacacgttccaaacaaacaaacagaagaatcgaatcgacaggttccatccatccatccaacccacccaggtaacagatctgcgcatccctagcgctcgcctaacaaatcgatcgcagggacgaactcgcaaaagaaatcatgaggagaggggagaggccataccggaaggggaggaggtgggtgccctagccctagctcagcctcagctcggtcgtccgccttaccgggagggggaggaggaggaggaggacgaggaggcgagcacaagtggaggttcccaagagaagagaagagaagagaagaggagaagcggcgcaaagggcgaagagagcgggggccaaccctagcgctggaccctctctcctctgcctgggccagaactcctagcgcggcctggcctactacagagcctctaaggctcggtccacttacggaaaacaaaaaggaaataagtccaattcgtgtccctcaaatatagctccaatcctcaattgatgtcgtttgaaccataataccggatatctttgaaacccaaattattaaaaccggtgtaacttgactctctcaactgtgtttggagagtggtttcgttgacgtgacactttgacttatctacctcgatgagtcttctggtggagcccacatagacctttaaggagggctggttgttgaagttaccgttattgttgttgttgttgcctccttggtagaacgggcagggctggttccacccctggtcttctttgggatgatagccattgttccccatgaacatggcttcttcacgaatgtcggggcagtcgttccccgagtgtccagtgttcctgcagacctcacaagtgatgtgcgagtctagtgccttgacagcggcctacgggttgttcttctcctgatcatctagcttcttcatcaggaggtccagctttgcggccagcatttttgtctccttgacagtatgcatgccatgctgatgggtctggagatgttcttcactgcagctcatgttcgacactatcttctcgatgagatcaacggcccctttgaccgtctttgataagaaggcacccccagcagtaacgtccaagtgattccgggacgaaacagtaagtccgttgtaaaactctgtagaatgagccagttgtccatcccatggtgaggacaggcagctacatattcctgcagacgttgtaaaactcctggaagcttgatattctcctgcggagggcatttgtcttgcccatcaggaagaattttgagaggaacgcagtggagcacttgtcccatgtgttaactgcaacccgattcgtgtaaaaccactgcttcacttttcccaggagtgagaaagtgaacagacgcagcctaatggtgtccgggctgacacccttcatggtgtaggtgctgcagatctctaggaactgctgcaagtgagcacttgcgtcctcatttggcctgccacaaaataggcttgcatgcgccatagtaatcaggctgctcttgagatcgaagtcagtgtctccgaggttaacctgtggcccgacgggcacattgtcagcggacggagcagcgaactcacgaagtgtcttctcagccatattcctgaaacatggtgacgctgggatgactggtttcttagctgaaagtttcttctgcggagggacgacactcggtctgacgctctggaagaaagcttctggattttcgttgaagttttctggcaggtttaccagtcatgcactatcctgttttcataccctgttttcatgacacaaaggttagcctgcaacggacaatgatttatgcagaggtaattatatataaaagattattagcttatagtaatctctttactaatcttccctagaaacagcgctagaaatgctagttggtatttcttaacgacattactacaaatattcattcccagcaatggcgcatgaataatcctggtatatatgtatggtcaaagaagtaatccgcaagcgcacggatataccattgtagcatttcacccagaagtatacaatcatgtggctaataccccctaacagtgccctcctggtgtttcgagagaccatcctgggttaccgagttccttacgacaacctgtcatggccgtccaaccggggctaaatacatgagagtaccctccctaggaattagtcttaggaatatatactaacgtggaggaatacctgtattgagctgtcatcatcagtggtccacctctactgtcctgcagcatatatgcccagatagtgataattagtaatctaagcaccatgcttacattaataaatactactctacacctctggacatgatatagagcaaccgataaatcggacactaaacccatgccattgcacctctctggtaggctacccacacaattataccgacgcaaacataaagcaagagcaatactcagactaagcaaagtactgaaagtatataaagaagaatatttcattaatttcgaaagtcttatagatgaaagtagaaaagctgctagagccataccggaactcttccgaagactccgaggactccgagaactattctattctactccacttagcactaaaaatactaaactaaagtatgaagagaaatcttgagcttgcttgagtgtgttgagatagtgaatgaactcctcctgttatagggcagttatgatggttgtagctatgcgaattgtccattttcccccggaaccgtcattgggaatcaatttggagcgtccacgtggagggctgacctgagccgacgtagccagggtttggctgaacctgggctagcccagcaggtctccagcttcggcagggtgggtgacaggtgggtcctattggtggttgtggcagttaatgcggtttccaggatggttacacctgatttgtggaccctccttatccataagcttgcttaggagtgaggtttcttcactttctctttattttatttgctaaattcctgtaacaaataatactataagtacaagtggagatatgttattctaaaacaaatatgcattgtaagcatagctagttctcctttattatagttatattgacggtcgagattggtctataacgtccgtcaacagtgtataaaattaggggatcctaaacatggtatgctccatgagtggcttctcagcagaagggtgtctgtaggaagggaaatatgggtgttgttttttgttgccatacaacttcttcaaataaatgcccatccaaccaaaaagtgtataggccatggtctacttgcagcatgggaggggatgataagatttgtactagccaatatcaaagaatagtacaaagaacatagggcgggcggagccaacgaatttctccaccctagggccatccaggaagccatgaccaatacccccatgacgaaggactggacccaacccaacaacaacgaagcaacaaagccacaaagctataaaggcggctatgtaaatgcgtgaggactcaatgcccgaggaatctggcaacccctccatgcggttgtgaaaatgatcacaccaatcctgaagcgaaacttctccaccaacttcaagactcttcctaatgtccatatgtagcattaagctctttgggtacatcaagagagatggctctaactcactgtgaggtggaacgtactcttcaaaaagatcaccgtcaaggggcagtcctgagagtttgtatatatcgagtaatgtgatggtcctctcgccatgaggaaaaaggaagctgttggtgtgtggatcccatttttccagcagagatctcagcatacttggtgaatggtgatgtacagtacaaaccaagggagcaatagatagacccataaatgtaatctaccccctcttcgctaccacgcaaatgaagggaatgatgacgcaggactgctttaccccattccgcatatcctgaaggagctagaacaaattccaccttatggttttcccaacccaatccctcagatactatcctattccctaaggtggaagccttatcatctcaaggcaaaggggtgagagggtgaaaacagcggcccttgaaagcgtgaccagaagtcctgccacgagtgttacgcgaaaattcaccaccgatcaattctttatccacaatagtagggttccccaagtcacttgtttcaggttcatagggctgaagttgcgccattctaaaaagcggcaagttatgtgttgctcgagaagagccagcatctgtcatctacaaatgaaaaaaatatatcggaatatgtatataggtgcagcctaaatatacaatgaggaagaaaaggtattgttagacaagtttgacatgcaaatctaattaacaacccggattggctgcgtaacatatcacaaaatttccgggaaccccgattatacgagcaactcattctatacaaatgtggttaaagaaagttatatgtatctatcaacctgtaaaaaaaatgaatgactgaaagagggtgaagaaaatctctctgtaccttcctcttgccacacctaaatcaccaatcacccgctgaaattaagacttggtaggtttcgggcatgtgtgcatagggaagaaacccaaatggaattaattaatggaggaatgaaagccaacaataatagtaaaaaggaaacaaaaaaaaagatcgccagttcagtatgcaagatcaaatcaaggtcttacctttgatgctgtcattgatgaagtctctcctcaaatccttgcacagaagaggagaaagagggagaagactggagtagtagatgagttcaacgaacaagtgcctcactgcccctagccatagggaacgtggccaaataatcggagagatgctccttaattttctcaacaatctttcaaacaacgggcacatcgatagttgtgaggataaacttcacatgcatcatgtccctacgaatccaaaattatgtttcgagctccggatgcaaaaccaaaattttggcaagggggcatttgttgacactgattttggctcgtatcttaaataagatgtattaaattataaactaatatataatctcaaacataatgtaaaaaaataaataaacaaaaataggaataaacagtcaaaacagtcaaatgaataaataaaataaaatggcgaccaaaaatatatggccgcaatataaaaataaaatccgctcggtcagagtgaaatgatttccggcgcaaatagaaatgcgtatgcgcgtgccatataaaaataaattagcatcttggaaacacgttcaaaaaattaaaaaacgtgaacaaatattttttacgtgcttttcatcggaccgacgaacgctgatacttagctttctggtcgtgtgcacatatgaaattcgtgctataataaaagagatcgtataaatatattgagactacgattattcgctaagtacacacctggcctaaaacatatggccgtggaataggatttttcccactcacccaaaatagtcatgtcctaaatattttcaggaaaggtgtacgcaccatataaaatagttttagactacggtcatccaataaattaaaaagaaaaccaaaatatatgttcatacaacaaatgagaaaattatactcctaatttttgcgacgtgaaataaaaatgcatgtcacgtgcagaccgctataatgatgcggatatataaacacgcacgcgccaaataagagagggccagatgtcagtgagaggatacacgcgctctctctcactcaataaccaggcaattaaaaggctaactggagtaataaagattagaatgataacaataaatgggaaagcatgtaacgaccaggggcatgaccggtctgctcatgttcaccccactacctgcacgcacgttgccacattcatccagtcaaaatgaagggacccacatgtaagccaaagaaaggtgtatgctgttgagtccatttcccacgatctgcccacggatgcgcgcgggactctgttctaaaccacgaaaagctggttaaccccctagcggcaaaggaagttccaggggagattagcgtagaggctaggtgctgttcgtaggctttgcagaagcgctgcttgttgctaggcaatactgctgccgttccgctttgctcctatgccatctcgtcagcctctgcttcctcgctccactgtgctggaagatcagaggtgtttaaggtgggaatcatgctcctccttcgttattaggctcgttcattgtgtgcgagtcaaagaatctctcggttctcgttcttctgctcacgttgatgtattcttttgctatgttgttcggttcggctaatgagtacgaaccaggaagtcatcttcttgccatattcttaggcttgaccaccatgagtacaagccaaaggaatttttcgtcttttgttatgtccttcgtctcaaccaatgcatatgagacaagaaagttcgttttatttgatggcttttaacataatttcacacttttttctatggttcggccagatgagtatgggtctaggagtggcttctatgcacgttttttttcatgttatcctaccataccctctgatttggtctcgttagtggatacaagcctagacgagattctcgctctcaggttcggtcccctacgaatggatacaaatcacggatacaaacatgaaatttgcatacactactacaaaatcgatttttcatggcgttgactttttgttttctctagcggccataagtggaaaccgttagcgaaattttaacgagggatgaggcgttaaggaccgtcagcgaaaatggatcttcgctggcggctgggttaagagtaccgcttgtaaaaataggggactttttataagcggacctcttaagtgattttcgctggcggttactaaggacctccgacagcaaaaagtacatactcatagagagcagcgcttgcaaaaaaaaatcaaccgcgttattaaaaacccccacagcccacaacccaccacccaccgcatccctctcctctcccagtcgcctccctctcctcttctcccatacacggccgtctccctctcctctccggtattctcagaggtgaagggagcctgcagtggtaacaacgacggcgcgtggaggtggatccggcgatggggaggagcataggcgaagctcgtggtgcggaggcggatccaacgatggggagcagcgacgaagctcgtggtgcgccgacaacgcgagctgcggcgactcaggccacgggcggtggatctggcggcccggggagtcgcaggcggcggtgggtggtgaaggagaggggcggtcgtggtggagaggtggatctggcggcggggagcggcgtggtcggtggagccgtggtggggaggggtgcgggccgcggcaaaaagtggcggtctcctctcccagtcgcctccctctcctctcctcccatacacggccgtctccctctcctctcctctctagtcttctcaaaggcggtgaaagggtgcctgcagtggtaacggcgacggcggcacggaagctgatccggcaacgaggtgcagcgacgaagctcgtggtgcggcgacaacgtgagctgcggcgactcgggccatgggcggcggatctggcggcccggggagtcgcaggagccggtggccggtgaagaagaggggcggttgtggtggaaaggtggatctggcggcggggagcggcgtggtgggtcccatggcggggaggggtgcgggcggcggcgaagagtggcggtcgcggtggatccagcagcggctgccacacgacgacgacggccgggcctcgaaggttccagcggcttcctctaaccccctcccctctcccagatccaatgggtggcggtggtgctcggccggtgctcgatctggcggcagcgactccggcggcacccatatgtttgataatacaggcagagtaaaaattaaaataattcaaaagtaacatgaattcactgcacccatatgtttaatcgaagcaatatatatccctgcatcatatataaagtgcagtaaaaaatataatattaatgcatgcgtgttgtaggttcataagcctaaaaaaaatgacaaggttaaaacataaatatataaaaatttctgacaatatgttgataaaaagtatcaaatattaaagtgaacaaatactcgcacggttatgccttgtggtttagatcacattggtagtaatacatgtgagtattttaagaaaatcagccaagagtcatatacctgctgcatatattaaagacaaaatttgctacagaaaattaaaaaaacgtataattagctagtggacaaaaaaaactggtaattagttgctggacacctgccagattatgttattatatgtgaaggaattggagagagaaacagctgtgtaagtacgattttaccctttatttttttttccttatccttgttcttttctctctatctcattctttctctcttcttcaagtgagcccgagggcgacggcgcggcgaagtcatgctgggcgcctgggtcactctcacaatgagtttgttttatgttaaaattggcgaaactgcggctactgcagcaacacaggccccaatggcaagagcaagca

SEQ ID NO: 25208 - DNA, 9663 bp, Oryza sativa
  unsure (1)..(9663): unsure at all n locations
ccggccggatagggggagatgaggccggcgggagaggggggaggatacggctgcaccggcgggagagggggaagaggcgacggccgctctcgccagctgctggaaggaggtgatagagagagaagagagataagagagctaacatgtgggcccaagggcatttttgacatttcacatgatttctctctcctcttcaaccgaaaattattatttcaatcggcgtggtttccactgacaaattatcatgtttatggagtgttttcccccaaaagtgagtttgtgcagtgtcctagggctaaaaccacacattagtagtgttctgtagcaaaatttgccaaactaaaaaggaataaaaagagggagaggaaggggaaggtcttggcatcacacagtggtacatattgttcaattgtttagaatttcagcacattgcaaattcaaagtgtacagatttgtgattggaaattttgaaataaaatttgtgtaattgatgcgaaccctcgcattgagataatgttatgttgtacactatcatgcattgagattttttccccatattcttgttctatactaactcttgcggataatttacgggccacaccgactgcgagggagctgctccggcctggcgggcacagggcagctgcaacgagcagtccttccccgtcgaggaccctcccccttcgtgcggcgggaggtaagctgtggtgtcaaagccaccggtggtgtgcgcgacggtgggcgtggctgggacggtgtgcacggaggaaatcgcggtagcggacacccgtggtgcgtctcccctgcacgcactggtaccgtggctctggatgtgccgtgccgagctgccggccatcgacaacaccatcgaggaaggcggcggcgccaggagaaagccaagccgagagagccaaagggcaatatggtcttttctttttgtctctttctctgttttgtttgaaaagaataaaataatgtcttcagtgtcctcaagcatatgtttttttagagtgtcatagagccaattcacgtctttgtggtgtcctatagctaattacacgtttttttcgatgttattgttgacggtcattattgaccagtttcgaccgttaatattacccaatatataaagactaactatgcttacaatgcataatttccaaataaaatatctccttccactatatactatgctactaacatgtatccaggagaagcacatataaatggaggagaatcgacagcaaaataaatgatcaatcaattggatgctgtcgagaatcagacttgtggatagatgggctgacaacacggaattaccacgagcaaacaagcccacaattcacaccactggatcaaaggaccaatgttgacggtcgttagcgatcagtttcgaccatcaatactaccaaaataaaggagaactagttatacttgcaatgcatatttgtgttagaataataaatattccactagcactaggattactaacctcttgtagagaatgacataaaatggaggagaatcgatatcaaaacaggtgatcaatcaatcggacgatgttgagaatcagacttatcaacgaatgggccaagaactcagaaataacacgaccaattgggccaaaattcataagtctgcagaagggatcgagagaggaggccacctgccgaatttggaccaggccggcccagcccatggtttggccgaatcattgggttcagccgaacccaccgtggctccgttcgatgcagggtttggatgggcggtcaggattgctcccctatggcggttggagggtattactgacctttccaaccgtcataaccgtcattctcaagctatataaagccctctcatcctccatttcaagacacacctcaagcaagaagttcatttcatctctcaagtttagcatagtttctagagtataatggaatagaaatagaataaaatcttcagtcctcagagtcttcggaagaattcgtgtatggctctagtagcttttccttttttcttttttttatgacttgtactttatttagaatactcttctttatactactttggtattgtattactttccgagtatatgaataccaactttactatatgttcgagttatatttattatgatgctagcttatctgggagatgcaatggtgtgggtataataatcgtatttatgataactctatgtcatgacgatgatattagatagtatttggtaatttaagcgtagtgtttagattactagatatcattatttggggttatatgctgtggaagcgaggtgggccgctgatggtgacagctcagtatgggtattcctccacgaatgtatatagtcctaagatactttcctggggagggtactccaccgtatttagtcccggttgtatagtcatgacggattgtcgtaaggaactcgacaatcaggggtggcttctcgaagcaccagcagggcatcggatggagggtattagctaagtaatactataactaggatgtatatataatatgtatgtaaattagaagtataggaataggatctttctatattctttccacttagcttagataatcacgagtaagaggatgaatgcttctacttagtgttattgtaccctatgaattatattaacccctgcttagactttggttataaattattcgtacagtaatatataaattattagtactgttctctctattataatcttcccacgggattaaacaaatacgatacctttggaatactctcaggtgaaatgctacaatggtatattcatgcgcttgcggatgaactctgtaaccataatataccagaagtatttttgcgccattactgggaattaaatttctagtaatgtcgttaagaaataccaacaagcatttctggcaccattgccagggaagatttataaaagagattaccattactaatactttatatttacctctatataatcattgtactttgcaggctaaccatggttgttttcacttttattgtggaaacagggtagtacatgactggtttcaacttgccggaaaactctaaggaaaatccagaggctttctttcggagcgtaagccacgagtcgtcgctctgcagtaaactcttccgacatagaaaccagccataccagcgctaccaactttcaagactatggctgacaagaccctccgcgaatttgctgctccctctgctaacaacgtggccactgggccgcaaatcaacatgggagacgtggatttcgatctgaagtccagccttatcacaatggcgcaggctagcccgttttgcggcaagcctaatgaggatgccaatgctcatctgcaacagttcctggagatctgcaacacgttcacaatgaagggtgtcagtcctgacgccgtcaggctgcaattgtttccgttttccctccttgggaaagcgaaacaatggttttatgccaaccgtgccacgatcaacacctgggataaatgctctacgtcattcctgtcaaaattcttcccgatgggcaaaaccaacgcccttctggaaggatctcaagtttccagcagacgagggatgagtccattcctgaggcgtgggaacgacttcaggaatatatggccgcttgtcctcatcatgggatggacgactggctgatcttgtagaacttttagtatcatgacgagctgcgtgctcgagacatccgaccatgttttattggtcataattatccaactaaaatgcgacttaatggtgggttgtgggtgcatggttttgctagtcccacccatggcagttaaggaccggttcacaggatgcactggaagacttaccgcgcttaccacaagcgggaatgggtaactgtctgacttgaagtatagctttcctctctgacgcatccaggcaagggtgagcgtgatggagttcggatgggccctgcgacagtctatgcgcctttttgatttgcctaggcacgagaggggactgcccgctgcctgttgaggagtgggggtgaaacctgaggtgtggtgtgcttggtcagagagggttatatgaagggtcttgtcacaatcactcgacatggtgacgtgtccggacaggcgcggtgacatgccggtggattgtgtcttttgggtacagttgtgcacctctggccagagtaaaactattcgaatagccatgcccgcggttatgggcgatcgaccagattcatcgtgattagtcacacacttattaaatcgactcaatgcactgtagttcaggtgggttggttgggcctattcaacgtggtgtagcgttgatcagtggagatttaatattaccttaattaatcaactattttactgttttgctcaataaatgttttacaattgcctttatgcaaatagcctcaagccatccttgtatccccttgcacgcctgcatcattggtgtggcttgctgagtacggtggttgtactcagccttgctattattcccccttttcagaagtgtagtgcttctgagctaaagacggagttagaggaccaaggctcagaccccagttgagttttgcctgtggagtggagctgaagccctgctaggattgcctttttccgctgctgctgctttcgtttcgggtgtgaggactaagtgcctcttctgtaagtattttacgctttatttacgtttgaaaccgtatattacttgtcgttttgtttaccctgggtgattcttggacagagatttaatgcacaaaatagtctggaaatttgggctaaatttttgggcgtgacaaggtacaactacaactggtcttcgaccagtgacgtagcagtccacgtaccacgactttaagtgatcaagaacaactacacacatggtcttcatcttgtgtggtagtcacctcagcatcctatgagcatcaatgtcacaccctaaagttctcctcctaagcctaaaattgaatttataaatcatcctaagaaaatgccggtgcaaatcaagagaaaaccttaataaattaatgcaaataataatcggaattggcatgtggaatttttcttgagttctacatgtcgaaatacgctaacaagatttttagtggaattttcagagctctcgaaataattttaaccaattaaaattgagcacatgcaattttaaatcccagggaaaatcttttcctccttttctttttcttttccctccttttcctcttcttgggccggcggcccagtccaccccgccggcgcgcgcgccctccttcttgtgggccggcccaagccgcccctccctctctccccgggacgccgacaggtgggccccacctgtcggggtcgtccccttcctcggctgcccgccccacgtcgccaccaccaccgaaaccgccgctgtgccaacgtccccgcctcctccgggtcatgtcggccacgcccgcgcatgcgccgcgcctcccgcacccactccccctctctcccgctcgcgcccgcgcccgagatggcaaggattcgaattccgaatcccacctctctctccacctccacctccccgcgttggccggcggaatcccgcccctaccggccatgtccgggattcccctcccctatttaagctccaccgccactccctctctctttttccccatctcgccgaactccctcgtgcttcccatcgctcccgcgccgtgcttccacccgccgccgccgcttccgctactccggctgccgctagccgccgctaggctcgccgccgcaccacgccgtcgccgccgcccgtccgatcggcctcgggggcgatctgggccgtcggtccggtggaccggcagccttgagccgctgacccgggggccccacttgccggcgcccctctctccccttgagccgctgacatgcgggccccgcctgtcggcaccaccccccctttgatgacgtcagccctgggacatattgcgcaataaatgatttaaggactttttattatagtaataaacacagtgaatcttctaaaattcataactaattcatccgtgctccgtttaagcccattcaagtctcagtaaatcaagaaaaatgtgtagaatccattaaaaatggttttgttctctgtttcagtagtcttatagcctgtttgcattgtttgctttgtatgtcgcttagattccggttcttctgatgctccggtgtacttcgagatagtcgccgaggttcctccaactgcagagcaaggcaagttatgcctgtcacttgaacatgttgatcctatattgcaaatggtctattgtttttcttcaaatactgcattgttttataatgttactatgggatgtttacctattgttacagccatgctattttgataccatgctcctttgttagcttgcgttataacatgaatagactttggactaggaattgcttagccatgcttagttcaactagcacacattggggaaaaatcctattaatgtttagactgtaggttctaatggtaatgttggattagtgacaccgcttcagtgttggttaattaaaataaatcacatggtgggctgtgggtgcatggttttgttggtcgcacccatggcagttaaggaccggttcgcgggatgccctggaagaacttatcgtacttaccacaagccagcgtgggcaacggctggacttgtagtgtagcttttctttagccgacgcatccaggcaagggtgggcgtgatggagtttggatgggccctgctacggcctatgcagcttccggattcacctaggcacgagaggggactgcccgctgccttgtgaggagtgggagtgaaacctgaggtgtggtgtgcttggttagagggggttatgcgaagggtcctgttacggtctctttccggtatgtcgtggtggcatgtcggcgcacggaaacgtgtcgtggggctgtgtcttgtgggtacagttgtacacctctgatcagagtaaaactattcgaatagtcgtgcctgcggttatgggcggtcaaccagattcaccgtgattagtctcaccctagtttagtctaatgaaattggatactataggtggatggttgggcctgtcgcaacgtggtatagcgttggacagtggatgaataatatgattaattattacaactgtttaattctttcaacttctgtttataaatgctcgctttatgcaaatgaaccactctagctctcctttgataattccctgcatcatacccctattccggtatgacttgctgagtacagtgggtagtactcagtcttgctctattttccccaaccccagagtacaagtatgtgtcagatggtggtttctccgaggagtaggcttcgtccgtgccgtcgaggatgtctgtggagtggtgttcccgctgcagatcaagtcaaggcttagttcctgttatctttcgtttttccgctgcatttatgtaagacttttatgatgtttgtaagacgtggatctgaatgtcaacattgtcgtttgtgtaccccggccggtcctggacggggattttaatgatgcccaatcatgttgttacaaatgaaagaataatgtctatctatacataataaagtaacttcaaatgcagcacaatatatgcgcctaaactttgcagtactgattttgcagttcagttttctgtgagctttatgagatgttgaaaccgaattttgttttttgcccaaagaaaataatttagagaagttttgtttcaatcattattttggcctgagtttaccctgctaaatgtgtggaaaattatctcattaaaatctcatgtacatgtttatatatccaaatcaaactatttaatgctcagcagaccgtgaaagaggaaaattgggaaacatccattgctgattcactgatctattttaagctgcatttgtacatttactagcttttgataatacatggctgctatctcactttttcttgagttatctatcgtcgtttgttctcataatagtttaactcttacaggcttaaccattatctattgcatgtagtccaaggcataaagtaatgaaaataagattctcactgaaaaacatctgttacgctatataatacaataacaaattagttttattcaatgaattaccaagacaatgtttacaatacttttatttttatcaatgattatgagctttaatttgtgagtatatgtagatgtacattagcaatgaatgcatttttcttcaattgtatatatcaatgtgctttgcacgtgcacgttcactagtttttttaatatatgacgttgttgacttttagatatgatgtttggatattttttttaagaaaaacatataaatataatttattatcattaaagatattttaatcattacttatatttttcctaagacgagtatgaaatgttagataaagaaaaatcaataacaccatctatttattaatacggaaggagtagtatttttatttctttcccttatctgtttattaatttttccttggttttttactttccttcaatctatgatagctccagctcgtgcgatttgtcactatatctgtgaggttgtgagcctgtgatcgtgagaggctatttgggtagccagctagtttgatccagactttcagagggagatgagcggcgcaggaaacactccccaatttaggtgcgtttggttgctcgtatacttctagcctggttcatctcctttatccagactaagattggcctggttaaagatatacatatgcattgtttggttgtttgtattgaataaacctgcatatggttagatattgtttggttagttgtattaaagatactgtatgcgaaagatgtttggttggttggatcaaaaatacattctggattggagggtgagtttacctccatgggtattaaattgagttttaactaagtccaagatgaagttttcggaatattgagtatagtttcttcgtattggagaggataacaacatattacatgcagtgctactgacttcttggagatgcacaaatttcaatgacgaaaaaattcgccaaactaggaagtcccaaaaaattgtgccaaacattaaattacactattataaattaatcgtcgggattatccggtcaaccggatagaaaaagaaaagaaaaaaatgaaaaaaaaaaggaagagagaaatgcatcgccatctcgcaactgccgtcgccgctcgcctacatgacgctcgccactctccctttgagtcccgctgtttgccgccgccagcagagttcatggctgcggatccggtgccgtcgaagctgaagactcccggatctagcgtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25209 - DNA, 1185 bp, Oryza sativa
  unsure (1)..(1185): unsure at all n locations
aattatgttccttagatatatgcactgttttcttgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttttcaaaaaaaaccttcactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggaatgcatgctgattggtatgctggataaaaaagctcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataactngcactgtccacacattttcctagctgaagtgatgcaccacattaatttaatatagcttgcattgtcacatattttctagctgagtgatgcac

SEQ ID NO: 25210 - DNA, 621 bp, Oryza sativa
tagttgtatttttgttgatttaattttgagtagataatttggaatgcgatacatgctatgatctatgatttggtattttgctactttttacggaatttgtagcctgctagatgttcttacaaagatatgagaatcatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtgggtggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgtatactgaaatgttgcactatagcaagagtttgtatagtcagtcaacccccgtaccgcggtgtg

SEQ ID NO: 25211 - DNA, 1651 bp, Oryza sativa
aaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatacaaaagagaggccaccaccttcccaaagagacaacaattgatgttaggcacctgcaaaaaccccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggctttaacttcacttcacaggcaaaaactaactggggtctgagcctgggtctctaacttcgt

SEQ ID NO: 25212 - DNA, 6015 bp, Oryza sativa
  unsure (1)..(6015): unsure at all n locations
nnnnnnnnnnnnnnnnnnnnnnnnnnnnnnnnnnnnnnnnnnnnnnnnnnnnnnnagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctagggttgacaactaaaagaa

SEQ ID NO: 25213 - DNA, 1728 bp, Oryza sativa
ggcacagcggtttggatgagggaggctgaaggtagaggaagggtctgacaagcgggtcccacggccccacttgtcggcctgaggggaggaagaaggcgcgcaggaacgcaaagcagacttgggaagggaaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggttgcaggcaccgaagaccgcattcgtcgaggccacagcccgccgccggcaccacagagctgaccacgagccgctgatcggtgcaccgcagccgggaccagctacggtgcacaagctgtcgaggccaaagcctccaccgccggccgtaagggggtgggtgggtgg

SEQ ID NO: 25214 - DNA, 12162 bp, Oryza sativa
  unsure (1)..(12162): unsure at all n locations
gcacggaactctggtagcacactctggtgccggcgaggggagagagaggagcagaaagtgccggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccccggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtcccttcaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgcttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctcctctcctcccctccccctcccacagtggcttggtgctgcgatggttgcggcgacggctcgttgttgcgggacatggcgagctcccccctcccctcccctccccttcccttcctctccctctccctctcccagatctagccggaggggagggggtggcggcgaccacggcggtaacggaaggcaggcggtggtggatctgacaacgggtcggcggcatgagagcaaccgcgacgacgacgacccgtgaccggggcgacgacgacgacgatgctgcgcgccggccgggagcacggcttttagcgggttcttccctcccctccttctccctttccaagaggagaggtgnaagcggtggccgtagcggcgacgacaggtgggcggaggcggcggatctgaccgcggcggccataattattagaaccggaccggaccggcggtccggccaggaaaaaccgggaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaggacggtatagatcaaacggctcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatgacctttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaggcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcatgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtc

SEQ ID NO: 25215 - DNA, 11509 bp, Oryza sativa
aggcgaggcgagcgagcgtgcgcgtgtgtttcccctcttttttccaccacacatgcttcaagtgactaggagggcatcctcccttttaaggaggtccccctctcctagaataaagcaaggtggtactaaactccacatgcatgccatcccatgaggggggcttttgtgattttccaaagaattaatcttcgagtgggctaaggcccattcattaattccaacaatcccccaccaaatctcaaaatcccactgagatttgccttttccaatatactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcctagctccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtcctttttcgccgccggccgccgtagctcgccgtcgtcggtaaggtccaagccgccgccgcctcctctcgtcgccggccgtcgtcggacgtcgaatgtcgttgtggtgagtaccgttgggttcgcctcgtcgtcctctacgtgtgcatgccctccaaatccgcagccgggcgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggtgggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaagcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatccttt

SEQ ID NO: 25216 - DNA, 9421 bp, Oryza sativa
  unsure (1)..(9421): unsure at all n locations
gcnnnnnnnnnnnnnnnnnnnnnnnnnnnnnnnnnnnnnnnnnnnnnnnnnnnnnnntcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggatcggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttttttaaaaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcagatggagataaggaatggttcacgcgactcgaacaacgccagtggcagcgaagagccgatcaatggagcacgtgccaacggtgcatctgacaacagtccgtccccaccgcccgagaacccaacaattgctcaggtgttggacaatcagactcagataatgacaatgatgatgcaacagatgcagcaacagtaccatcaggtgatgcagcaggtgcagcagcaagcacagctgcagcagcagaacctgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccggctggggcagaggttacttggacagagtttcgtcatagtttcaataaagcacaggttcccgagggaattgtgggacaaaagaagagagagttccgttccctgcaacaaggaaccagaacagttatagagtatttgcatgagttcaaccgcctcgcgcgctacgcccctgaggacgtgcgtaccgatgccgagaagcaggagaagtttatgtctggtcttgatgatgaattgaccaaccagttgatctctagagactatgaggactttgagaagcttgtggacaaggctattcgtcaagaggagcagtgtaacaaaatgaaccgtaagaggaaggcagcccagttcaggactccccaggggaagtgtcagaagcctcgttacacgatgggacgtcacggtggaccttccaccatgattatccgacagcaccgtccctaccacccgggtagcttcaataagacccaccatagtgatagtcacaacaacagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattccttcatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttggtaactggaactgcaccgatccacaagaggccttacagaatgggagccagcgagttggcggaagtcaagaagcaagtcgatgaacagttatagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcaatattccattcatcccggcagtaccaaaatgtaccaagaactcaaagaaaagttctggtgggtcagcatgagaagggaaatagctgaattcgtagcactctgtgacgtctgtcaacgagtaaaggcagaacaccaaaggccagcaggattgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcaaatcaaaatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttcccccctttgcttgctttaaaaattggctaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttcctttttcctcctttttcctcttcttgggccgtcggcccagtccacccgtcgcccgcgctcggcctccccttgtgggccggcccgttcccctttcccctccccgaagttctccctccctccctctctccttcgggcgccgacaggtggggcccacctgtcggtcgtcttcctcctctagccggttggagccgagccccaaccgccggggccccaccttcccacgccggcccgctttttccgtccctttccgcgcccgcacctcgcgcccacgttggcgctctccccccccccccacattttccgcgcgcgcgcgcccgcaagtggtgggggatttgaatccctctctctctctctcttcctccccactcccccacatcgccggccaaatcggccacctccccggccacgtccgccccctcccgcacctataaatcgctccccgcgtcttcctctctcgtttttcgcactcgccgcgccctcccgtgcttcctatcgtcgccgcgccgctcgccccttgcgccgccgcctaccgccgtctccggccacgcgccgccgccactatagccaccgccgcgccacgcagtcgccgccgtcgcgctcaccgagcccgcccgcacctcggccgccgcttcattgccgcgaatcaccgccggagcccttttctcctcgcgcgccggtgagaccctctctcccctccgtctccggccggcaattcaagccgccatggtcgccttcccttccctaacccctctatgctctctcctagggtgccgccgccgcccgttcgcgcctcggcatcaccggtcgtcgccgccgttttcttccttcgcgccggccgccgtgttcgccggtgaggaatcccctctcctcctccttccttccctccctcccatgagcgccgccgccctccgcgcgtgtgccgtcatcttcggccgccgccgccgccttcgcactggccgccgccgtctcccgcgccgccggtcaccgccggtgaccgcgcgtgtcgccgccggtcgccatggccgccggtcggctttgaggccgagccgagcccggccggcgcctccctcgcctcccctttgagccaccgcctggtggggcccacctgccagccgccccctccctctccccttgtgccgctgccagtggggcccgcatgtcgggccgcccccccccccccttggatgacgtcagccctggggcaatattgcgcaataattaattaaggacttttctttattagtaaaaacacagtttatcttctaaaattcataagtaattcatccgagctccgtttaagtccattcaagtctcagtaaatcaagaaaaatgcaaagaatccattaaaaatagttttgtttcctgcttcagtagtcttatagcctgttttgcttgtgtgctttgtttgtcgcgtagatttcggccgtttcgtcgatccgcagtttctcgaagacgttgctgtgatctcatcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatnnnnnnnnnnnnnnnnnnnnnnnnnnnnnnnnnnnnnnntttgtgggtaccagtggacacccttggccagagtaaaactatttgaaaagccgtgccc

SEQ ID NO: 25217 - DNA, 735 bp, Oryza sativa
  unsure (1)..(735): unsure at all n locations
nnnnnnnnnnnnnnnnnnnnnnnnnnnnnnnnnnnnnnnnnnnnnnnnnnnnnnncaatgcactgtagtacaggtgggttggttgggcctgttcaacgtggtgtagcgttgatcagtggagatctaatttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgagctgaagacgaagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaacggtcaaaccctaaggacaagctttctgaaaaccctatttgaaaaatgtctcctctcgcccttcggcatttctttgtcaaacggtttttcaaaattctcctcccaatct

SEQ ID NO: 25218 - DNA, 806 bp, Oryza sativa
  unsure (1)..(806): unsure at all n locations
gttgatcatgagcagggttcatttggcgttgggcccccttgcagctttcaattaaaccattgatctgtggctttaattgatcttatctctgacactgaccatttgctgctaggacgaaagagaggtgaaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaannnnnnnnnnnnnnnnnnnnnnnnnnnnnnnnnnnnnnnnnnnnnnnnnnnnnnnn

SEQ ID NO: 25219 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnncgaaattggaaaggatttccatataaaattttggggatttcttggggaaaaggaagaggagaataagaggaatatttcccctcaactaatttggaaagaggagcaacgaggaggccggatttggtggaagaaggcggcactgtgcacaggctcggctggctcgggctctgtccagagctggaagatgaacagtgccagggaggcaaactagacttttttcggttggctgagaacagaacagagcacttgacttgggccggcttgggctgcacagcacgcgcgcaagggagagagaagaggaaggaatgggccgaaaatggcccaagcggaggaggaggatttttattactttcccaattaaaataatcacttaaatgatctttgaattgttaaaaatacttccaatgctcaaataatttcaagaaaaatcatgaaaatacttggacactcaaagtatttaacaatattaaaaccagaccatttaatgattaatttaatatgtggattattactgaaatgttctttgtatgattaaaaattaggaattgagctccgaaaaatttgagaagatttcagagagttgacttaatcatggagaatttaataaaaattaaatccatccatgctttatattagggaaaatttatttcccacatttaacttcacttggaaattaaagaacatttaatataaattctattaataatttattaaaaaatttataa

SEQ ID NO: 25220 - DNA, 746 bp, Oryza sativa
ttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaagctaaaggtacaagt

SEQ ID NO: 25221 - DNA, 513 bp, Oryza sativa
acttgcaccccctccacgacgaaaataatatgtcacaaattcttctcaacgtaatgataagaatgagatttgtttagatccaaattttctacggtacgaactaactttaatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatagtcttcaatgacatatcctcaaactcaacatgtccaccaacataaggttccaccactctaccaccatagtaaacacgaacaagtctatccatctacaccaaaaaatcaaatgtaactttgcaacaaaaattaaatcttcatttttaaacgtagtccaaaccgacatattataaccaatgcataact

SEQ ID NO: 25222 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnattatccccagacatcaacatgacaaaacagttgttggctgtgtacacccccaaggtgtaaaggccgggttaatataatcctttatcttaacaaaagaacatgacaaaacagaggattttaatcaggcggccactgttatacagtagcttgcgagttgttgtctatgaaaacgagacgtaggtacgtccaaacttaaaagaggccgagacagtgagacataagtaaaataggcgaagttggtaatgtcttctgtttgagcaatactctcacatcactgtatcacaaaataaattcattttttatctattctatacataccaatagaaaaaaagaactataatattctcactttatcaaattgtaatagaattattctatactctagctatctgtttccaatgtgtttataaatttattttagaataaataggaagagaaaaaaaataatctttttttttctgagatactatagtagacatgaacgtgagctcagcttcagtggtcacaactcacaacctgcaacgacgtaaaagccacggagaaagcaacaaatctacctctgaatcgtcgaaatacggaaccataaacacatgtttggcatatagagttaatgtaacctcgtacaactgcagcacaagtggccaggctccattacttcatcggggtattatacggtgggtaatttcttcacct

SEQ ID NO: 25223 - DNA, 713 bp, Oryza sativa
  unsure (1)..(713): unsure at all n locations
nnnnnnnnnnnnnnnnnnnnnnnnnnnnnnnnnnnnnnnnnnnnnnnnnnnnnnnnnttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacaccttggccagagtaaaactattcgaatagccgtgcccgcggttatgggcgatcaaccagattcaccgtgattagtctcacccctaggttagcttaatgaactggtgtagttcaagtggttggttgggcctgttgcaacgtggtgtaccgttggacaccgtttggttaatattgaataattactaca

SEQ ID NO: 25224 - DNA, 1622 bp, Oryza sativa
cctcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaagcggcccaagtgcgcgcgtgctgaagggaaggagagaaagggccggtggacagggctcaccgtgcgcggtcccgggtgggacccgcttgtcagcggctcggctcaccgtgcggagggagcactcggcgcacgcgcgcgggcgggggaggaacgtggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggctggcgggaggtagacgacgacgccggccggaacggacggcggacaacagcggcgagcggcggagcgaaccacggcgataccggcgaaagcgagcacgccgggtggttgcacgagacgaggggagacgagccaacggctcggattcgccggaggaagcttgacggcggcgaatcgcggcggcgacaaccggcggggagggaagagggaaacggcgacgaggccacgaggggccgattcccggcggtgagagcatccacgcggccacgggaatccgatgctagcgtcggattgggcggagctacgccgatcgaggctggcgacgtgcgggtgctacggagctcgagcggcgacggtggcgagcacacggcgagcgacggcaatggttggggcggcgccggctagctacggggagtctactcgtgctaccaccgaagactaaggggggagatggagcgaggaggaagaacggagaggggcactaccgtgcgggtcggggcgctgtgacgagaggccgatggcgcgggagtaatctctccggcctcgggc

SEQ ID NO: 25225 - DNA, 686 bp, Oryza sativa
acatatttcatccagccagattatgatttaggcattgggtcttgtaatgatcaggtcgtggactaaatcaaagagataaacgccttaagtctaaccatatagcgtccctaatcatatttattcagtagtcattatcgtttagagttgggttttgctaagttatttctgtcatcgtagtttcgtcgctagttcagtttgtgcaaccccaacttcgaatgcttaatcataatatgctaattcagttgttgtctaccttgttttttattgtgttcatcgattcgcatgcagggattaaccttcttggtgagattaaccgggcagcgcacggtttataacatgaggagacggttgcctggttgataacctgagtaaacgtggtgttgcgattgcaggattcagattgtgtcaatcggaaaccggatcatgtctctcaagtttccaccaaagcgagagctatcagtacctatcaaatcatatgacctagttgctctcatcagacggtccaaggatctgtttgatttggtgccaaatttttacctatgtgttaaaatctttacaagttttaacattatcaaatttaattcagtatagagactagtgtggataaaagtgggtaccagatcaaatatttactttatactataaaattcatcaccatttaatatgataaaaataaaaaataattt

SEQ ID NO: 25226 - DNA, 687 bp, Oryza sativa
ccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaccagcaagaaagacaaaaacgtaattagatgaacgatagccaatcggccgatagggccgatgacttattgtcaggaccaaccgatacgggtaaacctaattggctgtggctttatgatagtcaattagagccaaaaccataaatatgccctattggttgtagga

SEQ ID NO: 25227 - DNA, 1991 bp, Oryza sativa
ctgcccgagtggatcgcaagttgtattgcgtgggttgcgtcccctgaggcgcgtcgggaagctgtgacatgtctatctcctcggcatctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatgtaagtaactttgacaaatgcaagaaaacttacgactttgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctgttcttcattcatcaatgtatctattatgctctaacccccaatctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcatcaaccggccaatcttgtttcttcccgaactgtcgcatgacaccgtgcggaaggtggtactcaactgccccaaaacaaatcaatgggcactggtacatgaaatagtcagagtctcgattgcacatctagttcacggtcaagcttgaaacctcatttgtgtggtatggtaaccactcaatctgcaaaagttgaagagatgtccttggttagtatctcaattaaagaagtaaatgtctaactagaagtgatattggaagtactaacatgttgaggcttgaagcagtccatctcattgacataatgcttgtatcccacatcccggtgagcatgtgcagtgccagtactctcaaaaaggtaggccactgttttctccatgtctggctcattgtagggccaaggagtgaagctttgcctccacttaggctttccatccggtagtcttaaccacatccacatctgaatcaatagcacacaaccactcatgttggatgatggtgcctgacgacaacaggcctcacagagctgtctatatgtccacactaacactgctgacccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcttgcccgtcacggcatgcccccgtaatgggagggccaaaatcatagccacatcctgtagagtgatggtcatctcaccaccggggaggtggaagctgtgtgtc

SEQ ID NO: 25228 - DNA, 800 bp, Oryza sativa
  unsure (1)..(800): unsure at all n locations
nnnnnnnnnnnnnnnnnnnnnnnnnnnnnnnnnnnnnnnnnnnnnnnnnnnnnnnnnnattttttttctatatagccctttaaattaaaggaattgatcctataaaatcctatgaaattcctatggattatctttttccatacaagttttgcaagttttggaggaaatttgacatgagatagaacctcatggaaagaatcctttgagtctttatttctcctcaaattcctatgtttttcctgcggcccaatcaaacagtcatttctatgtctttcctgtgttttgcaatcctctataaaaccagttaccactagctttaccaccagtggccgcacctttcactctgcttgatctcttcgtcgatctcctccattgttcgttggtctccacgcgcgcgatctggaattacaaacttgtagtgccgatggttgcggcgccgtcgatgatcgctgccgtggccgtgggcgtcgggtcgaccgccttcttgtacttgctgtggccggcctcggcgccggcggcggcgatgatatgatgaaggcgccgggcgccgccggctacgtcatctcccgcgcggcgttcctggcgaacccgcaggtctacttccacctcctgcgcacggtgggcgctgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgca

SEQ ID NO: 25229 - DNA, 490 bp, Oryza sativa
tacagtattctattgccataagggatgtcacactactattcttgctgtgtatgtggatgatatgattatcacatgggatgattctatagagatagcaagattgaaagaaaatctaagtaaggaatttgaagtcaaggatttgggtcagtaggcatcgagattgcaagatcccctagagggatagtactttcacaacgaaagtatgcattgaatctgctcagtgacacaggtatgcttagttgtcgaccggcctctacaccaattgagcaaaatcttaagctttgtgctgagtcgggagatccagtgaataaggagagatatcaaagacttgtagggcggctgatatatttatgtcacacaaggccggatataacttatgcagtaagtgtgggaagtcgatacatgcatgaccctagaagtggtcacatggatgccgtgtataggatcttgagatatttgaaaggtagtcctggcaaaggcttgtggttta

SEQ ID NO: 25230 - DNA, 25604 bp, Oryza sativa
aatacttgcatgaagctatggtgtgacaataagtcagctatcaatattgccaacaatcctgttcaacatgatcgaacaaaacatatagagatagatcgtttctttataaaggaaaaactagatgagggaatgttgaagctagactttgtaatatctggagaacaaatagcggattgtctaacaaagggctttaggtgttgcagagtgtttgtctatgtgtaacaagatgggcatgatagatatctatcgcccatcttgagggggagtgttgggctgtaaatgtagaagtatgtctatctaggcccaagaggcacatatatccatatgtacatgtatatgttcagttgatagagtaatgaaaaagaagtgaagcttccagagaaaacaaacacaaaaaacttcaaaatatactcctagacaagttgagaatttatcctagaggatgctaattgataagattcgcaagagtacgagttgtactatatgcaaaatcaataaagcaaccacaagtattactactccatccgttctattttaagtgcaatcataagtttagttttcgtgtccaactttaattgtccgtcttatttaaatttttttaataattagtattttgttgttatgagataataaaacatgaatattactttacatgtgacttatgtttttattttttaaaaaaattaaataagacgaacggtcaaaatcatgcacggaaaatcatgaccgcacttaaaatggaacagagggagtacaaagtaaagccatttgttcagaggaaaatatgtaaaatctgtcattcagaaaagatcgaatactagtactgtgctcttcccgactcacatccttctttttccgcgacgtacgctatttaaattgctaaaaagtatttttctaaaaaaagtttctatatcaaagttgttttaaaaattcatattaattaaaattttaagtttttttggctaatatttgatcaatcacgtgttaataaacaacattgtttccgtgcgttaatgaactccacctcgggaactcagccttagcattaacctgctatggaacaatactccctccgtcccataaaaagagcattcttagcatcccaatgcaaatttagtgaggagtaaagacaactaaaatgtcccttattatttaaaaaaaaatagtaatgatgatagatatgtaaacggtatttaagggataaaacttctcgttttacgtgctgaaaataggcaggacagtagaagttgattttttttgacaaaatttaaacttcagaaattgagttttttttaagatggagtatatgagaagagattttttttccttgagattcggacaagatgacagtgatacagtttgaaacagagctgacaaacctcttccctttcagttaagggtttaaggcatctgacatcagatttcagataaccacttccctttcagtcaagggtttaaggcatctgacatcagatttcagataaccaggaagcgttttgattctcctctctaaaaaaaaagttctgaatcctactcttttaatccttgaaaaggcggtggcgctgttcgttttcttacatctgaagaacagatgaaaggaaatcacagcaggtgagacaagttaaaccacatctccgtcgattgcatacagagcacaacgacgagaggaaacatacacggctctacaatctcggaccaaggactactcatcgatcagagagaaaaaaaaatgcagcagatatgcaaagatcgttacaagacagatatagaacagagaagctcaaggcgtcattaaccctatgaagctttgacaagatacattacattaatatatattggctatgccgaatgccgatatatcaatatcgctggaagatggattgcacaacagtggctgccttagttggaagaaacatgttgatgttggccattgagtggagtgacgtttgagatcaacagatgccttcatgtgtgacttgtccggagcatccatggcggaagcttgctgttgcctgcttgtgccggagacggttgagcttctgactcccctgatcctcttggttggctttgactgaattaagatgaggaaaaacagcataactaaaacagacaatggagttgatgaaatagtagtaacatgctagatcattcctaacgtcaagttattgttcagacatgatatatcaagctgagaccaaaccatttggaggctttttcactgtttggttcaggcgctttcaggcctgggcttatttgttccaaacttccaatagccatatgaaatagaccggcagcatttgattgaacaaatttcaccggattaagtttcctaggcatagaccatcaaaaactactgaactgtgatagataatggaagtctgataaaagaaaaaatatagaataaaaatttgctgaagaacaaaacagagttttgttttatttatggtgagtgcaggggcaaaatatatggaagtaaaagcggtacctgttatttgttgtcgggatgggatctggagccgtcactggtgttggtgatgatgtgcttggtgttgctccattttgctcctcccggttagtgtttattatagcattgtttttctccttttctgtctccatgagctgctccgaagaatgtagacaaaagggtttgacctccaatacagcttttgtagtgatctgatataaaacattgttgtaaacaagaatgaaatttaccttttgcagaacattattctggtttttaagtgacttttcctgcagacaggaagatagcagattgtaagaatattcatcagcacgaacctatatcaacttcgtccatttctcagcacaatattaacatggctctgttgccacttgccagatcagatacagtaacaatcagtagtgcaggtccttttttttccctatgtttatgcatacattattgcgtaaaaggctaacggtcaagtccttgccatatgcatcgaagatttattttcccgtagaatgttcaattttacaacgtagtctgacttagtctgttctctctcccctagaatatatacattgatggcgactttcctgttatacccatttgacaacattgtgcatttcccacaatatgaccaagacaagtggcttctcgttagttccttaggtgattcaaattgactaatgatttcttcttataatggaatttctagaattgccaaaagacatgttttacatgaatatattctggtagaaggcaagaagagttagttgtctgaaaattgtttgaatgcaactttaatactccaaaacaatatggtataaacagactgctacattgctatttaaggagccacattgagggtaacctaccttcttctgaagctcagaaattgattcaaacagaagctgattctgcaaaagaaaaacaaaaaggaaagtaatgatgttttcaaagattagttggaaataattaaatcaagcaaatttgatccctcagtcaacagtgcataatggacacaaatttcaccttttttgatcttatatgcttcagagaatattccagttgatgttccaattgctggagttcttttattgttagtgtgtccaattgttcacctaagagttgccttgagcagtagatagaccaactcaagttagcataatcttgttaccaaagtgaaaatttcttaagaaagtttgcagtacctttggctcttctgaagtgcatccagtttggacttcaaaattccatattcatcaccccagttttcctaggagaaaatgaatatcaagatcagataactaaccagctagttaaataaacagccggagatagttctccaacagtcagggatgtttttttacctggtcctcagtatttggctccagtacggctctttcatcaaacgagtaacgctggtagcgttcaaggatcccttccatactacagaagaagtatcacatgattatgctttggtttgaccaatgcatcaaaagatgatgccaagcatagtcttagagcaatatcaaacaaatgcacagttataatttttgtaccctcaataattcttaaggcttgtcaggtgacaactacaaaagtaggatccattattcaaattatccatgtataaatttaaatcataactgctacaaaaattatgcatcagaaatagcactttgaaaaacatttgtatttgttggctgaaactttatccattcatgttcttcgtcgtaagtttatatctaattagaatgattaaaaaaaggattatctggccttaataacattagtacatatggtgaatccacattactcccttcgttaacaaataaaagtcgttttgaaatgtgtaatcaaatctcaacatcaactcactggagaatggattctaaactctcaagggaacatcccctcgttttttgcatgtcatctaaatggttatgatttttttaaaaaaaaatcgacaagatagattaatatgtgatagattacttcacaaacatgcaagttcaaattcaacttctacaagttacaacaaaaaaaaattaaactatggctagttaatgtatattcacggtcaaatttaattttttcattgcaacttgtagaatttgaatttgtccttgcatgtttgtggagtgatttatcacatattaatctatcttgtttattttttttcaatttttttcacaaccgtttggataacatgcagataatgaggggatgtcccctcgagagtttagaatagttcccaactcggtgtataaaaataacattcatagattcataattgaataatgtagttatattttaactattttatgagtagatgatcatacaaagaaagatgtgtgttagggataatgtcaatatcctagacaagaaataaaaaaaggaacagaaggagtatttggtagcatagaagtagcttgaccttaatactaacacaataatgagagagtattgttgcctatccaaaaattttgcaaatttgaaattatatttatcacaaaaggcatcatttaggtcccttttttcccttacgagctactgatattatgctccctccatttcataatacttggtgattttaagttcgcattgttttagtttggccattccaattttataaataaacttttagtattagattatgtaacatattattaaagtatgttacatggtaatggtaaatatagagatataaatcccatccatcataatcataaattttaaaagatattaatggttaaactgaagcaatcaccggtcaaaattgccaaatattatgaaataatagagtataggaataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgcatggcagcagcagcagcagcatgccagcatcacatagagagctgtaatccaggggacacaagcaacctacaactagctagacttcgcgagcaactccatcccgagctaagcagcaatcgcacgaacgaacacgtacaaagccatgaaccgtatgtgcaatcagagagcacatgagagaaatcaatcagcacgaaataatagcaatcgtacacgcaccaacaccaccagccccctcgcattccgcagcggaaacgatcgaacacaaggcaggaacccgtacgaaacgaaatcgaacgcatcaacaagccgcccaggaacggggagctccgcgagctcgcccatggcgcgcgcgcggcgaggaaaggcgacgggcatgggccgtactacgtaggtaggcgggaggtcgcgcagaggaggagaaggaggaggaggagctaagcgcgtgcgtacctggagtggctggagaactcgtagagcttgcccttggtggagaagacgatgagcgcgacgtcggcgtcacagagcacggagatctcgtgcgccttcttcagcagcccgttcctccgcttggagaaggtcacctgcctgtttatcttgttctcgatccgccgcagctgcaccggccctctccccatcgtcgtcggcggcggcggcggcggcgaagccggcggtggcggtggcgggtggagggtgaaaagctcggggaagatggaaatggggggaggaagagagaggaagggggagggaaggcggttttagatgggggtggaatgcggtgtggccataccagggcggtttcgagtgcctcgttgtcgatttccgattggccgaggcggtttcggggcggcgtggagggatcccggccgtcggatcaggagagaggtcgttaccgcggccctggcccggtggggcccacgggccacgcggcgcgcgcgaacccgtgcacccgcgggctcgcgctcgggattggtcggtgggtcggatggggcccgcttgtctgtgactgcgggtgcggtgggctcgcgtgagggatgggtttttctttttccacaacgtaggggggtgtcgggtacaaggaaacgagacgccggatgacacgtggcgagcccacgtgtggtcgtcgaagcgggcgggtggggcccacctgccagtacaggtttttcttttattttatttttttctttttagaaattccgatacgatacgagtatttctgtttgtactactcaactccgtatagccgccaaactgtttggcaccgagtactacctagtagtacaatacacgtactgggagtaccagcgtttgtttgttggtgttgaaagatttttttttcttttttttaagagagttcgtgttgcaacaatagaaggagcggacaacaagaccgtagaaaaaggctagactttttttttttaagatactccctccggtttcattttaattgacgctttggacaatgacacgctctacaagatataccttggatcttatttttctattataatatatacaataaataaatacatgtttacttttattacagtgttttgaaagacaaatctatatatgtttttctagtttctttaaactaaatatttttaaagttattgatggtcaaagttataaaagtttaaccttaaccttgtctaaaacattaattaatatagaaccaaagggagtaatagattaactggtctccacagcccaagaaaaatgaactaccttgtggctttgtattgctatgctaccgtggttgattgcaaaattgcagataggtaaatgacctttggctacacacaggggcggagctaccatgattcctgggtattcccgggaatacccaacttttttatcaaaaaacaagtatacttttagtatatacacatgtacacatattagtgcacctaaatcctcaattcttcgatccaaacacagtccaactggcctcttgcaacgcctcctaccaacccgacccactccgtcatgacccatcagacatcagctgacccacttagccaccactcttccatacggccccctctccctctccctccgtgacccatccctccctagctcggttccctcgcgccgctccccatttccaaaccccaggtggcggcgcggcgaggcggcaaccggcggcggaagctggaccgtgctaccgcggaggggtggcgcccgccactccgccaagctcaggcggtcaggccgattgggtggccggtggccgcgaggggcaggggcagctagcggctcagcgcttagacggaaatacccaactttaaaatcctggctccgccactggctacacaaacgaatgttagccatgtctaaaaggattaccatgttaaattcatgttgaaatatttttttaaagataatggaaaataatcatggcctttaacaaacaagcgatggagccatttcaacgaaaaatatgtataaattagagcaacctttgataaacaaactatgaaaatatacatattggtttgctctcaccttccttttgttttggattatactcctctatcccaaaaataaatcaaactccagagatcaatctggacacatgtgtatccagatttttatttttattttttttgtgaggggggagggggggctacggagtgagtacacgaaagacgcgtgggcatgcagaccacactcccacatccatgaatacctcccactcccaatgctcacacacccacaaatgtgcctctcactcgcaaaccagaagcacatccctggtcccactataatgttattgaaagtacatccgtgtgtgtggaatgtttattggaaccagaatttgaaccatattagctatttctgaagtcacgtacccacgacttcaccaccacacagacgatgttttcccactactgtttgtattttccttagatcttgtgcaaaggttgcatcttgcatgagatctaggcgatttatcatctctccccttgcatatatcctccaccttatcattcaatgttacaagcaacgtggaaagattcaaggtgttttatgacatggtaggctatctcatggataaaagttatcgggactatcacttaagatgatgtggtaggagtaaaaaacaatagcgatgtcttcacacatgcagctagcatgaaaaaaatagagtaaatataatggcaccaaacgcatatacttgattagcatacttaggggtgaaaacaagtcgggccgagctaggctctgctgaaattagcatcacaagctaaaagagtagctcggcttggctcaacttcttcttgacctctagttggctcgtgagcctatgaacaaaaaatactttcagagatgaagaggagtgagaggatattggaggagccgacgagaagagtggcaactaggagtcgagaccaacaaggcgcgcgacaggtcattgggcaccagccgcaccaactttgcgagaggtgagtggcaactcgcacattgtgcttgttagcacaagctagcgacaccaaggagcagcgactttctatagtttggtcaagcagagaggcaacacgacgagttggtggaggctagagatgccttcaattggtggagtcgacatgcctacgtgcagcctcaagtatgacatgtgttgaaccgaagaaagcagtgttgtgggtaggagcatggctgagatagggaataggagacagggtgcgaggaaaggttgggaacttcggctttctttaactagattgaccactagactaataatgtgctatgagttaaatgagtgggctcgccagctagcttgggctatactcattctcgaaacgtgttgtcttatgagtgaaaccaagccatgtgagactaaatggagctcacaagttcgagatctttgtccacctctcacacaaaaactgatgagtagttgtattagtatgtgctttctgttgaaatgaaaaatgtataaggtgaattagtttgagttcttttcagcaataatgacaattttcttattttccgttatcatactttccaaatagttaaacattgtgttttgtgaaaaaaaaatatttacatattttttaaaaaaaatcaaagaactctactttttaagtttataatggctaataatcatgctctaatggttgttctagttatacgagaacatgcaacctgccttctcaaacgaagccttactcactactaaaaaatggtttttctgtcggccaaaatcagtctttgatttttgccagccttactcactactaaaaaatggttttttctgtcggccaaaatcagtctttgctgatttttgctggcagttaggttaaccgcctgaaaccaaagggtagagaaaataaacgttttcacattcggaacttaaccgccagccaaaaaacatattttcgttggcggttctgttacatgggctgctggcaacagtccatttttgcttacgtagtgttaagacgaccgccagcgaagctcttttttggttaaaaaaattgaaaatatgttaatgcatctgttctctgaccaccagcaaagaaaattaaagaaaaattgaaaattgccagatacaacaaccctgcattcccattccacattgcaaatcaaatccaagaacatgccacaaatacaagcacaaattccacaaaatataagcaaatctcaactattgaacatgcacaatcgccgatgctagatctgccctcccgatgcacgctgcacatggtcttgggcctcgccaatgaccggcttgcggcggcctcctcctcctcgcggtcactgccaccatcgaggtcgtcgtctcctccttgcccttgtcatccccgcacagatctggcaagaacgaggccggatccgcgccgatagaggtggcggcggctcgatctcgccggtggagaggggagagagctcgacaccgccaatctcgtcaccctctgtgggaaggagctcgtcacggcggtggggagggagcccgtcacggcggccggatatgatgcccacggcgcctcccgctgtctgcgctgtcgaagaaaaggaaggcaagacggggacggagttggatccggcccccgccaccgccaaactggatccagccgttgccttcttcggcacctccatgcccacatgcttcacaggctccaggcccaccgccgttgtcccctcaagcgcgccgctggccccatgcaggatccccctcaccgtggacgaaccgcagccgccacccaccggtcgtctcccctccgcccagatctgggcctcctatcgcagcgcgcgggggagggggagggggaggggggaggcccggcttttgcgcgcgtcgatttcacagtcgccgcagtcgcggtccgctatcgccgtcatcttatccgccgtgtcagctgagagccgagaggtggggtgagatgaatctggagggaggtggtgaggagaagaggataagatggagtgactagtcagtggataaaatggagtccgcacttggtgttttaatatagcgaataacttcttgcggtcggcgctccttggcaaccaccagcgaaattttgattttatctagtggtcacttaagaggcccgctttaaaaagacctctatttttacaagcggttctcttatcccggccgctaacgaaaatgaattttttcgctggcagttcttagcacctcatccctcgttaaattttcgctggcggttttcgcttatagacgtcagagaaaaaaaatagataaacgccatgaaaaatcgattttctagcggtgactccctcccatcaaacaaaaagcaattctgacatagtcttaaaaatactgtttccgctaatacttcgtattgcattttttttagaaacctaataaaatcacaatttgtaaaagtactttctgagataaatctacacacgtgattttcatgtataccatctaaatatctttaagaagaaatttatgtgtaaggttgttttcgcgattgaagggtacggtgggtaattacagtcctccttccgatggaaatgccggggaacggcaacactctatattcttttatgtccttttgaatggatccatattcttggacaggtacattggatggcacatcaatattcacttggtcaaggataatacgaggtacacgatcaacatcatgatacgtactagtaccagctaaccactgcaccataattgaccgaggaaggcaccgatgagttgaagttttcaaattcctccatttcatattatatgatgatctggcttattttttcgaatcaaacatttctaatataaaacaaacatattataaatatacatttaatgctagatataataaagctattttcatgttgtttaattattctataaatttaattaaatttgaacatagttgacttataaatcaaagcgacttaatatgaaaacgaaggtagtcactccgtttcaggttacaagacgttttaactttagtcaaagtcaaactattttaagtttaactaagtttatagacaaatataataatatttataatactaaattagttccatcaaatcaataattgaatatatttccataataaatttgtcttgggttgaaaatgttactagctacttttttctacaaacctgatccaacttaaagtaaaaacgtcttttaactcgaaatgaagggagtagaacttaaaaacatgaaaaggtcggggggagaaacggccaccggcacgtgggaagaacggacgtcttccttcctcggccacacatatgcacgcacggacgccaccttgagatcacatttggagcaaagattctatacaaaagttgctacaaaagttttttacgaaaagtttctatacaaaagttgcttaaaaaatcatattaatctattatttttttaaaaaaatagctaatacttaattaatcacgcgttaatgcgaacattgtgttacgtgccgcctcctcctgaacagatcctaatccatcatcctcactccactctctctctctctttctcccgtcgacgcggaggcgccaacgccactgaccacccccatccatcaattcaatcaccaatcaatcgacggcgacgacgacaacgacgacgatggcgacgacggagacgaggacgacgacgacgtgctcgatcgcaagctagcggcggcgaatcatgagacgcccgcaatgaagtcgtcgtcgtcgtacgtcctcgtcggcgaatcatcggtcggcgaagcagctgcagctgcagcgatcgatcgatcgatcgatgtggccgtaacaacaagcggctgggagaaggacacatcgctagtccgaggctagtacttcctccgtattattttaatatatgacgccgttgacttttcgaccaacatttgaccattcgtttaattcaaattttttatgcaaatatgaaaatatttatatcatgcttaaagaacatttgatgatgaatcaaatcataataaaataaataataattacataatttttttattaagacgaatggtcaaacgttataaaaaagttaacgacgttgtacattaaaattaaaatatggaggtagtattaagctccgagctagctgctgaatgcagtgcgtgcagagagtctctgcactccgatccactgaactcatcacatgaaactgtttcacgtgtgtggctcggtttggaattattgaaccgattattaccgtatactatgcccctccatactataaaaaaaaccagcttagaattagatggggtttactccctctctattcatgctgagtaattttacagttgttgagaaggtaccatggggtactaaaaatttcgtgtaaaattcggtaccttatacgagataccaaattcataatagaaaaggtgatatctcatattagcttttaaaggacggtaaaattggtcattcatatgcatgccataaagcccggaaaaggaacggtgtcttttcttctcctctttggtcttgctgccatgcacaaatgcattgatcaaacgcatgaaaggagaaagtaacataggccttatttagttgggaaaaatttttaggtttggttatcacatcggatatacggacacacatttgaagaattaaacgtagtctaataacaaaacaaattgcaattctgccaagaaactgcgagacgaatttattaagtctaattttattaatccatcattagcaaatgtttactgtagcacaatattatcaaatcatggcgcaattaggcttaaaagattcgtctcacaatttacacgcaatctgtgtaattgttttttttccctacatttaatactccatacatgcgtccaaacattcgatgtgacagtgtgaaaatttttattttgagaactaaacagggccatagtataacaaatctgaataagaggttatctagatttattatactagctaggttatgtcttattcacatttagtttgattttctgtgaaacggactatgctttatcgtaatgataaattagatatttatagagagaaacttaatgaatgtcaacatttaatacatggtccaaaaaactgtctaaacattcatgtatttttaaagaggtgaagaaattacccaccgtataataccccgatgaagtaatggagcctggccacttgtgctgcagttgtacgaggttacattaactctatatgccaaacatgtgtttatggttccgtatttcgacgattcagaggtagatttgttgctttctccgtggcttttacgtcgttgcaggttgtgagttgtgaccactgaagctgagctcacgttcatgtctactatagtatctcagaaaaaaaaagattattttttttctcttcctatttattctaaaataaatttataaacacattggaaacagatagctagagtatagaataattctattacaatttgataaagtgagaatattatagttctttttttctattggtatgtatagaatagataaaaaatgaatttattttgtgatacagtgatgtgagagtattgctcaaacagaagacattaccaacttcgcctattttacttatgtctcactgtctcggcctcttttaagtttggacgtacctacgtctcgttttcatagacaacaactcgcaagctactgtataacagtggccgcctgattaaaatcctctgttttgtcatgttcttttgttaagataaaggattatattaacccggcctttacaccttgggggtgtacacagccaacaactgttttgtcatgttgatgtctggggataatctgctgagtttctgctgtcatagctgaaaaaagttcaggcataatgacaaatatgcacataatcgagtaaaatgagcacagtgccacagtgtaaaaactgcgtaaactcagactattcgcccaaactgtggcaaattgatagtattgtccgttcgttgctaatccgatgctaaaaaaatctcctaaatccgcggcattgtttagtggactttatgcctctacttcctctcaagtgttgaaatgatgcctctactacgtaaaatttgcgtatctttgtatcaggattcaggactggtgggtgtttggggttatatggccttgagcccttgacaagctcatggcatatgtgtgtgtgtgtgatcgagagatggagcaaatgtagcggtggaacttgtggtttgaaaattactatctccgtcctaaaatataaaaagttatcggtttggacatatgtattaaaaaaaatgtaggtgaaataaatggaaggagattatgattggttgagaaaaaaagtaagtggtgaatttgaatgatgtgtttggtttagaaagaaattattatatttttgaataagttctaaatgtaaaaaaatgttatattttgggacggaacgtgtactactcctaccacttattattattattattattattattattattattattattattattattattattattattattattattattattggcaaaaagatttacatttcttctttcttcttatggattgggatcaggtgcagtcacgactgcaactttggcagtagccactgatccaccatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattgataacttttaaagaaaatgttccattcaggaaaaaaagaaactgtaaagaaaaaacaataggattaatgcttcttagttgaacagagcatgagtcacataaaaaaaaggttaaaggagttacatcaaaatatgagctctacttcaagcccttaaaataaatgccaagcttcttttaaacatctaaataagtagtactaaatttcttgtcaaatgaaaaataattgtgctagtatttcatgttcaaatgctaaatgaggaaggaggcaattaagtctgaacgttccttactagttggatggttggattagttgctactgccaaagttagtgactgcacctgatcccaatcctcttcttatgggttactcactgttcaccataggatgctggagtaccctgcctcatgattcggcgaaaacagccaaactgtccttgtaaacgttggattgacaggctttattggtgattctcccaggcccctacctcttgcatttctgtccattcaatcaatgtatggaaaacttttcagatggggtagtactgaagtggatacctcagccagtaaattccacagccgtgagccaattggctctgattggttgagataaaggtagaaaaatgaacaaaacaatcaaaataatttacggtttaaacctttatatctatatcatgtggtttaaaagtaaacggtagtagaaaatagactaggtaaaaaaaagctaaaactgactctaaaattaaaattaagttccactccctccgtttcacaatgtaagtcattctagcattttccacattcatattgatgttaataaatttagatagatatgcatgtctagattcattaacatcaatataaatgtaggaaatgttagaatgacttacattgtaaaacgaaggaagtaaaacttaaattttagccgtgaccaccaacaaggaattaataagagccttccaagtcaataattgagagacagagtgagtgagctattggtttcgaagagtagaagtaaaagtaagttggacattatatagggcgtaatctctcaatttcaatgtataagtatttagtaatggaggtcatatcataatacttggatgatttatatccagtactaggattttatatattggcatagagggaatagaaagagaaggtgccatccaatatatatatatatatatatatatatatatagtaaatttgtttggtgctccatggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccggcaacggcgaattagtttttaatttttttggcacttgaaatgcaagatgcatttgtgttttaaatgacgaaatagccgataatttccaaattggaaaaggtactcctccgcaactttacagtacaggaggtgattttgaacttcaagcttcaaaataatgtgttttctttgctgtttgttcagataagcaaaaacttcagaaatgcagtcgtaggtgaaggcagttctttcttctttttacaatggggccatgtatgtgtaagtgtaaatcctatgatttctttgataaaatgattactatcgtattattatcaattccaagcaggttgcttgtgcactggagagacaaaatttaggaacagataatttaaactgacataaaattggtgcatccagggatggtttaatttttttttaatgcaagtcttatcaaggcactacaaaaaggaagcataactgcacaacaccaacaaaacacatgatgcgatatgtaaacataaccaatatctttattctaatttgaaggtgattcgatcctgacattacaactgtttcatcacaccaaaaagaaaaaaaaaattgtaaataccatagaacagccaggacggttgtccagggaggtgacacatttgaagttacaacgctgaagcgatctcagttcaatcagcactaacaaaaccaaaagtatttcggtatttcagtataagcagttcacatgaacaaacgaagtttttatactaccgccctctcacttgctcttggcagtgccgtttgcggtggcaacagctccctttggtgggttcagctgatcccaggcctcaatccatgtgaccatggagtcggcgagcttgttgaagtagccatcgaccttcccgagcttcgccctcacttgcttggccagctcaaggtaacacttttggacagtgtcggcctccttcgggagggacgcagactggaagaaggggatcagctcctcctgccagaatatgccgttgtattccttcttgaggttcacaaaggggttgctcgctttgctgtgccagatgtagggaaggccagtcttaacacccaaacccaagtgatcggtaatcacctgtttttatgacagatattagcatggattgtgattggtgagtggtgaacaatagttagcttgcacaatgcacaaattatttctgaagggggagaaagaacaaaccttggtgcaccatcctgcccacatatcgtcgtaacgaccaataggctggccatcacccataagaccaaagtacatcgcaggaccgatgaggtcacggtcaaaagcaaggttcattccacacatcgggaataaagtgcccttcgggattgtcataacagcatccacatacctgatttcatcatcaataaacaaaaacatcagattggcaagaagagaacgataaaggatgagaaatgccaaaaatgtaacatcaatacctgctgttcctctcaagaggcttgacaagctgggtaggggcatcatagtctggaatgttgagccaaagcccatgagaaacggcagtcggggcaccctcacggaggctgaaggggtacccacggacaaaatcagcgccatcacggtacgggtcatacaaagtgttgaagaaaaatggagtggaagggttcagaaggttcttgatgtgctgctcaagtgcattgatatcctttcctgatgggtctttagcaacctgagattttgcaagaggaataggtcagcaatgaaccaaaaacaaatgatagggcggaatcagagaagtattagcattacccaaaagtaacaaaacagaggactaaaataatggcatcacactccaatgctcaacttttatagtgcaaggcatgtggaagtactcagtcaactgtaagctaatcaagaaaactattgtgaagatcatactagaatgcaactaaaggacatgaaagagaacatgactatattcttatgctgtaaacaactgaggaccattcatatagttaaggttgattctacagtacatccatgcatccataagccagcctaataaaacatataaatcaaataatttaacaagcaggtgggacccttgtggctcatgtgccccatgtgaatacacatggcatttgctttgggggaagaagctacaacacaaccgctgaatacatccaacagtattttttttccttgtagaagtaaaacaaaaataggaatacagtcgagataaccttcatgtacctttatgttaattcctacaaaatttgtgttccactggctcttaactgataactagtgaccgaggcttaatgatgtcatagtccatcacatgtgatttagatggattgtttggtcctgtctaacttcagattaacgtttttgtataaaggaatcaatcataattaaatacaaatctggaaaatgatgtgtagccaataacaaagccaagatgaccccaaaccaaagtggacataccattcagtccaaaagacaccattaacttgaccctttctctactgtttctacattgatatgttctgaagaaaagactactgataacggcctcgagcataaacaaagtaatataagcgtacatatgcattaacacaaccgacaaagcacagcggcaggacgatatatccgagccacattgtcgcgtactaacaatttctgaatactacaaacctgtggggcaccacagatatacatataacctattccagctcacatcccctccaaccgcaaccgcaacctatacatgaccaccaagcaagtgtagctagatccaatgcttgatgcttccaagcagtgggccaagtcaaacgttcaatccaagacaaagcaaacactgtcagatctgataatggcagactacatgcatgattccaaggattaaggagttactaccttttcaactaggcagatcaatcagtcatccgcaacatgtgaaattcacattcaacctacccacatcacagcactatgcagtagtaatagtagtagtatgatgtaatgcaaaaattaaagggtttttttatcactactaaactaaactgtcctaacaaaaagaactactaatctcgcaaaactgaagctaaactcaaaaatctaactacggggcaatgccgattgctgacgaagaaacagcccagagatctcgcctttcccccactaaaactacacatccagatccgatccccaccaaaccaagatctaaaatccccgcacacagatcacgccatggcagtggagaaagatcgcccaagatccagcggccatcaaccagcagatcaaaccttaacagagacagatctcactgaggcgaagttaatcgaggggtggaagggggaaagaagctcacgaagcagtcgtcgtcgatggtgtagatgtacttcttcttggagaccatgtagccgaagcagcggcaggcggagtccttgaaggagatgcaggaggccctggggccgaggatccgggtgatgtcgtcgcggttgtagagctcgtagtcgaagccctcgggcacccggatcgtcttcttggggtcgccgtcctggacgatgatgaggtggtacggctggaagaagggcctccacatctccaggaagtccaggttgcggatcgtcgggatcacgatgtccagctcgtccttcagcagcggcgtcgccgcctgcgcggccgcggcgtcggaggaaagccattgccggtggcggagtagaaggtaaaggtgaaggtgaaggtgcaggtcggggggagtgaggcgagacgaggcgggtataaaagggagggagacgagggggtgggccggatggcccgtggtgggcctcttttttgttgggctttgcgtgtacaggaaggaaaggaacctgtgtgagtgtgagtgtgagtgtgggtggtccgttgttggagttggtgctttgcttgacttattatcactactactggggcatggactgatttgcatggccatggacatggtgcctaccaacaacatctgggatggttggctcaagaggggaagatatggtaacggctacgggtaaaaagggtcgaaatcggtagaatctcttcggaaacgatgctcgatcagccggtaattgaccatatctatcatttaaactactcagtatcgacattaatacgatgtagaaagaaattagaaaaaacaaaatttaaaaatagccaaaaacggtacagtcggaaactgtaccccttaaacggaaacggcgcccggtcgatcgggaatttccgtccgttttcatccctagtaacggcgatgttcttttcaacttatttatttatcggattaatggaatagattatttgtttcatgttttcaaaaagagtaaattaatacgtagtgtaggaacttggcaggtggatgtgatttagtgtaacaaattgaaaaatatgcagaccggtacatgaacttggcaattaagtgcattttggtcaataacattgttgcgtacgtatgattcaacatttcaacttattttgtttgttctcattataagcataattgctaggttattggtcataagtacgttttgcgttgttcatcaccgcagacaatcaaatatgtttgattagtccgatcactcgggaaactatgttacaacagtttttatgcagttagtttttacaatcattatatttttcggtttcaaatcaagaggttattttattattataaacaaacaaatacaatacatctaggctattattttgagagtcattatacttgttagattgcaatgacaactgcttgcttttacgtggcttaaaaagttagccacgatatatggtcgcatgatcaaatgttagccaagaaaaaaatgctgcaaatttgtgatatactcttccttcaatttttatatcatttcgtttaccctcttggacggacagccagtcgttctaagttctaagttctaacggcccttttgccactctagaatgcgtgctagagacaccaaaaccagtcagaaaaacgtctttgagtacgagctgcgcgcgattacttgaagattacacacgcaaatacgcctttccacatcgtacgccatggaccttagctacagctacacgcacatcaccatactattatttacttaattgtaaagatgaattgaatattttgaaaataaaattaaaatcaatggtctaaataatatacagtagaataaagttttttttaaaaaaaaaagaacataaagtgtgaagcactgaagcaaacaatttgtttcaattaaagctagtgaattttgatgcctgcaatataggagtagatggtgtgatcatctgtcacgctcgtacgaaagaaaggacgtacgtttcagcttatatggatggtctcctctctccatgtgagctgcaaggaaaacaaaaccggtaacatatcaatgcctaacagaaaatgatggctgctagaacgtacgcattagtactagtacatcaactaatcgccttttttgaaaataaagaaagaaaaagatcaatgctgacagagtacttacctgatcaaatcggtaattttagttagtttatatccagggtgagcaatgagcgtctttcattttcagtactacttcttccgtccataaaaaaaaatcaagggcttcatcttttctcgcttatgcttatacttatcagctaaaatttgaattttcaattttaaatttagaggtgattttgaggtttttttatcgaagtttatttttcagactttgcttttatatcgctaagaacacgtatataaaattttattcacaaattacttttcgtttgtaaatatgccatttctcttattccgcgaataagccaaatgatggctccgcaaatcttgactataaatctagataaatgtttgtccagatgcatagtcaggatttaaccctttttgacgaaagtagtggaatattccctctgtctcaaaaaaaagcacaacctagataaggatgcgacatctcctaatacaatgaatctggatatgttatagctgccatttcttcatcccaaggaatgaaaatgaaactttttagagatccaaggtatacagaggagacttttgagtgtttatacagatacaataatgagttgacgagacacacgacattgtgattctctcgagatgctcgtctctttgcctgcctcgcacgtcggccggtgatcgatcgccggtgctctgcctcttgcagtccgcactgtacttacaccgacaaagtattttcttttcacgaacacacaaaagctttaccttttgatgtaagatgatgaataattcaagtagaagaaacgttgaaatggaaattagcattgtgatttggtgatctgtatatactgacctagtaacagcttacatcaaggacttgtcgggagtaatggcaatcatctactgatctagtacctacaatgctacataattgagaatcttcagtttacatagcaacagtgattgtactgactaagcttctgtttgtggttctgacgacgaatgcacgatgactgtcctctcctacttgaaatcatggagaaatggcagtgattgtacacaaatgctgcacagttttcacaagaatgaacagccagcttgatatagtgatctcacctcacgctgcaagcacgtagtgctatgtcgtcgcggcagcaaatcagcatttatctgaaactgaacaaccaaacagactgaacctcgtcgtcactcgtcagtactcaggtgatgagaatttttacatcacttctccgaaactgaactgcccctaaatcatccgacagtgctacgaccaacgccatctctaggtggattttcaggcccagatttgtaccagacaacgcctgatttaagcttgttcatgttttcagttgtaggtgagcatctgcatacatagtttttgtcccagttggaatgcaatcgagttgatttatttctttcgaatttacagcggaaatggctctccaattgtgatcctggaattttgcacagttcagaatgtagactggatgaagcaagttcagactccaattgtaatttagatacttcatagagtgttctaaaaaaaacttcatagagtcgttggacccaaaaataggccaaggcccagccccgctgaagttttggcccaacatatgttcacacggcgaaaattaaagtcattaatgggccttgcatcccagggctcgggccatggtccaggttgcctgggcctgggtccgagaaggtttcccagcttcttctttttttttttttgagaatttcccagctattgg

SEQ ID NO: 25231 - DNA, 559 bp, Oryza sativa
gctcggtacccgacttttgacattgtttcatgtgtggaatataggatggactttttgcattgtttgatgtgtgggacatgtgacggacttttggcattgtttaatgtgtggaatatgtgatggactatgtgatggacttttggcattgtgatttgtgcaattggaacttgttttagtctgtacgaatctgtgaattgtgatttgaattgcgaactgtgaattggtacatttgtgcaatatggatctacaatttgcagggaggcagagggcggcgccaaccaccctggcgccgaggttgagaagggcagcgccagccagtgccgcgtggcagaagggtttcgggctgggggagggcggcgccagctacccaggcgccgtggtccatgagggcggcgccagccgaggcccggaggcagaagggcttcgatgggtggaggaggggggcgccagccaccctggcgccgcggtcggggggggcgccagccgttgcctggaggcagaacagacttggcgaaaatttgggggggggagaaagttggtggggcccgtagaggagggg

SEQ ID NO: 25232 - DNA, 1474 bp, Oryza sativa
  unsure (1)..(1474): unsure at all n locations
cccaggggtctatttataaaataagttttcaaaaaggaccaaattgtaaaaatttcaggtagaggcggcgacgtcggttttcaccacgctatggcccgcaagacatgtaaagttgtcaacacgcttgtgcggttttgggccgaattgaaggcgacctgctggttgggcgcccaagctacagaataaggaataagttcacttgatgaccctcaaaagtgatcggaatataatccatgagcctaaaccgcaaaatcggatatctcgaccctcaaactattaaaaccggtgcaatttgactcccttggcggttttagagggcggtttcgctgacgtgacggtattgacctagtctgtgtgctgacgtggcgcttagatagcatttcaattaaaaagatatacgtgggacccgtttgtcattcacacacacaattgtggattccactgacatgtgggccccacatgccatcttatccgtttcttcttcctcccctcctcccttctctatttctctccctctcccctacagccgtccgcggggagcgagcggcggcggccgggggctgaagcagcgggggacggcgggagctgaagtggcggcggcggaggtaggctggagtccatgtcgtgccgctgccaccaccaaccgcaccacccgacggcacacatcgagatgtcgtcggcggccgagctcccctcagaacccgagagattctgcgggtgtcgcggcggctggcggagactgcggcgagcggctgcggctgcacggagtcccaagcgcggaggcgcaggtgtggagccgtggcctacgagcagcgcaacggagacgcgggtgtggcggtggcgacctgcaggtcgagcagggcgcggccgagctcgccgtaccccgccgcgtgtgcctcccgccgccgccgctgtggtctcctccatcttcaccgtggtggagctcagcccgggcgccgccgccgcccgcaggcgatcagctacaccgtccgctccggccgcctcgacgcgctcgcgctgctcctccttctcgcagcggatataccccatggtgaacgaagacgcgcagtatggcgacgagctccgggccgtgtgcccgccggacgcggaggagacggcgtgggtgcacctagaccacggcacgccgggggagctcgacagccagtgctacgtacaggaacgtgctcgccgggaaggtggtggctattcaactcggatcactggacgctgatcagcgaagcggcgacgaggcagatggtcgaggacaacgcggtgaacctgtcagccctttgcttgttggcttgccgcttgatgttagtacacacatgcactgcctgttgctaccgcttgtgcttgctagccgcagtccagccagtcctcatctgtcgccccttgccgattgcctcagcaaccagcannnnnnnnnnnnnnnnnnnnnnnnnnnnnnnnnnnnnnnnnnnnnnnnnnnnnnnnn

SEQ ID NO: 25233 - DNA, 16576 bp, Oryza sativa
  unsure (1)..(16576): unsure at all n locations
agtcgcggtggcgagacgcaagcggcccttacgcgttcgtgggcgcggcgggagaacggcggaggcgggtgcgtcgtggccggcagagagggcgtggagcatagtggtggatagtacagtcacggggctgagggtggcgaggacgcggccattctcgtggcccgttttcttccttccgacggccaaccttccacggcagtctcgatctccgccgccgccgctccggccctcgcccgcacgccgctgtcgccgctccagtgccactcccaggtctccgccgccgctggccaccgtcccacactcgcggagagaaagagagaggggaggatatgatttatgtgggccccacatgtcagtgggtcccacctatacttttggtgaatgacaaatgggtcccacgtatattttttttatttctaatgccacctaagcgccacgtcaacaccatgtggacagaagaccgagtcaatactgacatgtaagcgccacgtcagcgaaactgtcctccaaaaccaccaagggagtcaaattgcaccggttttaagagttgggggtcgagatatccggttttgtggtttagggtcatggattagatttcgatcacttttgagggtcataaagtgaacttattccacagaataaacctagcccaaacatgcaaacaattgtacaggtggcctcaaatgaaaaaaagaagggagggggggaatttataccttaattagtccgttccatcgtgccaccttggtcaatataaatgcttgttcagtttattaccacttttaaccttatcattttttatgttatcaaatttggtactctctccatctacttttgatagtcatatttcatcttgacacacagaccaaggataaataattctacttatcatctatttaaatatgctactagtcattcctcgtaaacaagcgattcattaatatttacatttctcaatacccatgtagccaatcatgtgttgaagaatggagagtcacgcattaaatttaaaaaaatcattaagatgataggttgttggattgaaatatgcctatcaaaaataaaatttttagatttgaaaatatgactatcaaaagtagatggagggagtaataccataaactaaacactcttcttcattgtcaccttaccaaattttgatatttctaaaagtttcttccaataagagaactttcaaaatttggtaagttacaaactgaaaacattcaacaataccaactttgatgacaccaaagtgtgccaatatttggcaatgtcaaatcttagtgagattgattttgacaacgagctgaactaagctaagaacgcaagcaaattaggtattaactgacagctccataagtaactcgaaaagataatgaaataagtcagagctttaattttgtcttgtgtttcttcagaaaaataaactagcactcgactaagctaagaacgcaagcaaattactatgtaaaaaaaggacaagtccccctaagaaaacaggcacctacttatgtgctcgagttaaacgacatatttgaagactatttcctccgttctaaaatataagacacagccactcttaacccaaagaccaagaaacaattattatcatcttctagtttgaatcaccataataaatactcactccatctacttttgatagtcatatttcatcttggcacacagaccaaggataaataattctacttatcatccatttaaacatgctactagtcattcctcgtaaacaaatgattcattaatatttatatttctcgatgcctatgtagccaatcttgtgtagaagaatgaagagtcacacattaaatccgagaaagtaattaagatgataggttgttggattgaaatatgcctatcaaaaataaatttttcagatttagaaatatgactatcaaaaatagatggagggagtataatacatgcatccaatagaattagaggtcttgatggtagaggattaaaaaagtaataatttaacggggaagaggttctaattaattgtatgcatgcctgcatgccttatattatggaacatccaaaaaagtagttgtgccttatattatggaacgtagggagtactacatgatagatttttctggacaccacccattttgtttccatgcggtccgaaactgaaaccgcatggaaaaatggggggacgagcaccgggctattgcccgcacgtcttaacccgactgcacgggataatcctcgttatcccgtgctgtcgacttaagagaaccgtacggaaaaatcgattttcgcgtgcaggcttttaagtggactgtacggaaaagtagatggagagtatggacgaccaggatggatagaagtacgtatgtatatagtatacaactccctctatctactcgtgatagtcatatttctaaatttaaaaaaaatatttttgataggcatatttcaattcaacaacctatcatcttaatgattttctcgaatttaatgcatgactcttcattcttccatacaagattggctacatggacatcgagaaatgtaaatattgatgaatcgtttgtttgcgatgaatgactagtagcatatttaaatagatgataagtagaattacttagggcagtcctaacccataacactagacatggtttccataaactccacatcatcaagaaactagtactagacactactcttccaatgcaaacaccactattccatacttcaatttaatgctacttatctcacatgatgccttggatgttatgtagaaaccatgtctcatgctagatatagtttccttatctttcctcatttattcacttgccacgtcattttttttcctaggtggcaacttatttaattgctatggacaccatcctatttattggattgggaatgtacttatccttggtttgtgtgccaagataaaatataactatcaaaagtaacgaagagagtatatttatatgagtagtacacaagtctagtcttggtactagctggcgagccttgtgcatttgttgcttaattatctcgggaagggaaagagttggggaggtgagaactgagaattgaaggaaggcagagcaggggagtcggtagctagtttttacggtgaagaagatgaaacgatactccggtaattgatccttgattaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctccttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattctataggaattgtatatatatggtttggaaaactcaaatccttttaatcaaaaggccaaataaaaaaaattctataaaatttcaattatatgaaattcctctgtaaatcatttacttcaaagaggctctaaatttcttttatgtttcaagccaattcaaatgattttttttggaataataattcaaaggaattttgtaggatttccaaaatttcttcaagtaccctgtgttccaagggatatttgtttggataatagggtttagacatgttaaattcctacataagtttaaacggcaacatacttaattaccacaaaaacttattacacggcaccttattacacatgaccatggatgtactagcatataaccacgtcgcctaaacaccgtgaattactagcccacacagattcacagccaaacaagagtaatctaagcatgaactccatcacaaatccctccttaattagcaaggcgattactcactcaaccaaacgccacacacgaaccagcaagccaacgccagcgagcggcggacgtcggcggcggcggataccatttcttccctacaggaaagcggcggcggccgccttggcgcccaccgtgcgcaggaggtggaagtagagcttggggttcgccaggaacgccgcgcgggagatgacgtagccggcggcgcccggcgcgttcatgatggcgccgccgactgccgccgtgggccagaggaagtaggcggccacggcggccccgccgacggccagcgccgacttccccacgccctgctccttcacgaagccgacccccgcggcgaggcccggcttggccgccgccgccacggtggaggccacggccgccaccgcgctcttggcggagttgagcaggccgccgacgaactcgctcacgccaaccatattctgctaagcaaaccaaaacgacagtaataaagtaaagtagtattagctaccgaggtgaggactgagtagtggagtcttccgttgcttatgtagaaggccatggctacagtaatatagtaaacttctataaagttgcaacttccaaaaagaatttaaaaaaataaaaacatattcttattagaaaaatctagtacataataccagttccaacccaaaacactagacatggttttcataaactccatattattaaaaactagtactccctagacactactttctcaatgcaaacaccactctttcatacttaaatttaatgctacttatctcacatgatgttttaaatgttgtatagaaactatgtctcacgcaagacctggtttccttctcttttgtcattgccacatcatgtttcattctaggtaacaacttatttaatgctatggacatcatcctaattattgggttaggaatggcctaatatgtcacatcccatactaaccttgtatttttatgaaacgaatggagcagtcccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtctacgcatcacaagcaaagcaacagtgaaaggtcaccttgactaacaacagtgaacgacgaaatcgaaaaaggtaagaaaccaaagctgtggaaagcatgaaggtgaaatggaagtgtgacgcaagatgggattccctgattgatgtcatgtatgcttatgtcacgttatgctgctaggaaagataaccggcaacgaatctgggagttttttttggaaataatattattttaatggnanancncnnnattatnngtnanttaaacnaaatcncaagtttaacaccctgtccaacggaggcagttcgaaagggtacctgtcgaactgncccaattcgatagggtaccgttcgacaggtaataaaataacataaaaaaagggaaaacactggagcgacactggagcgacccttgctatcgaactcccgctgttagaaacgtccatcccacgccccctatggaactccccctgttaatacgtccctatcgggtactgttcaagaacttttttattttttttcttggacaactagcctgtcgaactagggcctgtcgaactgccccagttcgacaggggtacctatcgaactgccccagttcgacagggcgctaaaattgcgatttcgtctagccgacctataattttgcgattttccattaaaataatattatttttaaaaaaaattcacgaatctggtgcactcatgcacacacacaatcaggcccctccaatctagatccaaaggctagtgttcaggtgaggtaattttgcaaaaaaagcgcccgcctcttgccctggcattttgcaaaaacccccctcacgattggttttcctatcccctcatctatcagatcgtgtgtcctccgagcgcactaatccatgactcttgcgattctctttgttgaacttgttcgttctcctgcatttcctcttgccataggtgaaaacggtgattgggaaggagcttcatgtccttcctatgaggtaatccttgaacaagaccttatgtcttctcctatatgatattttttcttacaagcatacacatgtactggatactggatattgttatattcttttttttcaagggaatggtataggagctatgcaatgttcttggcttccatggtctaacttgatttactatttctagagatactacttggtcaggtgctgaagaatagttgaatgaagatggtagcaagagaatatgggaggcatctgcagtagcaggaaaactattagttgatcaggacagcttgcttgattttaatgtatctccttatatatgtacaagtgcatttctcattattgatatgcttcagcaagcactgaaaattttcactatgcatgttcacataattaaacctggtattgataattttcacacagagacttcgatggaaaaaccagcaaatttttttacattcatatcagcaagccatcataaccttttgcattcagatttcaagaatttgagagatattacattcaattcaatctgggtgaacatttttaccatgtaagaagaaagaaaaatgtgcagtccgctcaaaattcagaatggcaaacattctgaatatttctgaaaatatgtgcaaatcaaatgtgcgtcagatttgttgttattgcttggtagttggtactgccaattgttgctttgtaacaccactaagcagtagcaatgattcttatcaaaattattcttcttgcttcctcacaccacctaacagtagcaatgcttcctcagagcgatagctttcagaatggtcaggaacaggggcatcgccacatactacatctacaatcactcaacgccggagagaaagctagtgcgcgtgtgtgcaccaggatgggtactgtaaccaagagcaagtacggagttgcctccatatccactgttgatgccacctgcagtaccggtgagagagagagaggggattaaatattagggtttgcagagaacttgaaaaagagaaaaatggaatttgggaatgtgagagagcaaacctgcagcttgggttcctcaataatgtatcccagatgatcgttttgaatcagtcttgaagctttgcttagccaccaccatcgccgaggagcttcgcgtcgtcgccgccgccatcatctccgttttaactttatttaaattagactacttcaagattaactatgtttagtaatatctacaaaatcaaattagttttattatatctataattaaatatatttatcttgggataaaaatgtaactaattttttcctaaaaatttggttaaaacttagagcatattcaatatatctgtaagtaaggtccatatctagaaagtcttctccaccagcccagtagtgtgcatagatcttaatgcagaatcaacgactaggggattaactgatgaattacaaatttgcaggcgactgcacagtagcaaaagcgcaaaaaattaaactaaaaaccagaatctagattccttttagctactccctccgtcaaaaaaaaaaacctagatggggatgcccggattcgtagttttaggtgaagtcacatcctcatctaggttgattttttttagggcgggagagtatttctcgtaatctctcagacagaacctacgtattgctcgaaaagctagctagccaggatagccaggataacatagcatgtcgaacagcaatcgatcgtcgatcgatcaatgtgagcagcaccaacgcaaacacttcaactaggtggcacgattaacgtaagttcctacgaccaagcaacaagttaacaacaaagcagcgcaagacgtacgtactccatccgttttatattgtaaaacattatagcattacccacatttatatgaatgttagtgaatctagacataatatattcatagcaattctaaaaattcttataatataaaacagtggaagtaataattaaggtcgtcgattcgtcacgtcacacggcgaaggcggcggcggcggcgacgcggccggcggtgtggaggaggtggtagtagagctgcgggttggcctcgaaggccatgcgggagatgaggaggccggcgccgcccggcgccttcatcatcaccacgggcgccaccgccggccaaagcaggctcaccgccgcgccgacggccacggaggcgatggctcccacgatgtatcccacggcaaccatggcgatccccgatccctctgcactggctcggcctcggcttctgttgcttaccacttggaagttggaagagatgaggcgcgcgcgatatcggcgaccaagatggatacgtatgtactccatatataatccctccgtcctttaaaataaaccaacatgtaacctctcatatagaataataaatttggaattctggacagttctttatccaaatttgttgtattaaaatagatacaataacaaactataagccaactctaaacacatatatagataaaaagaagaaagtgaagagcagtaggctataatttatagcccgctgcagcatagaatggacgcaatatatgtattacaggtgggatcatgtatcaatagtatagtatatgtttataggtaactattatatatattggctataaaattgattatagattatttggaactattagttggctatactattaaacttgctcttaggaggggatgtatctccttctagattgggtttttttttatagagggagtagcgcacaagctgctttaccttgggaagctaagtaaggccttgtttagttccccttttttttcaaaaaatatcacattgaatctttggacacatacatgtagcattaactatagataaaacgaaaactaattgcacagtttgcatggaaatcacgagacgaatcttttaaacctaattagtcatgattagccataagtgttacagtaactcacgtgtgctactggtggattaattaggcttaataaatttgtctcgcggtttctagacaagttatgaaattagttttttcattcgtgtctgaaaacattttccgacatccgatcaaacgtccaatgaggcatctaaaaattttcttttcaccaaccaaacgcaccctaaatgacatgtgggcccggatgaattcgaatggacgtggcttgcatgccaatactcgtcaaaagcttttgacacgcggattgttctgcctaattaagggatccgatcctcatcaattggaaaagaagaaaaattctatgcacacaaccacgacatccgattctcctacgaccacggtttatgtgatgcctgtgacatatactccctccatttgatattaattgtcatataattattgaatatataagcatatattaatttaatttattccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaaccagcaagaaagacaaaaacgtaattagatgaacgatagccaatcggccgatagggccgatgacttattgtcaggacccaaccgatacgggtaaacctaattggctgtggctttatgatagtcaattagagccaaaaccctaaatatgccctattggttgtaggactgtttcttttagtttttatcaatcgttttaagacaatattatggaaatagccgatagatcaatacttagagcgaagaaagataatgtactggctaatactccaatacagacttatataaacagattaatctataaaaatataccaaataacaattgatcaccagatatgaagtttaagcggtcaatctaactcgatgtatttatataaagcaatctatctatataagaggcaattataaataaacagatcatgaaactcgcgctatcatatataccaggtaagatggactgaaaccccaatactatccttagttatgattagttccatgttagtttcaattatatgattctaagcacggctagggatgatgcatcacaaagtatgcaaagaacataaagtctagacaaaattgctacaggatatcgtgactaggcaaaatttgctataggacatcgtgacttcacggttttagctgtagtacaccgcacgaagtgacttttgggggaaaacactcccaaaagttggatatttgctagtgaacaccgcaagcattaaagtaataatttacggttagagaggagagagaaatcgtgtgaaatgtcaaaaatgcccttgggcccacatgtcaactctcctatctctcttctctctctatccctccttctcttctctctttatcccaaatgtcgtggcgacggcaggagggcgagggcggagcggccgcaacaacgggacggcaatggctccggccagcggcgcctgccgccgacggcgcccctccttcctcactccgacggcacctcctcactccagttgaagaggagagagaaatcatgtgaaatatcaaaaatgcccttgggccacacgtcagctctcctatccctctgctctctatcacctctttcacttctctcactaatctcttctctctctatcccacatgttactgacgatggtgggtaggcgaggtttggccggggcggcgggaggacaagggcgaaagcagaaccgacgcgaccaacggcacgcggaggagcggcagcgcggctggacgacgacggctgcagcacgcggagtgaggaggaaggggcgccgcttgccggagccgtcgcccgcgcgaagtgaggagagaggggcgccgtcgcccgcgcgaagtgagaagcaatttgattttgatcaaaatcaaaacgacttataatttcaaatggagtgagtacttatcggacttcgctaatatttttttttaaagtattttagttaatcagtaataaaacatactagcagtgaagcccacacaaccacccaaccagcctgagagcgtacccgtacataccaccgctcatgcatttggtacaatcttataagaatttgaagcttaatgttagtacggatggtgaaaattctataaaaatatacatgtttcaaataagaaacccttaggacttctttggatggtagaatttttcgttttttttgtatgaatcaatttaattcccatgaaattcattaaaaaaattctcaattccaacggaggctttaattcacatttcagtaatacatagagttcgactgttcgagtgatcagtagagcagcgaggtgtgtggtacaacgaggcaatggggggaaataaaattaagactccatacagcttgtaaaattaagaattattgaaaagtttggatggattttagatgagaattcgtaactattaatatcaaattttatcgctattaataaaaataaagtttgcatattgtttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgcttacggttggaaaatcgtatagtcattagaaagcacttttgaacatgaatccaacaatatcattatttatggcaaaaagaaacctaaacattatttgagatagtcagttataaggttcaaaattagacagtcaaaattcacattacatttccgagcgtacggacggaagtaaatatgcgtacacgttcggcaaatatcatccatgggccatggcgtacgtatatgctagtaagtagtactaggaaaacatttgtatatactcccttatttatatactcgtaaagaaacgtaaagaaagttgtttagtataatgtttaaatcaaacattgggaatataaatcatgaataactctaaagttgttgagtttgaaaatgtaaaaattatatgaatagatttgtcttaaaaaataattttataaaagtatacatatatcacttttaaataaatatttttatagaaacaagaagttaaagttatattttggagaccgtgtcactgtcaaaaacttcctttacgactacggagggagtatatactaccgttaccgtatggcgtacaggagtatccgagtacgtatatacggggtgtacacgtacaccgtacacgtacgtaggtccattttacacttctcgccggcggcggcgccgccgcagcagcagcagcaggcgaggcggaggcagtggagcgcgagggcgccgagcacggcggggggcacacgaccactgcggcgacgcggagccaccgccggtgtgtccgtacgtcgtctccggcggcgggtgtaagagcgtacgtctcggcttcctcggcggccgcggagaggagcaggccggccaggaagacgacgagctccgtggtcctcgccatgacgagctcccacaggcggccgaagctgtggtcggcgccggcgccggcggccacggctgcagcgccgcctggtaggagcctctcctcgccgcggtctccgggaacgccattgctgatctctcgatctcagtagtgtgaggagtgagtgtgtgagtgagtgagactgatgagacaggaaaaatatgttgggctgtaaatatagaagtatgtttatctaggcccaagaggcccatatttccatatgtacatgtatatgttcagttgatagagtaatgaaaaagaagtgaagcttccagagaaaacaaacacaaaaaacttcatggtatcagagcaggtcgccggtgacctcgccgacgctgaacccaagctggcggcggcgcggaccagcgtggcacggcgaggcggcacggatcggctgccgccgaggagccaggtggtgcaagggagctgagctgggcgtggatcgtcggcgtaggatccggctgcggcgctgtgaccggaggagcggcggcggcggcgtctacgacaggggtcgccagagctcgaagggaggaaggagacggctgctgcagctcagcagaggcagcgacggcagaggaagcccacgtggtggaagtgctgagggcaccgggcgtgcacttgctggctgagttgagacaggaggcccgtgcggtaggaaggagagagaaaaggagaagtaggagaagcagaggaaatctgcagctgagatttggtgctgttgctgcgctgagaagaaaaggagaagcttgtgctgtagcggttgcaaggaaaaagagaggaaagctgaggatttggtgctagtggtgctgcagttctggtttgctgctgctgttgttctgctgaagtagtgttgctgctactctgacctgagagaaactgggaagtggtgctattgctgtgttttcttcttcaaattgaggtaatcagtgttgttcttgttgctgctacttgattaaaatggggaaaaatcagggacttgaacaagtgatgggtaaattggtggacatgcttgcaaagaaacttagtgaggccccaactacaagtaatgcagtggttcctcatactgaaacaatgcaaaaaattgagttgatgcaaaatgacattaagttggagggtgttaaaaattatttgagttggtcaaaaagagctttattgatcttgaaaacaaagggattagaagaatatgttacaagggagataaaggagcctgagagcacttcaaatgttgagtggaagacttggagtactaccaactcttcagtagtagcgtggttgttgacttcacttattcctgctattgctacaactgttgagaccatatctagtgcaagtgagatgtggaaaactctcaccaatctctactcaggagaaggaaatgtaatgctaatggtggaggcacaagagaagataagtgctatgagacagggggagcgttctgttgcagaatatgttgcagaactgaagcatctatggtctgatttggatcattatgatcctcttgggttagagcaccccgattgtatagcaaaaaatgaggaaatggattgagcgcagaagggtcattgagttcttgaagggcctaaattcagagtttgaagggagaagggatgcaatgtttccaaattttcccaaaaaaaccacttctttcctaccttggatgaggctattgcagctatggcacaggaggagcttaagaagaaagtattgcctagtgtcacaccatcttcaccaagtgccacatatgtagttgcacaaagtaaagagactagggagtgcttcaattgtggtgaaatggggcaccttatgcgtgattgccgtgctcctcgcaagcctagttatgggagaggaagatttggtgacaggggtggagcaagaggtggaagaggttatgcaggtagaggtaacagaggtaggggttatgagtatagaggtgatcacagagctaatgtggtcactcttgaagagggttcttctggacctacaaatgttgatgttgccaaccttgttcattctacctcaggtaattcaaaccaagcatttatgtctatcaatagctctcattcaaattggatacttgactcgggtgcatctagacatgtcacgggtatgtgtggagaatttgcatcatataaaccatacccatttacacgaaaagaaacaattcaaactgctgatggaacatcatgctcagttaagggagagggtacagtacagtgtactcctttaatcactttatcatcagtgttatatgtcccttcttttccagtgaatttggtttcaataagttctcttgttgatcatatggattgtcagatcttcccttgatcgtgagaattgtttaattcaggagaggcaaatagggaagaaacttgggattggcgtcaggcgtgatggactttggtatttggatcaaaaggagacaagtgaagatnnnnnnnnnnnnnnnnnnnnnnnnnnnnnnnnnnnnnnnnnnnnnnnnnnnnnnnnnnnnnn

SEQ ID NO: 25234 - DNA, 585 bp, Oryza sativa
tttgcattgtcgactagggcatatatcttttgaaactatgagtaagatgttcccaccagaactaagtagagtggataaacataagttagtatgtgatgcatgcgagtatggaaaacatccaagaacatcatatgtgagtagaggactccgaagtatgttaccatttatgctaattcacttagatgtttggacttcacctgtggtctctatgagtggaatgaagtattttgttacctttattgattgctactctcgcatgacatggttatatcttatgaggcataaggatgaggtgcttaaatgcttccaggatttctatgcatacattaaaaatcattttaatgctcgggttcagtttattagaactgataatggaggggagtatatgaacaatgaatttagtagctttctttcatcagaaggaatattgcatcaaacttcttgtcctgatactcctccacaaaatggagtagctgagaggaaaaaccgtcatcttttggagacagctcgatcattgatgtatactatgaatgtacctaaattcttgtggagtgaggcagtaatgacagcaacttatcttatcaa

SEQ ID NO: 25235 - DNA, 1202 bp, Oryza sativa
  unsure (1)..(1202): unsure at all n locations
gggggctggtggtgttggtgcgtgtacgattgctattatttcgtgctgattgatttctctcatgtgctctctgattgcacatacggttcatggctttgtacgtgttcgttcgtgcgattgctgcttagctcgggatggagttgctcgcgaagtctagctagttgtaggttgcttgtgtcccctggattacagctctctatgtgatgctggcatgctgctgctgctgctgccatgcatatcagaagctagtaatatacagtggtggtacatgcactgttgctgatttagctttatatgctgctcagttttgttcttggggactcatcaatcatcgtagcattggtgaacacgttcacttccatttttttttgtataaaaaggaatggaataataggtgaaaaaaaattcatgtgcttcatcagtacgggcggaaagaaagatatgtttaaattttaattagtgtgcttatctaggtttatcatatgcttatactcttgtgtactgtagcatatacaagtgatgcttattaccaaagcctagctaggccggtaaacttgtattatttgtctcgttatttctggaaatcattagagcagcacttcagttgaaatatgcacggacgccttgctaattaagcggctcctctaaccaggccagtaaggtcttaagttactgacaactcctggactggtataaatggcgcggccagctttacatgacatatggtttgatacttttgtttagttaatttcgaggtggaatataaggtgaccagcttacttaacttgttcatttgatgcattcggtttcatttccctttttttttttaagataatgggaagtaaattaatacccggccttgctttaactgaaactacaactttcttttgtccctttagtgtgtactgtcaccaagttagctatacatggtgcaagttgccattgcccattgctattaacttgctctcacaaattggggtgtttatttcttgaaatggattttttaggacaacaataaactgattgacatagctatactgttcaagtataaccatgtttatggttttcaattaagcaaactgcttatgtttatgctaatatcttttgtttaatgggaggaatttaaatatttcattattggtattnnnnnnnnnnnnnnnnnnnnnnnnnnnnnnnnnnnnnnnnnnnnnnnnnnnnnnnnn

SEQ ID NO: 25236 - DNA, 682 bp, Oryza sativa
ccatcaatgtatatattgtaggggagagagaacagattaagtcagactaggttgtaaaattgaacattctaggggaaaataaatcttcgatgcatatgcaaagaacttgaccgttagccttttacgcaataatgtatgcataaacataggaaaaaaaaaggacctgcactactgattgttactgtatctgatctgcaaagtggcaacagagccatgttaatattgtgctgagaaatggacgaagttgatataggttcgtgctaataaatattcttacaatctgctatcttcctgtctgcaggaaaagtcacttaaaaaccagaataatgttctgcaaaaggtaaatttcattcttgtttacaacaatgttttatatcagatcactacaaaagctgtattggaggtcaaacccttttgtctacattcttcggagcagctcatggagacagaaaaggagaaaaacaatgtataataaacactacccgggaggagcaaaatggagcaacaccaagcacatcatcaccaacaccagtgacggctccagatcccatcccgacaacaaataacaggtaccgcttttacttccatatattttgcccccgcactccccataaataaaacaaaaaaatttttgttcttcagcaaatttttattatatatttttggggatcctctagagtcg

SEQ ID NO: 25237 - DNA, 723 bp, Oryza sativa
  unsure (1)..(723): unsure at all n locations
ggcgaattcgagctcggtacccgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagccccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggnnnnnnnnnnnnnnnnnnnnnnnnnnnnnnnnnnnnnnnnnnnnnnnnnnnnnnnnnnnnnn

SEQ ID NO: 25238 - DNA, 557 bp, Oryza sativa
gatttacaaatgccagattcaattttcatcctcttatagccagcgtggtgaattctcaggttaccaaaattgccaacctcaacagttcagtccaagataagtaagtttcaggagcatccgcagtcctagctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcgga

SEQ ID NO: 25239 - DNA, 695 bp, Oryza sativa
agtgtactactgtacacgtgcacgcacatggtaaggtgtctagtgtactgtgtacactgtagagagagatggggtgatggaatcatgaggttgagatgagaatatgagattggctctgtgagatttacctgtagtgtgtgggggacatggactggtagaagacacgggtcttggctggatcgacgttggcgtccacccagttggcccaggttgccatcccgcgctggaacgccaccatccggtccatgtcctcgtagtaccgcccgtccgcgcccatgtaatcccacctgcatacgtgaagtgaaacgaagctgaagaggaaatctggcgggtgcgtgtggaaaagggcgcgtatcacgacgtttacaataccgtctaactagattcaaaacgatcagaaacgatttgataccgatactgtaatttttgttggaccggagtaaatatcttacaatacatacccctggagcgtgccggtgtgcgtccaccagtggccggagttgaaggagagcacgtcggcgccgcgccacgcctcgccgttcccggagatgtcgtccagccatagcaccttcttcccctgagccacgccgatgtccaccaggtacggcgcgcggtagaacgataccaccaaaccgtactcctgctcgtatacatacgtacgtacgtacgtacttaccatgagtacatctatatga

SEQ ID NO: 25240 - DNA, 24842 bp, Oryza sativa
  unsure (1)..(24842): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctatgagatgaatggcttctggtctctgaaaacctcatcaaacgtctatcattctggccgtggctatgattgcagctagctaccgttctctcgatagataatacggacgatcgacgcatctagcaatgactctgaaatccaggtacttaccatctgcaaaggatctgttatgcgctgcttgtgctaagtcacccaatcgttccccacaacattctcaatggcaactgctcaggtagtgatgagtttcacgcgctctaagcccggcccgcgcacagttaggaggattggccgctatctgagcggtttaaagccaaggagcaagaaaacggatgcgccccgagtaatcgacccgtttcccaagcagagtttcgcgaaacctcccctcgatgtgatagcatcgtcctttgtaacgatcaagactggtaagtccattagtccaaacagttgtccatgtaccagtagaagattcggcagctactgcagcccctgcttcaccttcatatttttcgtggtctatatcatgcgagttatagcagtcctaggaaatggttggttttagaatacacgaaagtgacgaagttgctttgactactgaaccatgcctggatcgtcggagcgaattggatgatcgggccgagggctgccccctcttccccttgctctcctttccttaatattcaccgtcgagtcatcaaagccgtcaactaattcagaggggctcggcgccctttgagtctatagccgccaaatctaaatattccttaagttgtcgtacggcgacgtcagatcgatgcgtctgttaattaaacgttaataacattgatagaagaaggaggttaatttcgtggttaattaacttggacggtattgtacgtcgttgtcgatcggtatcgatttcactctcaatctttacgtcttctctctttttctcgtctttgggtacgatgattaagcatgacgaggacaggtgctgagctgcatttaggttaatttttgcatatatcccccaagggccaaggcccccactgcataacaactcgtttaggaacattaattagtggggctggatgtatgagccactcatcagctaataaaatgtatagtagattatttaaaatatgcaatcaatacatcttattagttttatgttgtcttaatttttctctatacttgttccatgctatggcatgcagggacggatattgaactataagagtatgatagctagggctgcagccctatttccgaacctaaatatcaattgaaattgcattataaaattttaaaagataaagacaaaattatgtaaattatatcgattgagtcctaggcttaaaaagattccggttccgtcactgattgcatgcataattaactttcacttcaacttggtaacttctacaggtattagcaagggttacaattcgacctttttttctacataaaaagcacaatagattatcaaactggtgacaaaagagagtgagatcgtacttgttgggtatatattaatgaaaatggaggaacaatcaacatctcgctcatttgttgtttagtgggaccaagaaggtctgactggatatattacaaggacacacgtttttttaaaagaaaaatcaaagagttacatgtttctcttttgctctatggataaccaagtaaactcgaaccacttgcatccctcttgccgttttgtatgcttgttacatcaatcctagtgggcatgcattacagtatgttttggatctagcatgggttttctttaaggttaatttgatccatgtcattgcaactatgtcgtattgaaaaaataccactactattcacaaaatcgggtagatgtcactacaatcttctaaaatttgaaccgtgccattccatcacgatttcttttatctccgtcacactttgtgtcaccgcatcttcattctaagtcaatactagtcgtctttgtctccaagtagtaagcccgcaccggaggctggccggcgagctctgggaaggctaggcggtggtcgtgggtggtgatgactccatgcaatggtcgtggacggcacttgctgctccgcgcctatcccttcctccatggcgaggctgcggccagaagacggctgccttcgactatgacgaggcggaggtggaagtgctcctccacgcggcgcagcagatccccttgatgctgaactcatcggctgcttcgacacgctcatgtcccaaccatcggatccgaagccgaagcggcctgatgctctccccaccgccaaggcgggatggacgaaatggaggcgtgttttgcagcgttgaagggggcggcatggctggagaaggaggagacaagatcatggttggcaagctcgggaaggaactctgcatgcgggacaccgagctccgcgctatgcacacactagaggagcacgtccagccgaggagcactctcgccgcgctcaacggcctccacctagatctctagcactggcgttgacgggctagctccgttggatatggccggagcgtcgtgcctcgtcatgtgcgtgctcggcctgcaactggagaatatggtcttgtgcggcaagctcgacttcgccgtgccatctttcggttcgagaacaagttctccggcaggagacagcaagggattgaggagagagagctgtgagggatgtggacggaggagatcgtcagtgagggacaagcctagagccagcggtggaggtgcgggacaccgagctctgcgctatgcacacactagaagagcacgtccagacgaggagcactctcgccgcgctcaacggcctccacctagatctctagcactggcgctgacgggctagctccgttggatatggccggagcgtcgtgcctcgtcatgtgcgtgctcggcctgcaattggagaatatggtcttgtgcggcaagctcgacttcgccgtgccatctttcggtccgagaacaagttctctggcgggagacggcaggggattgaggagagggagctgtgagggatgtggacggaggagatcgtcagtgagggacaagcctggagccagcggtggagggatggggctggggacgcgagacgaccatgtgatggggatgatgaaaatcatgatggagtggcacggttctaattttagaagattgtagtggcatctacctggtttcatgaatagtagtgatgttttttcaatacagcacatttgcactggtatggatcaaattaaccattttctttatcaagttaaaatgttgtgtgaacatagattgtttcctttgcaccaactaagaatgcacacaactatatataatttatgagcaccaagattaatttggggattttgttatggtagaccgatactttgtgaaccatccatcttattattctttattgatccgatggttaatgttcatcttacatcataggaggtaagacgtcatctacaaccatgtaaagttaattaatctcaatcttttactacaggaaggaaaggagcgatgtttacttgtgtcactataaaaaaccattactaatacaataagaattaactagtaatttcatttttttattattactagcaatagtacccgtgcgttgcaacgggaaaaacaccatttgatattgtgacaccttgaaaacctcaaataggtaaaaaaaacaagtctaatttgatatattaacaaatagatagaaccgagtctaatttgatgaattagcataggatttaggatttagttttagatttatttttcgagccttcttaggcgtttatccgacggactttaatttaaaacatctgagccacattgtttgataaaatttgcattcggcctaggtcttctcatccggtccaaacttgggctggcccatcttcgtcgagctgagtcaattcgacagcccgcaagctgagcagctgagcgcggcccacatatgcggggacagtccgatgcacttccgcggcccattgggcacagtgtaatcggcggtgccggtctgacgttgggcaaatctgagccgtccgatctaatggatgctccgatcgtccccgtgctagatgaagcgccgaccgggagagaggggcaaaaccctagctcccaaatccctctctcccgatcctatttctctccggcgacgagcgagcagaacaacagcgaaggcagcgacggcagtccggtgagctagtgagcgctcctgcttcgctggctgggtggcgcacccgagggtggtgcaaagttgtgccacggtgttggaggttcggctaggcaagcgcgcaaacggcgctgagcgctgagcggcctggacctttaagattagataagattttcacggacgacgaaagtaaattgaatcaaactttctttttttttgttttatgttttctttcgcccttttttcgttattacagaggacagaaacgattagtagagatagagatagagaagataaagaaatatagtaccatgtcacatataataggattcgattttttttaccgcgtcacatataattctttgtttaatcggacataattcatttttataattgttttccaccctttttttaccgcgtccacggaatcagatttgtttttttgcccggtttttttcacaagattttttttctcccgattcttttttttcgaataggacagattggttttttttttttgcctttcattacacggaatcgtcattgttttttttgccccttttttcgcccggctttttgcccgatttcttattttttaatcggacagattgggttttttttcgcccttttctttacacggaataggattcgtttttttcgcccttttttcattcggttttttttcgcccgatttttttttgcacgaacgatggaaacatttcatattttttaagtagtagagataaagaatcggacagattttttttaattttttttcgtcctttttttaccgcgttgacggagttggattcgtttttgtttatcggacaagttccatttttttccttttttcgccccttttttggatcggacaggtttggttttttttttctttttttcgcccggttttttctggataggacagatttggttttttcgcccggttttccttttttcacctttttttatcggacaggtttggtttttttccttttttccgccatgttttttttcggacaaatttggtttttttcacccgattttttttacggacgatggaagcacctcttattttcttaagttgtagagatagagattaatatttaccagaaccagattacaatattgatttgtctttacttacaatttgtagtagaagttttcaaatattttcggaattttaaggtaatttatttattttcttcactcacagcaatttgaagagatgtttaactatggtctcttctgataatagaatctatgtagaccgtttatcttttctaatccaataaaccgaatctttttatactactacaataatattttttatatatgtagtatagaactcataaatagtaaaatgagcgttgttcaactggttaggtctattttgatggaaccagtctatctgggttcaaattctaaatttgagatggatgctcacatttacggccaattattctttcagtggtaggcgatttacccgtcagagacgtccgtgatgacggctataatctcaagatatatcggtccatttttcggaggtgctcataagggtagggtatatgtgtatgtgttcatagaggtgcgcgcgttatgaacgcccgtgtttggattgtgttttaaaaaaaattcataaattaaaggccacctcaaaggtactcgatgatctatacagactatactcgtataatccactctgaccttcgcccccctatggttacctatttgattacctcattcctgactactgaaaccatctttacttctctcttagcgcaacttccagtggatatatcaaactctaaacaaagtgttttaaaatgtacagtagtactgtggaagtgttctaaaacaaatttagtgatgtaactttcgtatatcgaacactccatgtacaaagttttgaacgtttgaccttttgcattctaaaacgttaatcaaaagaaaaacatacaaacagtacaactatttctaagtatgattgtgttctaatccactaccatatccaccaaattaaatgtgttctcaatattggtccaatttttcaaaatccagagaaacatcacacaattttggcaggcacaagaaacagagtattgtttgtgaagggaattttgttaagggcatggccacatataattctttgtagcttaaaaccctaacttttcccttggaacattcaagtgatcaaacaactggtgacccgatgtttttaaagattggccgacctattttaattcagaacgagaagataacttgtgttgttagctggattataggccattatgcttattaacgataaaatataaaacttttatacatatattgtcagtaacttaacagctagtgttgaataataaactacgaggagaaaaacattaaaatcaacttaaaaacaatagttaaattttaaattttaaaaatcatggctaataagccgaagagcaaacgatacaaagattttgcttgcgaggcatatgatggcacattcgctccttgtgataaggggaggcaggaacaaactttcattagttgtatcatgagacaacttcacttccaatgcatccggcatccctagacaccaagggcggcaagcgagggaaatgcatgaaagcggagatgaatgggacacaagcagttaattaggcacatcgctttcggtttgggcattgtgcgagggccgctctcgaataggcagcctgtgccgttgtctgttcttcacataacacccgttcttttcgatagcaactcgtttattttttttaaagagaatccatttctagctttcttcacctcgcttgattgtaaaatccatcgatcagaactgtctcacttttgtttctttcacggttcaccgtggatcctggctaaaataactaaagcaaattggcgaactggtttagttcaaggtctctgtacccagccgaagtataacagaaaatgtgaaactgcatcctacagtttacaagctgagatgtacttggtactgcagtggtaagaggaggtatttagcttcctcgcaaaaccagaatcccgtcagtgatatgtgtaaactcgaaataatgataaccctattggttagctgattaaactagaaataatgagctgcatgggtcttaacgagtcgagtagtatattttagtgcaaatgataaccccatcagtaatctgtgtaattaagcaagctaaaattaagctgaggtgccgtagctaaacgtaatacttcctcaatcccagtttgatcatctctaatagcaaagataatactccctccaccccaaattaattatcatatatatttattcaccaagactaaagataatttaaatcacatcaatcaggacaccatacacacattctcccacattacatgtatcgaaacatcatgctaaaagcaaggataataatagagctcacttcctactattagggcacccataatggttatctataggctctctacaagagatccatatcagcatattttcctatttgaaagatattaaataaagagagagagatcaaagctatctactaacttgaagatagtctatagagaaaaacgaggcaatgtattagagagctatagatacccatatagacatattattgaggtggtttactattaatctagtctattgctgagatgtacatgttttatagagagcatcttactttaccattgcgggtgctcttagctaatcttaaagccaacacatataatagattagctataaggttggctacaattttcttctcatctctctatgtctcacttatacattaattgcatttgtcttggagcttgtgttaagctagctcttgcatgagagccaacacccttaattttttgttatatctctcctccacataagcttatagtagccttatagctcactattatacttgctctaagagcaagtttaatagtatagcccactactagctctatatcatctatagtcaatgtaatagccaattcatacaatagttgcttactatactattaatatttggttccacctatcatacacacattacatcttggagtccatactgtagctggctatagatctgtagcccgctgctcttctctctctttctttatctctctaaaatatgtttatagctagcttatagactgctactatacccgctctaataacaccatagcatgtacacattctccaatgctgcattaattgtgttccgatgaaatacgagtccatacggttatatcagagtaagtacaatagcaggctataagccagcataactacataacgagaagaaaagagaagagagaataaagcgggctacatatttatagctagctgcaaaatggactccaagacgttgtgtgtatatgagaggtgggaccgggtattaatggtgtagtatatttttatagataactattgtatgaatgggttattagattagctatagataatttggagctaatatttagctatcatgaccaatttgagaaaatttgaattgcattatatgataatcaatttaggaaggagggagtaatggactataaggtaactatatacttatatgaataagagagataataaaaaaaataaaagatgttggctcttatataggagctagctttgcacgtgttccaagacaaatacgctgaatgcataagtgaaagtaaaagagaggcaaagaaaatttaaaaacgcccttatagctaattattatatatgttggttttaaaatagactaataggtggcagttaactctactattaagcaaaagacaccaagactaaggatgctaaaatattcatcattcttaaattaatctttatcggttaaggtgctatatcattttgtgtcccgtagttttactcatgctttaaatactgtatgtcattgtgcaaaaaaaaagttagtcttagttacatacgacgtattcaatgatatatatttacttttgcgcaaataaaagaaaagatacttgttaagagatgatcaaaataggataggatagaggaagtgcaatatatgatttttctattaatccatgatgagagagagatactttagaaaattcactcggcggatcatcgaatctccctaccatcagcccaacgacacgttaatcacacagccaagatgctctcaataatggccccatttgccccacgacgcaaatttcccaacgatggaaaacaaaactggttaatcacattcgcataacaaaccatcgatccatcgcatcacatggcagcagagcgcagcggccggccattggtgaatccggcggtcccccgtgcgggatgctcaaattcatcccagaaactgaacaagtatgtccacgttcatcggcaagtccagattcatagatatttccagattcattgtaatctagtactaaatgtagtaacatattatagttccgatccgtaaatatatctagattcattgtattagtaagtgtcacatctaatactccctccatctagttttgatagacatatttttaaatctgaaaaatttatttttgatagccatattttaatctaatcacttaccatcttaatgattttctcggatttaatgcgtggctctccattcttgcacacaagattggctagatgggcatcgagaaatataaatattaatgaatcgtttgtttacaaggaataactagtagtatatttaaatatatgataagcataattacttatttttgtcattgtggcaagataaaatatgactatgaaaaatagatagatgaagcattatagcaagtttaatagtatagccaactactaacttcaaattatttatagtcaatgtaagcaagttcatacaatagttgcttactatattattaatacatggtcccacctatcatacatacattacacatcttggagtccgtgatctagttgactacagatttatagtccacctctctctatttttatctctttaaaatatgtttatagctagcttatgatctgctgttggtctgctgttgcagctgctcttaagagagggagtagcccccaccaacccctccccacggtgcagggctcaccctcctgtccccagcctcacggcacccttgatccgtgatccgacggcccgatccgtggcatgacgcgcgcgccgggccccacgctgactagaccgccgcatccgaatccccaagaggggattatcctctcgcgcacgaggccgctcgaaccggcgcccgccacgtgctccccccggcgtcgcagacgcgaggccccggagccgcgcgcgccggctataaattctcgtcccgcatctcagcagcgcacagcatcacactccccacccatacgcatccatccaccgtctcaatctcggtagtaatcctcgcggcctcgccgttagttccaccaccgggcgccaccatgtgcgggatcctggccgtgctcggcgccgccgactggtcgcaggcgaagagggctcacgtcctctcctgctcccgcaggcaagcacgccacacacccccgcccgcgcgctgtacatgcacaatatcttaattctcttatccatattttagccggacgcatgcatgatgatcatcgatcacgagggtgatgggtgatgaacgtgccggtgcgacacatgcgtgcgtacgtgttcactgttccggtcaccaacttgtcatgcacccaccggctttaccgctcttgaacttgctatagtgaagaggcgtagggatcatggggggtgtggtggttgttgtggttttgtccttgtttatgtatttttgtctctttgtgaggggttcgcataggaatcgtaaggatatgagacagtaataacaaaggaccgacccagaaaaaaggaacacgggaatcttcgttgtgcattaagacccatgggtttagatgttatttttcgctgttgccgtgatgcgtatacttgcatggttcttttggggacggattggttctttctgaccgggagacttggtccggtgtgatattgtaggctgaagcacaggggacccgactggtccgggttgtaccagtgcgagggaaacttcctcgctcagcagcgtctcgccatcgtctccccgctctccggcgaccagccgctgtacaacgcggaccggaccatcgtcgtcgtggtaagagaactaactcatccatcaatccatcgtcagttcgtcacatgtgacaagagctgtcacgtctatctagtttgctgtttactaaaccttttgtgctgggtggggatcgaattgaaggccaatggagagatctacaaccacaagaagatcaggaagcagttcgcctccaagcacacgttcagcaccggcagcgactgcgaggtcatcatcccgctggtgagaccgaaatccgcccctgcggaacgtaatcaaggagatgaaaacgattaaacgtagctggatgtactgatactgacgttactgcttttcgctgttgtgtgatgtctccaaaagtatgaggagtacggcgaggacttcgtcgacatgctggacggcgtgttcgccttcgtcctctacgacacccgcaccaagacgtacatggccgcccgcgacgccatcggcgtcaaccccctctacatcggcaggggcagcgacggtacgtacgccgccgtgtaccactctgcttcaattcttcacgtctctgctgtgaccggaaccgagagagagagacttgacttgagttcactgatgatgtttcatctgtttttctcgtcttcttccttggctgtcgccgtcatgcacaggcgccgtctggatatcgtccgagatgaaggcgctgaacgaggactgcgtggagttcgagatcttccctccgggccacctctactccagcgccgccggcgggctccggcggtggtacaagccgcagtggttcgccgagaacgtcccggcgacgccgtaccagccactcctcctcagagaggccttcgagaaggtgccaagctataacacactgacgagagctagctaggagagatggccttgtacggtagcgtgatggtgaccgacacctctgacactgaccgtgacgtacttgctctgctccgctgcctttgcaggccgtcatcaagaggctcatgaccgacgtgcccttcggcgtcctcctctccggcggcctcgactcctccctcgtcgccgcggtgaccaagcgccacctcatcaagactgaagccgccgagaagttcggagctgagctccattccttcgtcgttggccttgaggtctgtggctttgcccatagtttttgggacgacttatcttgttatgtcgtcttctctaagaaccatggaaagtgattttttttttggcttgttcttggacgtttcagggttcccctgacctgatagctgcacgagaggtcgctgaccacctaggaaccatccatcacgagttccacttcactgtccaggtaaaatgaaaagaataaaaatgtaggagtagctgtccagtgcaatgatcgacctgacagaatatccagcttgaacagctcacaaaaaataaaacatgtctcctaagcaaaatttcagataattaaagattccaatcagaattcgtaaggcaaaattttgccccaaaccatatctcatatggataacggctgggtcagaaaactgacagaaagatgaaatatttggcctttcttaggatggcatcgacgcgatcgaggaggtcatctaccacgacgagacgtacgacgtgacgacgatacgggccagcacgccgatgttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgcccccaacaaggaagagttccacaaggagacctgccgcaaggtagcaaccgctgacactacaaccgcgactaacagaagctgttgctgaaattcctttctgatgctggcacgaaactgtctctgaattttctgactctgatgtacgtgcaacgcaggtgaaagcacttcatcannnnnnnnnnnnnnnnnnnnnnnnnnnnnnnnnnnnnnnnnnnnnnnnnnnnnnnnnnnnnnnnnnnnnnnnggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcacatactgtacannnnnnnnnnnnnnnnnnnnnnnnnnnnnnnnnnnnnnnnnnnnnntggcctgaaggctttcaccgagcagcaggtactaattaccgaccatttccctgtgtcctgtcctataaatcgcctaattaaattgacccccgtttactctgtcatttcttcaggtcagtgatgaaatgatgaagaacgctgccaaagtgtacccgcacaacacgcccgtcaacaaggaggcgtactactaccgcatgatatttgagaggctcttcccgcaggtgactgatgtgtattcaagcgttgtacagtacagtgtagtactactacacttgtactagtactaatttggaaccgtgtgctgacacatggtgaaacgcgaatcttgatgcaggaatcggcgagggagacggtgccgtggggcccgagcatcgcgtgcagcacgccggcggcgatcgagtgggtggagcagtggaaggcgtcgcacgacccatccggccggctgatcgcctcccacaactccgcctccgcctccgccaaccacaccaaccacgcaaacgccaacgccaacggcaacagcaacggcaaggccaacggcaactgcgcgatggcggccaacgggacgaacggcgtcggcctggttgtggccaacgggacagccaacgggaagatggaagcataacgctcgaagctggccggccggacggccattgatcgcgctagccgatgagatcgtcgacggccgtgtggtgtacactaaaaaaggataaagctagtactagtaggtgtgcgtgttttctcaccaatcgcccatgacgttggcgcgttctgtagtactacccgtgtacgtgcgtgtttgttgccgctgctgttgtaccgtctccccttgtcgttgtacgtgtgcgagagagaccgatccaagtatgtggagagtgatcgatcactcatccgaactcatccttgaaacgatacaccgtaattaatatatctcctcatttttcgctgtcattatccgtatcctttgtccgctagctgctaccactagtcactagtgggcttgcgttgcgttgcgtgcttgtgacttgtgagagccgagaggctaggctacaagtgggcgtagaggagtcggttccatgtgtccggcacgccggggatgcaccagtggatgcagtcggtgtagcgctgcggatcggtcttctcctcgtcggtgacgaggaggccgccggtctcggtgtagacggagacgtgggcgtcgacgcggtgctccgtgagctgggtgatgttgagcagcgtgacgggggtcctcatcctgcccagcacgtcggacatcacctccatcatccgacggtcggagccgctgcctcggtagccccgctgcgtgatcggccacgtctcgttgtagcacctgattcctccttcccttccccagtcctcgctcctggcacacggtacacgatattttaattacacccttatcaatcatcgagcaagttggagaggatgagtatgaatgtatgatgtgtgtgcctcatgtgcgtggtggagatggacatgaagaagacgcgggtggtggcgggatcgacgttggagtcgacccagttggcccacgtcttgaggcccagccggtacgccacccaggcgtccagctcctcgtacccatcgtccccgaacgatccccacctaagaaagacgtgtcgtgtcggtgtcacggggtgtggggttatttttgcttgttggacggcatcgagatttatcgttcgagtgacgggtggcttacaccgatttgatcctgtagccggtcatccaccagacgtagctgtcgaagacgaggatgtcggcgcggcgccagtgcttgccgtgctcctcgatggcgtcgacgtgcaggacgcggccgcccgcgcccagcgcgatgttccggtccgagttggactccaccaggaacggcgcccagtagaactcgatggacgcgttgtactcctgcgtgcagatttgcagttagccgagagctaattcgaggccttctctctgccggcggccagcgccgtcgtcgtcaagcgggtagggacgtactttgacggtgtagacggagagggtgcggctgcgctccatggacttggcgcccggggtgtccgggacggcggagttgacgaggcagacgaaggagagccactggcccagctgcagcgagtcgcccacgaacatgatccgcttcccccgcagcttctccagcatggacacagggtcaaacctgccatggtacacgatccggtccattattcttcagcaaagtgccaatgttggcccagcccaattacaatggaaaaagaggatactgtggaaggaaagattatagggaatatctttacggccctgttcgagaacccaacggagcggagataaagttttgaattttcatgacatgcttcttaaatggctaaacggtgcgtttcatacgaaaattttctgtatgaaagttgttctaaaatatcaaattaatccatttatcaagtttgtaataattaaaagtcaattaatcacaagttattactgtctcgttttacgtaaaacacttaattttcatcttcaggagattcaaagagagcctacgtcgtttaattgcatcctaaatcgtaataccagaaatctttacccttcatctttgcaaaaccattcaaatcgggtcccatagcagtattaaaggctgctttgactaacatagcttcctagccaacaaaaaataataattaaaagacatgtgggggcccacatgttagggtatgtaacatcccgcctcccccaagccgggtccacttacatctgatagcttcggtcacccatcccaaattgctctaggccaagcacgcttaaccctagagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccgcgcaactgcgacacacgcgagagtcggctctgataccattttgtaacgtcccgcctcccccaggccgggcccacttacatctgatagctttcataggtcatagactgccctcacagaccaaatatcttttctgcacactttgtcctcactcatgtgcacccgggaagaatttcccggtcggtcacccatcccaaattgctccaggccaagcacgcttaaccctggagttctttggagattggcttccggaaaagaagttgcagatatgagtattctattaattctattaagccctaggccgggatgttacagggtatttctatttcctccaaatccaaagcggcggccagcgctgataggaggagggggcagtggcggcaccttgccttgttacggccaagacggtgggagagaggagacgaggtgatggcgatagcatggaccagatccggtgtcgacaacgccctatcgaagaagaggcggcggaggtcggtccgagaaggaaccgacggtggagggtggctgacaacccagaggctagagaagagcgtcgagaccagtgtcctagcgaacggagaaggctgagtaggcgagggccttccaccaggaatgggcttggtggtggaggccgtcaactcgtggcggtgtcgggtagcttggaccggcggagttcctgatagggctggtacgtggagatgaggtcttgcaacccccaagcggcctcctccaaatcggcagctacctcgccttcccacgaacgactcgctggctcccttgcttgccacctattctcctccttggatcaccagcgatccctcgtcgtcgatcgttgacctcccacctttactgcctctcgcagataggctcgccgaccaccatccctctccccgttagcgagcttgaagagagagaaaaggtaggtggggaagagaggagaggtggaagtctacttagatgtgagccccatatatttttagttttttttactaggatgccacatctatactatcttaggacttgagttgaacggttttgcaaaggtgaggagtgaagatttctagtattacgatttatagggatgccaattaaactcgatgtaaagatgagggatgacaagtggacttattccagattatggggaccttggaaagaggcactaggagtatgacactgatgaacttcaaaatgccaaaaaggaaaggggaaaaaaaagcatagctgaataatctgagattataccaaattaagcaccactgaaattagcgcatacggttgcttgctgacctcgggagaaggcagtcatcaagatgccaatcccagtataggtagtcgctgtccggcctgccgttcctctggcaagagtcctgcctgtcaacgtatgggcacgtctggtccgtgtaaggcagtttcttggacctgtcgtacgcccagtacccatccgtcacgctgcaccgggtcgcgttgaacgccatcttcggcgctggcggcggcgttgccgttgctggttcgaccgagagcaccgctggcggcggcggctgatcagcagagagcaacgccgacgtcctcatcacggtccgcagcgacgttctcttcttctccttgtctgtcaccttctccttgacctctgaaaagatcaacaactgtcaactggagcactataacatgtacgctgcagaaggtggagctaggcgcaatgcatggatgcaaatatgcattgcaatctgcaactacgtcgataagtttatgccacagattgcattagtgttgtgagtgatgattagtgatgggtttaccagtgagaccccggaggtcctctgtaaagatgatgcccgcgagagccagcccgccgatgatcgccaccaccactgacagtggggcccgccccttcacgcgcttcattgcgggaagctgaaccatgtgagctcactacgtgcaggcagaggcactgatggttggcttcttccagagtgagctgaggtttctgtgattgcagcttcaggtgctttagtagcagattattggtacctaatggtgctcatgccggtgcaactgcagcaagaaatgtaattaaagtgagggaattatatgactgtactgtcagggacagagctggtgcactaggcacttgctttttaacgacctatttcacttgagtaggagtgaagcaaaggcaatatttggagttgagacagccaaccgaagcgtgagcatcttttactgtatttcactgtcgttgtcaacccgaaaggtgctgaaggatactgctttgaagtagaagtactaggcattatacgtgctaactaatctgatactgttccaacaaattgtgttctcaacgcctgcatcaaaaactgcttattggccctgagccactgagtgtttgcccaactgcttctgctgtagtgggcaggggcagcaagtttcagacctgagtggttcgaaagctgcagatcactaaatcatgctttgcacttatggaagaattgtacgatatcatcgttcaattatactgcctgttcagcgcccgatttatttatttaatcggttatattatgtggtaatgtagttgccttcatgctgtgccgtgtaccactcgagacttcgatctccatccgagaaaagtccaggtttggtccctcaactcaactatggcattgttcgtatggtctatccactttttttttattagagaagggcatttatacccgggcctctatatccaaccagatatatgcagtatttttaaattaggaacttagcctttaaataacccaatctaaatttatttgaactgtcagtacaacccctagactgcatgccctttcacatggtctatccactatacgaagctcttcattgttgatctctcagttcttgaaatcaactatatttcatccttagacctaaatcagggtagtttgtggtgtcacgtggcatctaattagcaattttaagtaaattgtgggattttctagatttcaggcgtgtgaaaattgataaattccatatacctaaagttgtatattgctaagctgaaaattacagatgctgcgaaaatatgtaactttagttcaatttaattttaatttagttgttatatttcgttttactttgttttttattaagtttgaattttgttcaagtagtttatttcgtgtataatattatatgataaaataatttattgtttaacctttcatctaaaaaagaggcatttttttaaaaaaataatgagtaataggagaatgatgagaaccattgaattatcattcaagggaagaaaaaggtggctgaaaattttgaaaaatctaggcacatcaaacgtaaaacattcccataactcgtatatataggatattggtgagaaagaagaaaatgagatgatgttgtcaggtagttttgtagagtttacttcgttttagtttttgttattatctataactatgttgatgtcagtggcgaatacaggatgtaaattgagggggtgctagtgtaaaaatataatgtgattaaaacaaataaagatatatcaactaaagtattttccaatgaataccaaaagcgcatatgatcaaaacaattttctctattttgatttgtgtctatcttaaaatattcataaaaatctgtgaatatattgttttgtatactcagagtatattctattttaccagtttggacagtagaagcagggaggaagcctgcatctttgccgtctgggaattttcttcagtaatgactaactagacttgttaatgattaattaggggcagggattagagctgggtctggcgcaccaaccagccccaacagtggatccgccactggttgatgtcatcactgttcactcatatgaattccatgtaggcatcataaaaaaccatctcagtttagatacagagataaaatgtgaatagttttgagagttaaagggaccagtggtgaatagttttgtagctaagggaccaaacactactaaaaataaaatatttttgcatgcggttgaaacctatttttccatgcggctggggccgtccgtctgctcggaaaggtatacgaaaatagcaattttttcatgcgagtgatgcacccacatgtaaaaatatgttttttacgtgtggatgcttatgtggtccgcccgcaaaaacaaaaacaatgcaaaaaaatataaatataaatcccaaaaatcgaaaatcgaaaccctagacatgataccccccactccttcgccatcgtcgttggatccgtcccggtcgacctactgttgtgcacccttcagtcatcgagagagaagaagccaagcgagagaggaaggagaggcggtgggatctgcgcgatcggaggccgagcccgccgtccccgagcccactgccgctcccgtcgtcgtcgagcccgtcaccgctagatctgctccggccggatccacgatcgacagatctgctagccatcgggattgaagacgatgagggagaggaaggagaggcggcaggatctgcgtagttggaggtcgagcccgccgcagccgctcgtcctcaccgacgtcaccggtactcccgcagcctcctgagccctcgttgccaccgccgctcgttcttgtcgccagcccgagtaggaagtgggagaggagggaagaagttggagagaaagggtggagaaaaataagtggggagacagaaggtgaggagatgataatggaactttggaaaattttaaaatatgctgtaagggaagagaggagggaggtcaaacttgtagataggtctttttcgtatgcggctacttaggaggccgcctgaaaaaataattatattttcgcagaagggcctcctaagcaactgttcgcatgcgacccttcaactaatccccggggaacgatttttgcaagcgagaacggttatgattcgtctacaacttaatgatggtcttgtctagaaaaatcaattctgtagtagtgaaaatcgtcccaaaactatatttgggggaacaaatttggacttatctctgttgtttataggttagacttttggagggagaagtatcgatcatgtatactatgtgttatttatgcatataaggtagtactatatatattatattaacgtacgctcctaggagctataaacgcattgtagttttgatatgatgttcgaccgatctgttggagagatcttggtatgttgtttgcttcgatgctttactgatcgattgggcctgttttacattttactttatgatgggggcctataacatacaaccatcttccaaagttgtgctttaggccggtacaagtatttttttttcatgtgattcttggtcagtgatcaatgatcagcgaacacacagcacttcaactaaaagctaattatttgcaggcaccattaaaatggatgtagtcaccaacagcaacctaatgagatttaccgatttatttataatctttttgttgtttaaacttgtgttgaggcattcacagtgatgagtgcacattcatcttgtatctattccatattatcgtgcgaaactcacaacacagtaaggcaagactttccctattttctaacgccataggccacatatctctaactcagtaggcacataaaaaataacatcaaaagtagcatgacgacaataaattagatagcatgaataatttttttacgagcttctttaacatatatacagtgagttatacttttaaaaaaaaatcgttgtaatacatggtcattatgctagtgttaggaaacaaagaagaaaattgaacgatactacaaatctccttatgagatttgcaggaaaaaatatatatatacacaaacttaagacaacatacttgacacgttctttcatattatcaggaccaataatcataacatctcttgatcaacatcaaactaaaaagtattctactggtacagttactacaatagtggaaaactcggatgagtcttctctgaaatgcccattagtcgtagggctcacatatcaaccactaaaagttagatatagagaacgatacataattagaggatccatttccagaaaactgcgtgccccttgctgcattttttattagttcaggtttgtgattttctttggcaacgaaaagatttggccattgccaattctccttttcgttgtaaggtgcatgtttggattattgcatttcttttggatatggagttgctgatattttgtttggtgttaaagagatactaaaattttggttacaaaccaaacaaatatatatatttttagaaacaaggaacaaaacacatcgtcaggtatccggccaatcgaccatgacacaaacaacgtcaaacgtagaaatgatcgaagattcggaatctggttagctggggcctaaggaaacaacgcttcaaatctacggaactggtaaagtaaaccagacaattattctctctctagctaactaattcctgtaggactgtacccaacaaaatagataggtcaaccgaatgatcaccagtgcacgtacttactccgtacaaggtttagtcgatcttgatgacaccagactcattcgatctcatttagttgctgttgctactactcaacttcagtctgcagactacagtacttcactgtacctcctacttgtttgcttgtctcagcccctctgtttagatgagactaaaacttttaaaacttttaagttcatatcatatcggatattttgatattaattataaatattaaatgtagactattaataaaactcatccataatcttggactaattcgcgagacgaatctattaagtctaattaattcatgattagcctatgtgatgctacagtaaatattctctaattatagattaattagacataaaaaatttgactcgcaaattagcttttatttatgtaattagttttgtaaatagtctatatttaatactctaaattagtgtctaaatataaagactaaagttaagtccatggatccaaacaccacctgagttgctagcgaataaggccgtgtttaattcaccctcaacttccaactttccatcacatcacatcatatctaaaacttttctacacatataaacttttaacttttttctaaactttcaactttccctaaactttcaacttttttcagaaactaaacacagcataagggtagatggtaaatcttactcaggtgctgacaaattgactgatcaaatccctgcggatactcccccgtggacgtgagtggcgagacatcacacgagagaatgcgtggtggtatgctcctctctgatttgcatgcgttctgtttttttttctcaaaatacttctctttgttctcctctctctctacccgcatcattggagccagaatttcgcgaaatggttcatccgctgtgtttagatccaaagtttgcctctaaactttacatttttctatcacatcaacctgtcatacacacaacttttcagtcacatcatctctaattttatctaaaatttaaactttagatggaactaaacacagcctagtatttttcttccggaacgcggctcgatttgtgaagtggcaagagagcgcgaggaacccggaaagggagccggcgcgcgtgctcgaatcgaatctctatgaaggccggattttccgttgatggcccaaaatcagcccattattttccgcagcccgtttgcggcgcgcgtgccaggcctgggccgtagtaggccgaatattttgcaactgttgacttagcacagataggtgggccttcgggtgtaaacgtggaaattttttttatttttaattttttttattaaaagttttacaaaaataatttttccattt

SEQ ID NO: 25241 - DNA, 5846 bp, Oryza sativa
cggcgagggggcatggaattttgcaggcggcccccttgccgccctccgcaagggcgattttgtactgtgctctatatttttgtataaatatcaatagttatcaaatctttttatattgaaaactatacaagattaaaatctccaagactggtaaaatacaattttattattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctaaataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtagactgtgcgcgctactggatctgacactaccgtgcagcgccgaaagtgtgttgtcatgagcataagttgttctagcaccatatgaatgaaaagaactatgtagacgagacaaacacaagtagtactgcagtagtaatagcaaaagtagtactactttacaagtttgtaagccaaaagaaacggtcacataaggactgaagaggtagaacactactgacgaggcctcttacccctatccctcctaccctgcgccctaatgtgcccgtgggagtacgtgagtcggtccgggggtacggcacggccaacccgtcctgcctgtacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacaaatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcccccagggcggcaagggggccgcctgcaaaattccatgccccctcgccgcccatttgcaggcggcccccccacagtacaaaatcgccctagcggagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcgtaaacgttgtaccgtgcggtagaccggtagttgatcctcgtttgtatttacaatgcacattatttttttcgtttgtaatcgtgaattgatctgagaataatcatgtccgaaaaaaaaaaacaaagggagttcgtagttgaaagaacctcgcgtgtggttattagcgatcaagtcaaatatcctctgttgtgcaaggttatcaaagatgtttagatgtgggtaccagagtcacaattatcagagtatttagcgacagatcacagacagatcatagtacaaccgtgtacactgcaactgcaatttggcagcgcatgatcaatcaatgtacattcttgattcttctcagagtctcatccatgtgtgcctactgtcaccacgcctcctcaccttcactctgaagattgttacaccgagcgatataaaaaaaaacgaaattaactgcctacaggctacagctattggtagaagagaagcgcatagaagagctggttccacgtgtccggcaggccggggaggcaccagtggctgcagtccgccgagccgccgccggggttggcgcgctgcgccggcgagaggtcgccgctgtacaccgacgggtgcgcgtccttgcgcagcgccgacagcgccgagatgtcgaggaggcgaacggggctcttcatcgaccgcagcgtggcctgtatcacctggtcctgccccgacgtcgcctgcgccgtcgtcgcgttcagccccgccgccgccgccgccgccggggccgtctcgccgtagcagttcttcgacaccgggttggcccactccttcgagctggtcgatcgatccagcggcccacggcacagatcagaacaaaattagatcgcgttgtcagaaaagagagtgaaatacaatacaccattgccacatagtacgagtgtactactgtacacgtgcacgcacatggtaaggtgtctagtgtactgtgtacactgtagagagagatggggtgatggaatcatgaggttgagatgagaatatgagattggctcttgtgagatttacctgtagtgtgtgggggacatggactggtagaagacacgggtcttggctggatcgacgttggcgtccacccagttggcccaggttgccatcccgcgctggaacgccaccatccggtccatgtcctcgtagtaccgcccgtccgcgcccatgtaatcccacctgcatacgtgaagtgaaacgaagctgaagaggaaatctggcgggtgcgtgtggaaaagggcgcgtatcacgacgtttacaataccgtctaactagattcaaaacgatcagaaacgatttgataccgatactgtaatttttgttggaccggagtaaatatcttacaatacatacccctggagcgtgccggtgtgcgtccaccagtggccggagttgaaggagagcacgtcggcgccgcgccacgcctcgccgttcccggagatgtcgtccagccatagcaccttcttcccctgagccacgccgatgtccaccaggtacggcgcgcggtagaacgataccaccaaaccgtactcctgctcgtatacatacgtacgtacgtacgtacttaccatgagtacatctatatgacatttgcagtaagatcatgcaagtgcaatagggaaattaaatacgtacgtaccaggaacttgtacgtgtagagagggtcgacggagacgagctgcgccggcgactgcggcgccgcggcgtgcagcaggcagatgagcgactcccactggttccggcccagcgagtcgccgacgaacatcaccgtcttccccttcatccgcgtcaagaagtccgcgccatcaaacctatagcaaaatcgcgcgtcgatcgctgcagctaattcgcgctctagtcgtataatatgcgttacctgggtagctcgcagccggccggcttccaccggtaccggaggtagtcggagtccggccggccgtacagctggcagttgaactccgcgtcgatgaccgggcagttgtacccggtgtacgccgccgcgccgccgccgccgtcgtcgcggacccagctgccgctgaagacgtcgcagctcacggcggcgtctttccggtggcggcgcgctagcccgaaggagagcgccgaggccggcagcgagaaggcgtgaaggaggaggaggaagacgatggatgtagacacggcgacggcaagaaagccggcgccgtgcttgcagaagagcggcatcgatggcgatgagaattggaggaaaggggaggcgaagccggcctttcccccggccgctttataccgccgtacgctgacgattatgaatcgatcacgagaccagcttagccaagattaatcgtcctacaattcctgctgtcgcaagcaagagaaaaggcaatatagctgccctaattattttgctgtgcgatccaagcaaggaagcgattaaccgattagcagcagctcgtggagaagaatattatcaccaaaccgatggattgattttttttttatcagcgcacggggcagttcacgtgaggggttttgcagatcatctttgtactagttcgcgtagctaagattggaacctgagcctcatatatttggattcgttgccttcgcggctttgccccatggtgcacgtagacggtagacgtacagggaaaaggtttggttttggaattcgtgttcgcatcaatatggaatctgtggaattcgccgggtacgtttatgtttgcagtttgcacgtagcgtagtgtcctagtccgtctcagaggcagcaaacctggggtgacaaaaatggcgcggcagaagtgaagtgtgcgtcaagacaaaacgattggctggagccttggatgtacatggagcttgtccatgtcgttaggcccagttcctgccttggccatcggtagtatatcatgttggatgtcggatcgggcaaaaattcagaagcagcggcggataaagagaacctgtgtgtgtgtggtatatttagcagaacagagtgtctgctagcaaggttgcaggagtaattaaccacggtgattcgtcccctgaacaacgtgacttgattctcccgttcctgtgctctttagatataggagaataaagtgtggagaatatatcttcttgggcgacgctccggtgctttctacttgtagtatatactacaagtagaaataatccaaaccgtcgatttccaagggcatattagtactatgttaggactacagttaggggtaaacttggtattaggaaaatattcgtgatttttattacgtttcaatcttgtatcgcatcgatccttcgctaactttagcactattgccgttgttgccctatttcggtagctctcagccggcgttcatcactgtcgcaacgctctgcttcgctcatgtctgcaggcaatttgtttggtaaatttctcacatggtaaatccttctagtattttggtgcgactccttgatggtattttcgtgaacgaaaatcttctagacttttttctagggaaaattttgctacatgacacttgttatgtgtgattttagcactaagacactgcccaaacttatttttgggggaaaacactccataaacgtggtaatttgccagtgaacaccgcgccgattaaaataatactttccggttggggaggagagagaaaccgcgtgaaatgtcaaaaatgcccttgggcccacatgtcagctctatctcctatctctctcttttctctcacaaatggcgaggacggtggctggcggtggcggtggacgagcgtgcggccgctggagccacccctcgccgtgcccgtgcccgcagcagaaaggggcgtcaccgccacagcgggggagggggacgcgatgtagagccggcgagtttcggggaggacgacgtgaagccaagcgagcacgaggcaggggaaggaacgacgagtgggaggtgggccggctacggagaagaagctcgttggcggccgcgcgagcaagatgca

SEQ ID NO: 25242 - DNA, 32409 bp, Oryza sativa
aggagaagctcatgggcagccgcgcgagcaagacagggggagggaccgacttgtggaaggatggccggctacggagaaaaagctcgtcggcagccacgcacacggggaggacatgaccggctatggtgcacgccggacgagatgctcgtcgaccggccgcgacgaggggaggacctggctggctgcgacgcgctgggaagagtcgccggctggctgcgcgagagaaaagagagagatgaggagagagataggagatagacctgacatgtgggcccaatggtatttttgacatttcacgcgatttctctctcctccccaaccggaaagtattattttaatcgtcgcggtgtccactggcaaattaccatgtttatggaatgttttcccccaaaagtatggagtgttttcccccaaaaatgagtttgggcagtgtcatagagctaaaaccacacataacaagtatcctatagcaaaatttccctttttctaaagaccatctggcgttagcaacactcaaaacattaccattatcctgttcaaaattggaccatgtgtagtacactaccgataggtcattggggtgacatcgtccaatctcagaaagagctgcttttttactgatcaactgttttgtggaaccattgacatttacacatgcacacggagcaactgtatagatagcacttgcactcattcaccgaacatgacgtcacaagggcaccagaacatgtaagcatagttgagatcagataaaaacatgattttaaaactatacaattcaaggtcctaggttttcctatgtgcaaaattacaaccttatcccagtttcgagccaacatcaaagaagtcagagaggcattggatcaataaacatgtaagcacagttgaggtcacataaaaatatgacttgtaaaatagtacaattaaagtcagaggtaatatgggacaacactccttgagcctcgcattggcatctggttattctcctttcttctctagtcttgataagattagaaacagcttcgagcctccctcaagaaactaaacaaataggagtgcttcacagcaataattgtaagataagatagaaaatattatgagcaactaatgttagtcaggccacaggtaagataagtagctgtttacccgaaagttgatccggagatgcgttgcagaggcatcggagttataggatatcatcctgtatccaatttcaataataacatgagtaaactcaactccaaacaacatgcacggtgcaggaaatggatgccagataagaggtaacaatgctgtgaggcttgcctacgacacgagggagtggacttcatcagggtactcaacagaacacatttgttagctgtaatggaattactataaatttttcaatatactagttcacaattcagttgtgagttgtaggatactagtattttctggtaaagaggtgagggcggcggacgaggcgaggacgttggagccggcaaggtcggctgaggcggcaatggcgggggaagggaggagccacgaggcggggtcgctcggcgtcggcgccggatgcgatttgggacttctcttcgggcagcggcgtgaggaacaaatgacggaggaaagagcccggctagggttagtgaatgtaaaagatgattgtacccttccgcaaatatttttttcatagacaataataccctccatgattttactacccttaagtgaggtggtagtagaaataaatctgaaaccttggattaaatgagatcaacgatccaaattactttctactccaagtagaaagcacttccaagtaaaaagcaccggagtgagactcctttatgacttcgtcaaccagcctccttttggtctccaaatttatactccctgaggaagacagaacattcacattttttgcaaaggtgataaggatttacgtgcctttcttgcagaagggcgccaattcactatgacagtaaaaagaaaaaaaaagattggccatctttcctccgccccttcccttctttaaacccagattccaactccatatatggacaccagtttgatagtgaggcaagtagtattttcttttctttgtagatttattatccgataccttatcaaagaacaaaacaaggaattaaaactgagagttagcatggcctctcatttcccgtacttgggtggaaatggaacaaagtgacgaaagcactcattctatgagtccatctatttctatcaataactcgtactccctctgtcctaaaaaaaaagattcctaacatcccaaggcaaatttagtggggagtaaaaatgacccaaataaccctcatcaatagaaaatgtagtaatagtgataggtaggtaaatgatatttaagggatataacttctcgttttatgtgctgaagataaattggactctagaagttaagttttttttgacggagggagtatatagttaccctcacccacagataaatcaccatcaaattcttgagtaatgcatgaacgcgagtgtttaaacagagccgatcctgtttatccatggaatagttaagaaccaaagcttcaatcagaagcagtcaagtacggagtcgagttcgactgatcctctttcctacaagtccactgtcaagaactggttccagcagtgcggaaaagcccaacagcgaaaggctctcgaacacctatgggctggggccgcgcctgtcggtgcgcgcgggacgggacacccataggccacagcccagcgtcgaatggccacagcagtacagcccaccacctatgggccatggccgaattccacggatttccgtggatgtcacaatcgtccgtttcctactcggaaaaagtacaccgaaggtccctcaacttgtcatcgagttacaaaatcgtccccaaaccgcaaaaccggatatataacatccctcaatcgttcagatccttcggtggtttttatcccggttttagccgacggggcgactgagtcagcgtggaacccacgtgggccccacttgtcaggctgccacgtcacaccccctctctctctcccctcctctcccttcctcctttctctctcacttttcacctcaatgggcagccggccggcgggtggggagacggtcgccagggcaaggctggagaggatgtccggcggccggcgacgcgggagaagggaagggtggcagcggcgggagcacggggggagatcgaagaggacagggggagcacggcggcggcggcggcctccggtctccccgacctcagcccgtcttcaccaccgaacgccgccgccgttcttctcccctgctgaccaccggccacgccgtgagccaccaaggtcgaggacgcggcggccgagcgtggaggagcgaagggtcgaagcaaagcccgtcggtgcagcggcgaagaggaacccatcgaggagtgctaggaccacgtcggcgccgacgtgcacttggtcttggtgaagaaaacggggaagcagtcgtccccatagccaggccgcctccacacccatcgctgcgacacgcgcctccgtgccaatcgccgcggcgcccgcctccgcatccaccgctgcgacgcacgcctctgtgccaaccgccgcggtgcccgcctctgcactcaccgccgcagcgcccgggcccgcctttgtctctgcgtccaccaccgcaatgcccaccgcggcgcccatcgacgcccaccgctgcgtcgcccggccctgcctacgccgactcgtcgtcccccgcagcggcgcccgtcaacgcccaccaccgcgtcgcccggctccgcctccaccgcctcgtcgccccccgccgcggcgcccgtcgacgcccaccgcagcgtcgcccggccccgcctccaccgcctcgtcgcccgccgccggacctcctctcccgccttgccccgacgaccctctccccacccgctggctggctttccgttgaggagaaaattgagagagagaggaggaagaagaggaagggagaggaggggaaagaaagagagggggggtgtgatgtggcagcctgacatgtgaggcccaagtgggccccacgatgagtcagcagtgacgtggcctaaaaccgggttcaaaatcgccgaaggacctaaagtgaacggttttgtaagttgagagatatcaaatttccggttttgcggtttggggacgattacgtaactcgatgacaagttgagggacctccggtgtactttttcctttcctactcggttcgtcaaccggcacacgatgacacgaaaggagcctgcacagcagggccatcgaccatgcgacgaggccttcctggcctgcgagaaaggagcaaaatattttttttcaaagtaatacatactaaaagaaactcatccgagtacatcttttatagcatggcatatagatgtttttttttttactgaaatggcatatagatgttagcgcatgataattgtcacgtggaaggttgcaagggggctacctaaaaaatagccaaccctccttcgcgtagccgttagtacgagctaacaaccatgtgccatgtcataaaaatcgtcctccccaggaacattagtggatggatatgtaatactttgaatttttttaaaaaatatttgaataaataaaaaattcaataccaactgatgatttctcgagagcacaagaacattggtaagtgcgattttcagtgtcacggttttattaagtgctcattgctcccataataatgtgaaggagagagagagagagctgatgttggggatgtactacctccattctacaatagttgtcattttagtattcaaattttgtcttaaaatagttgtcgctacaaactttaatacggagtacatgttaaatcaatcatctttcagttaaatttatcccaaatctacccatgattatccttaactttcaactacataatatttattaagggataatataatattttttcttaaatcttaatttatgctaaataatatagaataacaaatgttttgggatggtggaagtatgttaatttcaatcccattacaaaatatcgtgtttctttcgttattattgtgttttgagcctttgaatgataacacctcatcggactagtagtatagcactatagctaaacaaaatcaaccactatatttatctgtgtgtatcactgaatcatggtttgcaaatgtgataatcagaggatggatgactggatgcatgcttgaaatagacctggttatctagcttatatatgctcggaaagttttgccaagtgtgatgacaaaccacacattgcggtgagctgtggtatgaaaataagacatgacaaatggctccaattccttgaaaagtgtggcacaccataattatagcaacaacaaaatactatactaattcggtggtcagaagtgtggctctcgatcaaacaataccttattctcaatatatagacgaaacaaaattctgtggtaataatgcatgtttgatgtgagatgagatagtcgggaattaattcaaagtagacaatagcactgcatagattaaatggactcaattctttttaacaacacaaaactaatcacactttaatatgtgcgtagaacctaacatgatattggccaaataacctcaaaatcatatcaaagtgctatgtaatgttcacacaaccaataaaaatcagctatccaccttctttcttagttatatttttcttccctaaactctaagtgataccgcctctaccattcttagttgatcctcctcatatactgctacatccaatgagataaccttcgaggccatctctattactggatgagtttaacggccttatcacctcttctcatcttagctacttcgtctcctactccgcttaccctaaatattgtcaccgatgttctcatatacaccacatatccgtagttctacccacgatgcaggcagctctaccgctattcaacacgattatttgagattaggaatgtgctgctcatttccgtctcttttaaatttttgaatgaaacctgtccaaattagacgattattgatgagcctggggacggaagtgtaagacatgaaacattgcagtctgcggggttcccaaaccgccggggccggggttaccgcgcctcgacggtaagcacggttaccgcgcagtaactgtgaaaaaaccgtataaaatttatcaaaaaatcaaattattttttaaatttatttaaatgtaagaagattaccatgatatttatattaccgtacccgcggtaagcacggtaatactgactgtaatgtaaacctgctgcgggtccctcccaccccgatccccaactgatctgagcccccaccaaataaacccaagggaccacgtgcaatcagccatttctcgttccccttttccttctcccgtcacggatccggggggccgggccaccgatccaaacgtaaaccgagcgcgcacacacacacgccacgcgcctcgccgccgatggcgacggatgccgccgacgaggcgccgctgctcgccgaggagcccctccgccccggcgcctgcagccgcgagctcgagctgcgggagttccgcgaccgctacgtgatccgctcggtcgacggcggcggcgccttcgccgtctcccgctccaacggctccctccgccccctctccgcaggttaccacttactactcctcccctcaccgtgaagcgcgccgccgccggaatcgttccgtgcaaagcaaaggggaaaacaaatcgcggctatgttccggttttgttggttggtttgagtgctgggctcgtgaaccgatggtggttttactaacctgtgcatttgttcgcgtgcagaggaagcggctgcgggaagcgattgtagggtgtcgaagatttacggagtggctggcgtgatcaggttgctcgccggtgagtcaccatttctatatagcttgtggtttttctcacgtacgatttggatagcttcgtttgtagtttttgcctgcacaatagtgatctgatctaaatttgcacatggaactgatttatcttgctgtactcatattttcctcatagggagaaacatatggatgatgattgtttgcttagatgtgcttgttttccctccatttagccatgtacttatattaatcattactgtttaactcaagtttattcacccagtgcttgacaagcaatttcagtttaaattacatcgtgctaatgaaagttccaccatacaaaatcacatggtctgacacttgaacctcctattcggtaattaattactaatacttgttggtgtcttcaaatttagatatttgcctagcactaactgtatgctgggaaacttctgcatttcaattagattcattctaggttttacacttgaatgtagtttttattatacatactaattccacattgtcaggaaaaatataaaaaaggattattagaaaatttattggtccaacaaaaaataaaatccaaatactcacttttacagtgcaactaattactgttttgctgagagtatgacagtgcagcatacaaaatccatttgctcaataattgagcatacattgcactgctgaagataatcaaacttatatctggtagataaaaatctggaaatatttttcgcttggaagtatttgataaaggaaaatgatttccttatgtctttttgtaaagttctccatgttataattgctaattttctgtccttttttttttggaaattataattttatgcagcaggctttccactttccctttttttttatcaggaagctatgtacttgtcatcacttctcaaagggacgctggttcatatcagggatcccctgtttacaatgtgaactcgatgaaattcttatgctgcaacgaggctataaagcatttaactgcacaagaagtatgacaaaattgagtagttagcatccaattttatccacattgtttgggcattgtttatctttatctggtatttttggtcacagtatcataatttgtgtatgccatcttattgcagaaaagggatgaggcatatttcatgtctctcctgaaaatcgcagaaactactcatgggctttattactcttatgacagggatttgacactgaagtaagtatcaagttatgcatgactgtggataggtcaactaaaatatctatctgttcacatccttgcaataaactttgtcactagttattttctgtcttatgagttattacttcgtagcttgcagagggcatcaaagttgcctgctgggcgggtacataagccactctggaaacaggttagtgatgattcactccataatttagtacatactattttcctgggtatttgagtcattatggctgttatctttgagaaaatctttatggttgttctcttaagttatttataatactctttccaattaaacttgcattgttttttgcatttgtaagtctgattaactgaactcatataaatggctgaaatcttgtgttgcaaaatgtaacaaaaatgcaaagcctgaactgtgtaaggacttgggatgtggagatgtaacatctaaacaaatcagatgcaattttgaccattacttttcaggtgtaattttctcctgtccatgcttgagaaaaagaatatctttgagcattactttttgtaaatatattgtcgttagagtttataaatcctataatgctatggaagtattcttaatgatgaatttactgatgtagttctcatacatccaactttgatagttttaagaggaggtaaatttagaatgtttgacctcatggattcttaattgtcagtcaaaaaggaagagagggaacaactacttttatcatttaatctgttctgttggcattgtgaattttattgattcttgattgagctgattttggtatactgttaagtgctagctatatctgttctaactaccattactttatacatttcttaattatacaaaaggatttgatgaacgggatgtgtgcatttgttagagcagcttctgcacacagacctgactggtgatgcatttaatacagagactttatctatcattatgtatgctcgattgcactgtactgtttgaagcttgacttgcaacagccacagtgagcataataattggagacatgctaagtcagaaaactatactagtttttttttttggttatgttacttataatcattcatctttactctgtttcctgacagttctttaagtttatatttcaggctgacccacgtttcgtttggaacaaaaatttgctagaggagtttattgaagcaaaagtaatcatgtttgactaaattaaaacatttatttatttatttccttttttacatctttgcttatttttctcccttttttctttttgcagcttgatgaatttatcatcccactggtccaaggaaatatccaaaatctcagatattttcactgcttatttttttattcttatctctacttttcactggtgtgtattgagcatttaccttttacatgtaacatcggtttctctgttttggacttttggtacccaggaggacagtataggatatacggattatctgtgtttagttgttgaaaatgtgtgatacagtgctcattgtttttcaatcatcagcagagaaacatgctttagcaatttgctatatccttgactatttaacgttttcagacagcgcaattttccttaaaggaggcacctgtcagaataacgttgttctcacgtagatgcaacaggcgtctaggttgtacttttttctcacctgtgatgtttcaattggaaagttgtagtatgagttactttatacaaacataatgatgcttttccaacttgtattgcatttacgtgcattcaacgcaggaacaagaatgtggaggagaggtgcaaatcttgaaggagccacagctaattttgttgagacagaacagctggcagagtatgaaggtttgatgtcttcatttatacaggtggcttcttgatactacaaatgaaatttcttgttgctggatgatcatggattattgacaagagatcttaattattaatatagaaatagattcaatggatatcagtgctagattgtatgttggtattcatattttttatacatactatcaagttgattcccaaagaaagaatgtcatcaatctatatcaacaaaataattgtggtgttcaatgtgataaaattggtcataaattcatattgttcaatatgaacaagaataagatagactctcctccccctgtaatccaatgttacataatttcttatcctcattcaaatattataggcttcatataatatcttacagttactttcatttgtgttatgcataattgtggtgtatatcgtttatagccctttaaggaatgtgtacaagtttggagtgtcatttagtttgatgttgtcccatttccagtgcctcacaatcttattcactcccttgttaggttcgaggctccattccacttctctgggagcaaatagtggatttaagctacaaaccatgtctcaacataattgaacatgaggaaacggtaggaatttactgccttttagtttgatacctcttaaatgacctttcacactgattatctgtagatctcttacaaacttgtactgcttacagccgaaggttgtccaacgccactttcatgatctttcacaaagatatggggacacagttgttgttgatttgacagataaggtaagtcctgtgctcatgttgatgttgaaatattagtttatctaatatagtaataactgaacactgtaatgcaactgtgaagtttatcaaacttagttgtcgacggtatgacgattgatgatttagtgctgtgttcacagtatgagctaaattacatgaacttgtatccatgtagtctctttgcttggttagaaatagctgaaccttgtgtgctatgatattctgttctctatttgcttaatttccaatctagaaattagtgaaatgaacattcaaaaggaaatatgtttgccttgaagaaatttcacacttttttttaaaaaaatatggataagtaaattgtgtaaatgacctttttccatgaaaaataaagtgcaacaaaccaatttcaatcctgtataatccaacttatatgaagcttaataaacatattgggtattgcacactttggcttgaggtgtcgtgcctcatgttttctcatcagttggtagtgcatatacattaatctagatctagtaaattatttattttaggttatcgaggacagaagacagttcatctaactaggtttgtttggtttcagcaaggagatgaaggaaatttaagcaatgcatttgctgctgaaatggagaggattcctaacatcaggtgcttgatgtttcgtgaaaatcataagatatccttctattgatttgtgattataaaagtgataaaatatctttctgggattaacaggattagcatgtatataaaattatcattttatgctgatgttcactttatctacaggtatgtgcattttgatttccatcatatctgtcgtggagggaactttgataatctgcaagttctatacaatcaaattgaagaagctattcagaaacaagggtaatttttaaacacctttaaatagccaacatttacgcttatctcttgttcctgatgagactactttaagatttatttcaactactgaaggtttaactatggcaagtaatttgctcttgattaatttcggggccagctgagcagatattttcttatcaactccaaaggagagatattcctggagcaaagcggcatagttagatccaattgcatagattgtctggaccgtacaaatgtaactcaggtatgttttgtcatttctgtgaatcaagttaacaaatatcatgattatttttgaaacaaaggtaataacttccagctatattgtgatagcccttactccttagacctttgcatgtcatgctaacagttctattcttctatctcgtcaatccttcagattgctaatgcactgatgcatatggctctagttaagttgaatttctatgatatggagccaaggtgtgagttgctaagtcagatccattgcatagctcaagcatgtcctgaattgatttggatagatacatgttagttggtacttagcaatgtgtatttcacattttcacatgccataatttgccacttcactctaatgagcattccttcagcaaaatagtgagcagggaaattatttagcattgttctcaatgatcccatgggattaaactgagcatgcaccgtgatataatatttcattactaatgttgaggatgataaatgtaaatactgaaaatggtgttatgtagtatgtttagtgatctattgactatattaacactaatccgtttttaacacttttcttttgctttccagagcttccttgctagaaaatcgttggacttacagctgcagcgcatgggggctctatcatcatctggcagcatttcccaatctggagacattagtgacacctttaaaaaaagtaaggttcctttttgtttactatagaaaccaagatggtttacatatattgtagtcatactttcacagtgtgggttgaacatggagatgagctaagcctggaatatgctggttcttatgcactaaagggggacctagtgaggtaactttttagcatttattgttacaacaataatttgtttatcaactgtggtgcgtttgtattgttaaatccatggcaacaacttaataacacaggtatggaaggcagacattacctggattgattaaagatggcatgagtgctctttcacgatattatttgaataattttcatgacggagtgagacaagtaagtgatatccactgccagttctgatatacatagtaaattgcttccctaatatttggtcttgtcaaatcatattttatcagtgaatgatcctttcaggtgtttcttgtattgatttgtaatgcacacagttcgtctgagcacttaactaatctttgcatggtctagtaacagttttatggatgtaccttattatatacaactttaatttaacgttcaaacaaaccatttgaagtaattatctgttgtaactcctgttgttgtcatgctaaaccatctatgttaaaatcttctgcttgctgcagtttatattctacaaaatgtgctcttgctggcttcttttaaattttaatacttcattactcatcttcaggatgctctagaccttatcagcggttactatacagtcagcaaaggcatctcttctccttttcaaaatggtggatttgaatctgcaacggtaatcagcattttcattttttttctgccttaataattagcatgttcatttcgatactggggattactaatattgtttgattgcagtatcttcctgtggcttcagcaatcatagttggtgggattactgccaccacattcactcttagtcaaggtgtgcctcctcgtacttgttttcacttaagaagttcccgtagtgtgatggattgtttttacatttgtgatctcatctaaccagcagttggacggaatgcacaacacttcatcacctccattatctgtgcgggtttgacggctggagtggtagccttggtgaaagcaaatgggaagcagttttgctctaagcctcgtttgtgtggtctcatataattctttgtttataccaatgacactaacatgaaccacccccacccctaaatttgtaatccttctcagaactcaacggaaaaaagaacctcagcaagtagtacatctataagagccaacttgccctgtagactaacacctcaaattaagcagccccaagttccttttttttttcagtacacattctcagtagatcttgtgatgagccatggatacatggttggtaatcattctcaataggtaatgaacggcagttggccttctgatcctgtaaactgaagttaatctgtaacgccagatttcttcctattagtaattgactgcttggatgatagtatgcaaaactgcaaatgtatgttctaaatgagtagcttacacgacccagagttcagactagtgaatattttggctttttcatggtgcgaacctggactagtcgaaggtcgtctgtcttttgtttttgttaccatccatccgatctctcgcagtgccatcgcacgagtatcagtttgccaccttcgactagtccaggttcatgtattttcatagcttgtgataaacttgaaggaagctttcttcgtcgtttttaatgtttatgccgttgcccaatagccatttttggctgttctcggtacctttctgcaacagaaatgggctacagctctatacagcaggttttccagccttgttcggttgttaaaaatggaaaaataacggagaaccctgaagtgtggtgtccaaaaataaacaccaagctttccgtggcaacacacaattcaaggtgaccaaatgtggtcgtaatctgcaagactcttcctaattcctttcatctctctggttgatgtgaaattcctgtgtttattctcacgttgctctgggtcttaatttgcattttttttttctgagaacggcttcaggtacttgctgcgtttctattgcacggtctatatctcaggattccacaatcatttccatgcttgacattattatgttcatgcagcatctgttgaaatattctgtatgttgccttgacttgaattttctaatgcatgatacagcagctggctctcttagactcttgtggcatcataagagaaatcaagaagctgaaaggaagttgcgctggataaacctaaggtgaacagttctaggtgtttttcttcaaaatccattttgtggaattgtcaatgggtaacacccataatccaacaggagaattggcaattggtgcgcgccctctctatctctctatctcgttcatatttaacaagaaatgtaactaagagtacattgcagacgacataaagattgacgatgaagcaagaccagcaccagcatcaaccccaaggtctttgtttagtaagaaaaccaaaacaggtagcgctgcgatttctggcaattcgaaatatataaatgtactcttcttctcaaattttcttaaaaaaaggtactcttcttctgattgcaatgttaactgtttgctagagacggaaagggagaaactatttgacggatcaagcgatgttgagaaaccaagaatgaaaagcacccaagagatcctcaccaaatacaaatttggcggggtacttttccttttctagtttcaccaatgcagcgaaatagcgaattgatcacctctgatttgttaacctgactaaccctgaatgctcatttcaggatgctgctgcagctgcagctcatgcaaaagataagctcaaggaacggggcgagaaacttgctgtaaacgacttccccatcctttttttttgcatcaagttgttttctcctttcgtctatgaacagttgaacacaaagaactgattctggttctttacttggcagagaataagccaagaatccgccgaacttcagaacgagtcagagaattttgcctcccttgctcatcagatcgcaaaatccatggagaacaagaaatggtggaagccatgatccctggttgggctttctgccatcttttcatacgatcgccttccctatgctccttaccattttggcctacatggtttctgtggccataacttgtattacgttgagaccttgatggcctaaaccaccttgattaccaaccaaccgatgacagtaatgtgtagtaccacctttgagcttatcatttcctttgaactactttgtactaccagctaacgcatagttaatgaaagcaaagcagagcaacgtgctttcacttgtgcagcgatgttatctgcctccaatctccatcaagagtactgagagatagcacatagtactgtttatggacgatttggatggctggtgaccaactgaccatccagcctctccccctctctcgcttgtcgtaatcagcaggatgtacgaggagacggcgtgatgagaggcgccgggagaggacacgatatcgcagcagctaccggttgctgctcgcgccctctgattggacgcccattgataagtgtgggtaaggcgcccccgtttactcgcagctctctctagtctctccgtgttcacttatatccggcccggtcacactacctgcacagggtcctgatagagtgataggggcatgaaaggtgtacgtatgttatggtctacgttggcgttggcgttgcataagatgctcctgaagtcctgattttattcgaggcgagatctgaagaatggcatgcggaatggacaacagaatcaggacgggacggggcctatgaacggttcgttgtcgggtacagtaataccacaccattgctgttgttagacagaaaggtcatatcttcctgttaaattgtcatgcagaaagaaatgctactgtatattttttaacttgtaggaatgtcgtgtggatttggtagacaatgtataaataaactgtactagtagctgaggggggagcacgcatgaaaccatggatttgaccaatgaggagggatttcattatcgggattggatggatggtggccgcaggagcacgaggacctcgtgtcctcctgccggccacagatgcgatcctgccgcgattcggagcgatttcttgctaaaatccacgcgggcaggaggacataagcgtgattaaccaacgacgacgccaaggcaaggcgcaccgcaccgcaccgcaccggccatggaccacggaccaacaagcaacaaccccttctccgtccactaaaaaaacatatagttttacgtgatgcacgttgttggcttggacggagctgaggtctttggtcctcgtttagtcctctaccctgcggtccagcctttctaattagtttgggctggttattacatgagtcctatattaggagctgttcagagtacttccaaataaactttttcaaaatttgataatactaaaattttaacaacattgctaaattttattagaatagattaaatgtgttattgccaaatattacttaaagtttagtaacaaactaaatacactcacgtctttatcagtttctttaaaaagatataattcaaaataacaccattctaaacgggttcttaaactcttggccggagtccactgccggattatcttgtggcccctctagtgatgcatggtaggaccgggccgtcataacagcggatatcgcccccgcgctctccgttgctgccgaccacaaagcgtccaaccgcgcgacaacgcaagtgaggttcgcaatggcttggcgcacaaatggcaacatagccaggcgaggcgaccggccgcttgagaggacatgttacgacctgcactatcaattttgccagtttgccacatgggttaattaatctaatcgaggtcttaatcaggtcctaatgacgacgggtgtgattgggtgactagcaaatggattttccacgatccgatccggttcacgtccacgtcgaaatcgaaaggaaaaaaaagcatcacacatgcgctcaccgctttttccccgcggccactcggtcggccaagcccccccccccccggtggtccagaatccagatcgccgcagcgccgtcggttagaagatcaacggcggtagaagatgccacgccatccgcatggcagaagccacccatatgcgcgcgcagctctcgtcgacgtggacgcctcctgctccacgtacgcggccaccgcctggagcaccgggcccacccctcccggtgcggccctgccttttccattttcgaaagcgaaatgagtagtagtaatactacctccgttttttaatagatgacgccgttgactttttctcatatgtttgaccattcgtcttatttaaaaaatttacataattataatttattttgttatgagttgttttatcacttatagtactttaagtgtgatttatatcttatacatttgtataaaattttcgaataagatgaatgatcaaacgtgtgagaaaaagtcaacagcgtcatctattaaaaaacagagggagtactagggtatgtttggattgaaaccaattcttgccctaccaattatttggtagttttgaacagtactcgttagctatttggattgaggccaaatcttaccaattcaatagagttaaacaacataatcctaccaaaattttggtagtgccaaaacttgtccaagatttagcattaacaaaattttggtaggactttaaaccaaaacaacccctagtgtgcttctaagcgtggcgcgatcgaccagtataaaagcgaaccttcaagtggagtgagtagtagcaagtccaaataaatttatttttatcaattccacacacataaaagaaattagaatattactattttatcaaacaataatataactatctcttattttatctgctttaaacacaaatgtttttttacttttaccaacttcgatataataattatagtagaaatgaatttattttgaaataaatgtaaggacccaaaaataaatttaataggagacagataaagtactagcatggactggatcgcatttgattagtgtactatcttcacatcgtcgtcgtatgccatttgagttctctgacttgttcattccttttcaaggcaaatctctcccttcttttttccgatgatacgacgaaagagtctcgaggaaaggataccaaaaagggattacgtggtttcttctccaagtatgaatgcatcaggttaaagggaggcataacattttgaaatgttctatttcgtggtacaagctcccttcccatgatagtatataaatcaaattttctcttgggtcgatggtgtagagatcagatcaaggactgtttaattgctttcatactcttttttggacgaaggatgtatatacagttgtaccacactgtactaatgtgtgtcatcaaagatcttattgacgtagacagatgacacctaaaacatttaattaaccatcagcataaagaagttttaccgtgtgaacgcatttcttccccccctccaaaaatacatttacttacctcctactctttctgtaccaaaatatagtaatttagaaaactagacacattataataatataaatttggatatagggcttgtttagattcatatcattatgatttgtccatcttagtcttaggtttactatattttgaaatggagagggtagctaatcctattttttaaatggaaaataacaatgatagtttatagaatgagatatactttgaaccatctttattaacaaaagtttaacagtaaactaaacgtaagactaactttcaacgtaacactacgtataattaaaaatgtttagacttcatgcttacttcaaagttcatcccaatccatgaaacatagtgcgagataaaagatcgatcggtatgatgacaattgggtgttgcattatgtgcgagataaaagatcaagcaacgatttattcttgctttgtattttttttccaaaagcttgcataaaaaatagaatatttttatattttggtattttgatagtaagggctttgatggcggtggaagctcttatatagattctcataatttatgaccacaaaaatacaaaatttgtagcacaatctatattgctattgggtcaaagccaacatgataagctattttaatcatcaactaaatgccttgttactcatgtggcatccttggaaacagtgatgtaacattctaatgtgacattactcaggtggcatttaattgaacattcttaggccattttataagaatgttcatattttgggcatgtttatatttcgggaccagagaatttctaattatgccgcaatttataatctgaactgtgatgtaactaatccacatgtgcaagagaaggtttggatgaattagttgcagcagacaggtttattgcgttgtctatcacggtatacatatgcaacaatcaattttttagtgcacttaggataatgatctagtacatacattctacaccaacacgcaaaaatgcataagcgttcctattacaatctcaatgatcatgacacagacattaattatatatgtacgctgactccttttcgattgaaacgaaacgtggaatgtgttccattagtctaacccgtccaagcactgaacttatgctgcatacatgagcgagagagcgtttgtttttcctttttttgaaaaagttttgtgccaaagttgacaccacataccatagacttggttgactcactgctgcaatccacctttgaccacccatgcataccaaacgtactactgtattgccacgtatacaataccgtacgtacgtgctaaactaaactatcttaattagcagtgagaaagacgcatcgtgcaacatccgataattccacaaatccacaccaaacctacggctttcacacacatgcattagatcgatcgaaccgctaattcctggaatataatcgccacagcgctaaattaattaaaccagtcagtcaacccacgagttaaaagcggggcggcgtcgcacgccaaattcacacgtgacagctaccgtcttctcgtctgacccgagtccgagtcgaccgcaccgcgtcgtccccttcggttcaccggcgcgcgaacccccccacgcgcttacggcggcccggtccggtccgtggctggcaatggcagtataaaaatcgtggacttctcttaatcccatcaccaccactacccgcacagcaaggcccatccgcgaacgcagagcagaaaaatcagaaaggaaatccgtgtaagccgtcaggggcagcggctgctaccgtcggtggcggcggaggcgatggcacggctcgtcctctccgagtgctgcggcctcacgccgctccgcctgcgcgggcgcggcgccattgcgctgccggcgccttccagcctcgccggggggccgcgccgccccgtgtccgccgccgccgcggggggagccatccaccgcgagtgggcgctccgcgttttccgcccccacccgcctcacctccgtcgtcgaggaggataataaaggggaggaggtggtggaggaggaggccaggggttcgttggcggcggccgaagccggcggcgggggaggtaggaggggacggagacgggttcgaccccggggcgccgccgccgttcgggctcgcggagatccgcgcggccatccccaagcactgctgggtgaaggacccctggaggtccatgagctacgtgctgcgcgacgtcgtcgtggtgcttgggctcgccgccgccgccgcgcgcgttaacagctggctcgtctggccgctctactgggccgcgcagggcaccatgttctgggcgctcttcgtgctgggtcacgactggtacgcccctgcctccatcctagagattggatttttttttcttttctgtgggttttagcttttgcagcccggatcgttgacccttccttccctactcggtgtctttgcagtggccatgggagcttctcaagcaacgccaagttgaacagcgtggttggacacatactccactcctccatccttgtcccataccacggctggtaagatgagcgcgcttcatgtattcctggttctttcgttttggacaggaattgttgttgaagctaaggaaggcagcatctcacattatttcgatccaatttcaggaggattagccacaggacgcaccaccagaaccacggtcatgtcgagaaagacgagtcctggcaaccggtaggtctttgtttttggttggttcatgaggaattctgcaattttgctcgatggttctctaatcgtgacaacctgcagctgtctgagaggctgtacaatagcctggactatatgacgaagaaattgaggttcaccatgccgtttcccatgctggcattcccattatacttggttaggccaagagcttcttgacattcattatcaactgtattagaggttcttattttgtaatatcatactaaattcctggtttggggttcatgtctatgcagtttgcaaggagtccagggaaaaaaggttcacacttcaacccaagcagtgatctgttccaaccaaatgagaagaaggatgtgataacatcaactgcatcctggctggcaatggttgggattcttgctggtctgacctttgtgatggggcccctcaaaatgttaaagctctatgctgttccatacgtggtaagagcatgatatttttattagtttctgcaaaatgataatttggattgatgggagtgtctggtgatgtatgtgttcacattttgtaaacccttatgcagatatttgttatgtggcttgattttgtcacatatttgcaccatcatggccatgaggacaagcttccttggtaccgtggaaaggtaaataatattattaattgtatgggtttgctatttgtaaatgattcaaggatggccacttaatgttgaaaaactaggagatagtccatttttgtttgttaaatgatggaaagtttcattattcgacattggtactgcatgtagaaactaagctaagactttaaaggtaacaagccgaattgatataccactcttccatctagttctggaaatacaactaaatgatttggtctacaccattataatatgttcccactattatcttagattcaaagttgtatatctctctctctttctccggttaatgcggtagtttctaggcttttagaggaattgtggtctctccttttagccctctctccattgtatattaggtcggcaaagtgatgattattatataaaccaaaaggtccatacgcatagcttaatggtatcctataaaatggagtatatgcgtgggcgtatcctgtctgatataaagcatgcaattattatatttttgacttaccttgaaaaaaatttcaaaaaaatagtggtagtgcatcatgcagcgtttgtagccaatatggtactgctgttgtctacatgcttggtagttatgtatcgccttatggctaaatgccaaatgtatcctttacttccaaccataagcaaggagcgaacgctacaaacctcagattccttgtggtcaagtacttgaaagagccccttttgtctccttccagagtgaaatgctaatggacatatcaaaacagtagttcctttttttaaccattttcctacgtagaatgaagtgcagattatcaaatacttttcactattttggagtttatatatttttaatgagctcacattttcttttgctctattaggagtggagctatctgcgcggaggattgacaacacttgatcgggactacgggtggatcaacaacgtacaccatgacattggaacccatgtcattcatcatcttttcccacaaatcccacattaccatcttgttgaggcggtaagaagccatccgccactcttgctgttttaatgaattattttgcaagaatcgcctactaagttatgttggtttggacctaacttgcagactgaggcagcaaaaccagtgctgggaaaatactacaaagagccagagaaatcagctcccctcccattccacttacttggtgtgctagcaaagagcttaaacagcgaccactatgttagtgacaccggagacgtagtgtactaccaaactgacttgaaaactagttcttctgcacaaagctcggattgacagaacattagtctctagcttatttttcgatttctcaggagcctgggcttaacatctgaccagcctcctgggcgttgagcctagaatttcaaagcattatcattgtaaaggagcatacatgtgtaattctttcgaatgattgaagacggagatcacctctgatgtaacaaacatgtgattctttcgacaagatatataatacagtaaagagcgagaaaaattgcttactgatgccattctcccggagtatgtacactgcacaggccagtgtgccgctgacgtctcagctgtcatgaccgtgacatgatcctgatagtacaaaaatggagatgcccttctttggcagtggcagttggcacgcaggaggtgctaattgccacagaaaatgaatcaatatttaaaacactcatgtataaatgctttgttttctaatggcccgcgtgtgagagatcgttttcgacgaattgaaaatgctccgtctctgtcaatgaacatttcgttgtgctcgtggacatcgaatggtggtggttcgaagtgggatccaagttgattattgtcagttttcacgattggcccaaattcagtttcagctcaccaagggccaaggctcttcatgctcccgaagaaaaatcttcggcttttgtggctgctgctcacttctatttgcaagggggcagcagacagcatgccagagatagtgatccacaataagcatggaagataatgtgcgtcatgtcctttgtcagatccaagatttggccactcaatttcgatcgatacgcatacaaatatttttgggatcccaattctttttttttctcctggttctcacaaatgatgtcgacttgatcgtcaatttctatacagtacgagcaatagtactaccgtataggggtatctctgaattcttgcaaaaggcagtggatctcaaatacttcacgtctctatcataaacagaactttatctctgaattctcgcggaggctaattgcacagctctgccgcatactgcaaaaggaagaagacaaaagaaaaagatgtaattgtgattagcacatatcattcatgtaattctgtaattgttttgcgtcaaaaaaaatgtgtaattgtgatactgtattatgtcttcacccttccttccagtcggccattgggccatgggaatccttttgtctttgtcggtgaaacttccccctttatcctccagatttgaagcgtatcatccacactcaggtcagagaaaacgtctgtattattccatcggcatcatgcattattcgcctttttttttcctttctcaaagaagagttccagtgtcggacactcagcatggcctgctctcactcacaatttaccacgattactctggccgagtgacaggatttcgtggcatgcggctatgtctcgcaattgtgcagtgttggtaaccttttctggtacactcgtaggacccgtgccaagacataaagttggtcagaattaccattgtgtatcaacgataactatgatatgatcatctggaagtcctgggcaccaaagaaatacattttttttggcctaattaatcgtgcaaaacagagtgtaaacgtcagacatgatagcaatttgtggatggccaaacaacacttgttacccactgtacagccacacacttaaacgttcttccaccttcttgttgagttcaagtacacgagaaaaatctgggacatgcctgttacctggatctcatgctaacaactcaaacttaggctgtgtttagatccaaacttccaactttttccatcacatcaatatgtcatacacacacaatttttcagtcacatcgtatcaatttcaacccagacttccaattttggaaggaactaaacacagtcttagtagtacactctagaagaccagcacgatggtccatgattggtaggaaacactcctcacctgcaaggacttacacaggggttgagctctctcatcctcctgacatcctaggtctaagagatacggagggagagaaatcagaaagcgttctatcataagatttttttgcaatagctttgttggcgaaaattaaagaagaggtcataatttgggcgcttgcagaggcaaagcatctatctctgtttagatttattttttttcctttattgaaccttttaaatcttatttttaaagactatgaaaacttgttttcaaatttaaacattttggtcatgctattctagctgatgtggtagaataatgctagactggtgtagtaagggttttgccacgctagctagaatggtatttttttaacctttttaatttttaaataaattccccctagaacatttttctaaatctgaacctttgacataccaactagatggatttggtgtggcaagacaacaatggcacaaccactgcgtgttgtcgtgtcacgccaaacaaattatatatatatatatacacacacacacacctgctcccatccaccgttgatcagtagccacccacgatcaaccctgttaccggatgcactcaccggacccgtttccatttctttaaagaatattctcctataatgtttaattatcccgcactaattggtcggttctgaacagatcgtataaatcccttggttcccatcccatccgcgacggcaatctctccgttgtattcggatcgagcgctagctaccggcgactcgaagcggaggtatggcacgatccattggggatcgagcaaccacgccggcggcaacatccatcggtgatttgctgggatgcggcggcattcatctgcagcaacacggcgttcctaggcggtgccggcccttgtggcgacggtatcacggcatcaatccatcggctcttcctatctacgcggaggcggcggtggcttcaccttggctgaccgatcgaagctagcaccggtgaccttaacaaggacgccatcaatatttcggcaagccactgtggtcatgcggctggcatcgatcaagcccgtgcaacgatcaaggcaagccctttcttccttcttccagttttgtttgattaattttttcctatagaacgataatacatactcttccttttcctttttctattgggtatatctctgttattgtttgcagacgaggatgcagacatgaagtatgacgttgatagaatgattaagcctctgatgaatgcatttgtttggtgcatgcacatgcgagacacatctatcgtgggcatagatggtgctgacaacaggacactccagcatgtacggtcgtctggcgacggtgctgagtccgtgattccgttgatccagtaagctgacacatgaatactcgtttcgctctcgggcgcgtgtttggcgtgatcccgtcgatgctaaccgatttgttagcctgcatgtagaatgtctattcggaattcagtgcacttctagcgtatttcattcatttagctttattcagaatgcagcaacccgatactttgctagtgattgacgacgcttctttatcaatcattgactaatacagtatattcataattagcaaccctacacataccaaatttacgtattgttctattctataagacaaaaatggtacgtactattatgtggaaaaaaaatacctatactactcccttcgttttatattacaagtcgttttgacttatttttcctatcaaacatctttatgtttgttcaaaaaatatactcatcaaaatgtatatactagtatgagaaactatatactggtactaacttaaaaaaaaggtatatactgttactaagttaaaaaaggtatatactgctactaagtttaaaaacagtatgcactcctgctaacttactataaaaaaaatatatacggctactaagtttaagaacattatatactcataaaaagtatatactagtaattgacaagtatgtagcatatactggtactagctaattaaaagaagttatatattgatactaagttaaaacaagtatatacttctactaagtttaaaaacagtatgtactaaaataaaatagtatgcgctgctacttaaagactactactctccctgaaaaaagggagctatcgtacctaaaaaaacagtatttggtctagtatatactgaatcctacaaagaaattaaagcggtacgtagtatctacaaccaaccagtacatgatctagtccagtatataccggattaaaaaaaggtatatactgctctcctaatttaaaaaggtatatgctgttactaacataaaaaagtatgtgccatacctaaaaaaaaatcaagtatgtacaaactggatattaaaaaaatgcatatagtccaacaaccaaaaatctaatacggtgtacatactgaatcatacacataaacacatagtatataccggatactaaaaaaaggcgttttcaacgttggctctggtacatatataccgaatattatgaagaaaaaaaaaaggtgcactgaatacgtagcatgcaacaggcggactaatttttaaattattagttgcatgcatgcatccccgattgttaattacatcatttatttattaatcattttgttgttcaatccggtaaattggatcctattggatgatccactatcaggggagggtgtatgtactcccgggagtacaaaacagccaagactattctacacctattctatacccccctccccctcaagagcccaacccacctctcccttttttttattgggcttaaaacccacctcccacccccagtcaaagcatggtcaaaggacggtcaaatcgctgccacgtcggtcaaacccgtgtgctaacttcctcccacgtccacctatttgttgttcttgtctcgtacgaacggtggagtaacatgacgaccaccgtgcagtaacgctgtagcttacttacagtaacactaataaaatatagttaaaatatagtcatgacggatctagttttatagagctctttttttaaagcattacggtgcaaacggttcaaaaatataatatgtggtgtgagagatattattgtttaaagatgtgaattcaaaagatatcacttgcacttacattttactagttcaaagtgggtggtaggtacttgtgtttggttgttaccatatgttattgcagtaacgctattaagaaattgcagtaacatgcactgttactgtaaaaattatagttgttactgcacacatagagtaacgtcataatggaatggtagtaacacacaataaaaagtagtaacaataagtatttagtattactacttatggagagatgaatttcaaaagacaaatcttcgagaagaaatggtagtaacacactcgattactgtaaaaacatataaactgttacaactctacaggacacataaagttccatagttgtaggaagctaagtagaagagaaatatatatgttattacaaaacccataacaagttactatgttttagtagtaacattatcgtataagtatagtaacacgtcacgttactgcaaaacatataggatgttactgcacttttgatagtaacatcgtggtgaaattgtagtaaactaggaatcaaaacaaaaatatatgagttaaaagtctacatgcgaaccatatttttgttactacacaaaagtgtgagtgttactgcatggcagatacacgtgaccacaagtttatgcagtaatactattcaagaattgcagtaagacgctttgttactacaaaacttataatatttaccacactttcataataacgttatgatgggattgtagtaacgtacaatagatagtaataacacttatgatatagtattactacttgtggagagttaaatttcaaaagaccagtctttgaaggttctctctacccttgccccatgagtaaaccgagctaattcgtctctctctccatgttactgcaccttttttttcttactatacatattcttgcagtaacgttataaagtaatcgcagtaacacactatgctactaagaaacttataatcattattacatcatgtagtaacgatattatgtgattacagtaacgcatagaggatcagcagtaatacttatgatatagaattactgctcgtggagagccaaatttttaaaaaaccaatctttgaagggtcatatctctcacatcatgtactacttttaaaaaccgtttgcaccatgatgttagaaaaaatgtgcttatcaaaagtagatccgtcataactatattatgactacatttcaatattgttactgcacgtaagacatggtgttactgtacgatgaacatcgcgttactacgtcgttctgagacgagagctgagaagagtggaggtggtggggaaagtgaagggcgggtttgaccaaggtgggggagctttgactgaggtgtggggtaggttttgccccctggagggaggggaggtgggctagagggagaggggtatagaatagttaccccgggtgtagaatagtttttctatatatatataatttcttattttaagtgcgtgttctcaatgttttattgaactacacttttttttagtgcaactttgtaataatgggttttagctctttttgagcaaaggcagggatattctattccattatctaaaaaatatatattttttaaagtataagtttttggtgggtatgttttttaaaaataaatataaaaaggttcaaaaaatattctataaccttgcttttttttctttttatagttctttggtttgagacatatacattgtgtttttttctacttgtctattcaacgaaatttcaccatcttgtattcttgtgccggtaaagtaaagaagtacaaatttgcgacttcagctcacgtggaaaggaatgatgagggaaagacggttcaaaggttgagatttaaagggcgtttttgacgtacgtattccgtaatcggtttgaacgttttttgacggagggagtatgggccttggattgtattacacttgtcatacgcttgatgggctggcccaataaaacccagtaaaaaattgttttttttttcaattttatatttatttttttaaaaaaaatattttaaaaataaagttcagtttcaaagttttgcaaaaatatactcctcctggcctactgtaaggtggaacatataaatcgtccttcggtaaggtaatctatgtgacgtgtcaccccgcgagtggggcatatcgtggtaattttgctggcagcccgagggcgatttaccactgagaggaggtcgcttacaaaatcaccatggcacacctcccacggggtgccacgtcatcgtaaggcgatttgtatgcccatgagtatatttttgtaaaactttgaaatgaatttttaaatatttttaaaaataaatataaatcaatcaatcgaaaatactcacactttggtcattgagcccaaatataattcgaactgttaagggtctgtttagatttatgtcaaaatgaactttactaaaattttagcaaattggtaatattgccaaaattttagtaggattggcttaatatgttaccaaaattctatacacattgctaatatttggtaacaaattaaatgtagccatataattattaattttatcaaataatggtatggttaaaaatgtcatcaatttgaatgggctctaaatcaaactggagtgttgtgccgacgccatacctttaaggccaccttcatcgtcatgctcgtactcaccctcatagtggtggtggcaggaggataaggagctcgtcggtgccagagctcaaagaggtgcgaggagaccagggcgaggccaggccattggtgctgggtttgagcttaagctcaagctcatcgtggttgggggaatgaaagagagccccacgtctatttttgattttttttttggtgattgaactttcacgtggatgacacgtcaatgaaaactgtccttgaaaaacagtcaggagagttgttttgcacggttttaatatttaaagggttacagtatacctgacctttttagttaaggaatactaaccaaattcgaccactactaagggagttaagttagactttttccattcacattaggcttggagaccaatgggctcaccaataccatgtcacgctcggtaggatgatattcttctttttttggattgtatgggtgacacatctgcaaacaacaaaagccaactagtgttttgagttcaaaatggactgttggaacaaaatattcctatcttttattctactataaataaaaagaatcaacaatgcaatagttcattcatcgtccaacatgccgtccaattactgtgccttgaaaagaaaaaggaacatttcaccagcaggcacctgttcggtgtcattttctttactttacagctaaccaaccgtgtcggtccggatagctaaggcacattccgctcttctgcacacatttcgccgagcaactcctagcatggttaatttaaccgtacacaccaccgacgtacgatctgttgtagctcgacgttagctcgctggcggaatcgcagctcgcgtacagcgtttgacgacgacgcggtaactcgacatctagctaattaagctacttagctctctcgctagccagtaatcacgtgtggtggtgatgctttgggtcaccggccacaatatatatatgtatgaatcaactgctgctccaagcgcatgtgtgtcacgtcgttgattgattcggtcgacccgt

SEQ ID NO: 25243 - DNA, 564 bp, Oryza sativa
  unsure (1)..(564): unsure at all n locations
gcccccaacaaggaagagttccacaaggagacctgccgcaaggtagcaaccgctgacactacaaccgcgactaacagaagctgttgctgaaattcctttctgatgctggcacgaaactgtctctgaattttctgactctgatgtacgtgcaacgcaggtgaaagcacttcatcannnnnnnnnnnnnnnnnnnnnnnnnnnnnnnnnnnnnnnnnnnnnnnnnnnnnnnnnnnnnnnnnnnnnnnnggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcaca

SEQ ID NO: 25244 - DNA, 593 bp, Oryza sativa
  unsure (1)..(593): unsure at all n locations
cagcacacggttccaaattagtactagtacaagtgtagtagtactacactgtactgtacaacgcttgaatacacatcagtcacctgcgggaagagcctctcaaatatcatgcggtagtagtacgcctccttgttgacgggcgtgttgtgcgggtacactttggcagcgttcttcatcatttcatcactgacctgaagaaatgacagagtaaacgggggtcaatttaattaggcgatttataggacaggacacagggaaatggtcggtaattagtacctgctgctcggtgaaagccttcaggccannnnnnnnnnnnnnnnnnnnnnnnnnnnnnnnnnnnnnnnnnnnnntgtacagtatgtgctgtggagaatttcagaagtattagttcagaacacggacaaaattaccattgcatctgaagaaacaaaaaagaactgccatttctaccttcggcaggtaaggatgctcctcgtcgtcgaacgccttcctcataacccacttctcgatgcgaccaagatcagcattgtactgcgtgcacacaaataaattgtcaacacattctgatcagcagaaatgggactataacataa

SEQ ID NO: 25245 - DNA, 4137 bp, Oryza sativa
catcaaagttagttcgtaccgtagaaaatttggatctaaacaaatctccttcttatcattacgttgagaagaattttgtgacatattattctcgtcgtggagggggtgcaagtaagactgagttggtacgagaagacttggagggggaaggagagaagaagggacctttgcttggaaatgatttatgggaggcaggaccatcaaagagacattgcggtagtgatgatgtggatgcagcgagggagatgaaaagggagttagtacaagaggggcttgatctaagtgaacatttgtcggcgagtgttcattggtcatcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattctctccacttactaataatgacaagttagcattagaggaatgtcgtgcgtttgagaaggtgtttgggaggaagccggacattcctgagtttagggacctaacacatgcccatggtgcactactagatggcggcatcaacctagatcagttgccagaaccattccaggtggatggtctcagaaagggtttagagttcccatccatggtcgcattgaagctatggctccaggattacgccatcgtgcaccatcatccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcagctgacatcaaagttcatagcaaataggttatgcaatgccataaaactgcaacctacactctctgcttctgagttagctttgtatatatttgaggttttccagtatagggtgaagtatggaaaggcttggagggcacgagaggaggctatgaagctcatttacggtgaatggggtgaagcgtatgtccgtttgcccactttgctgcaagccattaagcagaggaatcctagtatggtctaccacatcaatactcatcctgatagggttgtcaacgttgatggagtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttgtggttgggccgcatagggaggtttgtattatctcagatcgacatgctggtataatgaatgccatgacgactcctgttctaggattgccaccggttcaccaccgatggtgcatgaggcacttcagtgctaatttccacaaggccggtgcggacaagcaccagacaaaagagctcctaaggatatgtcagattgacgagaagtggatatttgagagggatgttgaggcactaagacagcgtattcccgaaggtcctcgtaaatggcttgaagatgagttgttggataaagataagtggtctcgtgcatacgatagaaatggccgccggtggggttacatgacaaccaacatggccgaatagttcaatagcgtgctagttggtgttcgtaagcttctagtgacggccatagtatcatttacgttcatgaagtgcaatgactactttgtgaacagacatgatgaagctttgaagcgagtccagttagggcagcgttggtccaccaaggttgatagtaagatgaaggtgcaaaaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgatgaggaatctcccaaccgaatgccgtatcagttctcttcaagagccgttgtgaacacatgggcaagtcgctttgagccatacctcgaccccacacagtggccaccgtacgatggtgaagaatttgttgctgacccaaatttgaagattaaaacaagaaggaagaggagatcgaaacgattcaagaatgaaatggactcgggtctgggtggttctggaaggaaaccaccttcatgcgttcaacttgatgctgcgccggtgcaaaatagatgctcattgtgtcaccaggagggtcacaagaaaactaagtgtcctaagcgtccaaaaaagaagaagtccaaaaaaaatataagtgttagggaggtaaatattttgttttcctactcatgttctcgcattcattttctgttaatatatgtcacattggtaactaacggtgaatttattactttttcatgtaggatggccgaggagagacaaccgctgacttacccagccttggaggcgtgctacgaggcccgtcatcgcggggctgcgatcgagacagggagggtatgaatcggcattgatccacttgtgcataagtatctgtagcatgtatttgacattatattaactaattgatttacaattgctaatgcagatacttcaaccgctccgagtcagagctcatgcccccccagtgttcgacgataggtacatcccgtacctaagggcggtcgggttgctcggggtggccttggtcgtgagcagaggaatgccagtgttcaacgctcctgcgttgacagcacttgtggacagatggaggcctgagacacacagcttccacctccctagtggtgagatgaccatcactctacaggatgtggctatgatcttggccctcccattacgggggcatgccgtgacgggcaggacagagactcctggatggcgtgcacaagtggagcagctgtttggcattccactgaacattgagcaggggcaaggggggaagaagaagcagaatggaatacccccgtcttggctgagtcagaacttctcacatattgacgacgacgctgagccatggcgtgttgagtgttatgcccgcgcatacatcttgcacttgttgggaggggttctgtttcctgatgctgggggtgacattgcttcgccgatatggattcctttggtcgccaaccttggtgatctaggctgtttcagttggggctcagcagtgttggcgtggacatatagacagctctgtgaggcctgttgtcgtcaggcaccatcatccaacatgagtggttgtgtgctattgattcagctgtggatgtggttaagactaccggttggaaggcctaagtggaggcaaagcttcactccttggccctacaatgagccagacatggagaagacagtggcctacctttttgagagtactgccactgcacatgctcactgggatgtggcatacaagcattatgtcaatgagatggactgcttacagcctcaacatgtaagtacttccaatatcacttctagttagacatttacttctttaattgagatactaactaacgacatctcttcaacttttgcagattgaatggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatccccttctacttgtctaggtatgacagggtgagaacaaagaaggtgaaaga

SEQ ID NO: 25246 - DNA, 596 bp, Oryza sativa
gtgaatgaaatggggcatgccctccaagctccgaggggtggtgaggacacggagaacacactctgcaatgttttaaaggtaaaatttatttagcactttgcattacttgagttatgcctaacaaacttctttttttttttgaaatgcagaaagttcgtcaaaggtgccggagactttcagcaagattaggttgcaagtcggttggattggacgacgtgtaccagccgcgaagactactaccaccactacctcactccgggcgtccaagtaccgctcgacactccatcaggatagaagagcgtgaagaagttggtggctcgtcgtcgtcacgcattccgcaagggaggggaaaggggaaggcgccggctccacctagcgacgacgatgacgacgacgaggaggaggatgaggactacgtcgcaccagacgctgaggagatagacatgtcgcagcttcccgacgcgcctcaggggatgcaacccacgcaatacaacttgcgatccacttgggcagtgaaaaagaggtaaaatgagcttaccattctcaaatgttatttgatttccctcattttgtttttaaaatgttttaaacattgg

SEQ ID NO: 25247 - DNA, 3436 bp, Oryza sativa
  unsure (1)..(3436): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggcaagagatctagccgctcccgacgccgccaccccctcgtccctcctccctagtccgcttcagccgggggcggtagctcagtggtttcaactttaattcttagccggatttatgggtgctggtgttatgtttgaactttgaatcctcaacactcaattttctttccacttcttttttctcccttacctcacgtgaagaagttaccttaacaagatgagatagtgaattcagcatcctcagcatgtttctttgccgtctgccggggaagttgagatgggggatgcctggtggtgggtttagaagggaagaaggggccaaaaaggagttgaagacggagagagcgctaggccgtggaatcgcgttggccgccgggccatctcactaccgtcacctccaggacaagaggaccaggggggaaagaccatgtaccccatgaatcaaagggcgcaaatgagaggaaaatgggatgcatctacaggggcctctccggcgcaagcaaaggtgagacggcatggaaaaccgctggcaaaaaacctcgtcgccaaatcaaaaggaggagcaatgagagattgcggaggtgtgaacagaagacatcgggtaaggacaggaacagaatggcgctagctagatcaacctggaacaggcttttttccatctctgtcttgcccctactaaatcgaaggtcggatttgccacctcctcgaggatggtaaaaatactattaaattaatgtaaaagtattatcttatatgaaatggtgtaagaacggaacgattataaggtctcattttgtaaaatttcgttgcaacccacgggtgtatatttagtttagggtgtgtttagttcacgctaaaattagaagtttgattgaaattgaaacgatgtgacggaaaagttagaagtttatgtgtgtagaaaaattttaatgtaataaaaaagttaaaaatttaaagaaaaagttagaaactgaaccaggctttactatctgtaccgtacatgctgggcctgctgccacctgtatgattgatttgatattcatattgctgccgtcttacgccgctcgcaccgtcgttgcggccggcgcacgtggtgtatccatctatcgcgctgtctccccttcttcccttcgctcgtgcgcccgcgcactaccggctgtctgaaacctaccgactcgcccgcacgatgcactcaccaccaatctagctactacagtactatctctatctgctaattcggtctggctccgttggccacagcgcgcgcgcgcggacggccagcctaatcaacggcaacaaaacctgcaggcccgcacgcccacctgaatcacgcgcccgcccgctcaaaaggccgggaaatccacaggtggatgagtggatcgggcgtgacgcgagaccagctcgcgcgcgcgcgcgccggccgctagctgcgctgcgcccagacgcgggctttgccgctggatcatcaattcatcatcgatctcctccgtgaattcggggttgtataggtttgtaggaaagcaagtaacgccgtgctacgcattagattggatcgtcggtgttaggccatataacagtcgtagcaacatgcgcatcatgcatgtgacaggtgctgcaggcctgcagggctttgcttggcgaaaatcttgagagcctcaccttcccagccagcagctgtaagataaggacgtaacacagtgatgatatgctgttttctcttcttaatggcagattaatttgcagccagcgtcacatgcaccaggaggatcagtcttgggataagcacagtgaagagtgcatctaattaatatctggtgagaagtactgtagaatcttcactgttatcttactctctttctttttctatcttaccttctcttcttcaccaacctggcccttctctggttgacagctccacgtcgatttcatcctttattacagtatggttttatctgaaagattattccatagttcttttcaattggatggttttattttttttcttttggttttctaagttttatcctccaagacaatgtattagagaatatccacggaactcaaagttttatcctccaagacaatgtattagagaatatccacggaactcatctttagtcccagtttataatccctttatttctgaatcgaaaaccggacatccaatccggaactagagatggatcattaccaactagaactaaatgtgttttttttctttttttcattgttttttactgtttgcatattaattttcccaaatcaagttgctctctacactacatccccaaatcacagattcgcaaataagataatatcacggattaacaaataacatcatagattcacacattcaaatacatcacaaattcttaaaaaaaaaaagaatgaacatgcgccgccgccatctcctcccctcccaccgccggagcaagagagagagcttgagagagagagagagggagagggagaggggatcgagagaggcgccacacacatcactaagtgctagttatatacgccgcgttaatctatagtctaaagatagtggggggctaacactttttgaatcgggactaaaaatgatcaaaaagtacagctgggcttttgaatcgggattatatatatcttttagtctcagttcctaatagaatcgggactaatgttatttttagtatctgagtaaagatcagttatccagtagtgatcttaccccagctcctataatttggttttaatctatagtaatatcttaagttttccaaaagaaaaaaattacatcccgtacaacatgggcctgaattcttccaagaccgtatacaacgtgtttatactgagtcttgtagtagtaacttgtaggaacgccaactcaccatcaagcaaaacgtgtttgctccggttggccgtcggcattctaaagtcacgtagaacacgcgcgcgcattctaaagtcagccccggcccgcctgcatcagcatgcggaccggcccggccgcgctgtcgtgaactcgcgcaacatgcgcgcgcgtgcgtgatgcgtcgaccgatcgggacgcggccgagcgctttgctcctcctccacctcctccgtttccaccgcatccgcggatcgatcgatcgatcggtgggg

SEQ ID NO: 25248 - DNA, 554 bp, Oryza sativa
  unsure (1)..(554): unsure at all n locations
ggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcacatactgtacannnnnnnnnnnnnnnnnnnnnnnnnnnnnnnnnnnnnnnnnnnnnntggcctgaaggctttcaccgagcagcaggtactaattaccgaccatttccctgtgtcctgtcctataaatcgcctaattaaattgacccccgtttactctgtcatttcttcaggtcagtgatgaaatgatgaagaacgctgccaaagtgtacccgcacaacacgcccgtcaacaaggaggc

SEQ ID NO: 25249 - DNA, 5396 bp, Oryza sativa
  unsure (1)..(5396): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaagagcttcaaaattagcttaggttttaagctgaagctgtgacaaattaaagcacgatcttgtaaaggttgcacattatatgttacactttcaccttcatttgcgtgattgcttccacgagcacgtctcctagctcgtaagcatggccaacactacaagtcaagcactaatggacctgatgaattagtggtaactacaatgttatgtctagctcttagttaattttctgatcaagaccgtagagtgattcaacgtacggcatgcacagtagtcgatcagggcgcccattttttacttgcaccgcaagccaaacatcgattaatatacgcttaccaaattgggtatatatagcaaagttagattagctcgttcagttaactaaaatgttcaaatgtcgatcgttcgaggaaatactcagcgtgttcacatattatgcacatggtttctcacttaaccaagtgtccagaccactgtacgtagaacttctaatcttacttactccatcccaaaatataaatagtgtgtttgaaagagattttttggtagcagatacgcctatggtagttcaaaacggctgcaagttgcagcgattttcaattgttggctgcagcaaaactggctatcgaacaagaccggaagattttggatggaagggatacactatacgaatccagataccctatctagattcgtagtattagtaagtgttctatctgtctaaaacgtgccccttatattttttagggcggagggagcatatatttcgaccgctgtagagcgaatgagaaaaaaaatcatcatttatcctcacattactctctccataaaaaaataatttctatagacaaatcgtatctgtttctttattagtagtttttttttccatgagacgatgcatgtttacttgaatgatgagaggtaatcactaatcacatctcgataagcaataattaagatgagcgaagacacgtttgttttggatttattctgtccaaacttctaaattaatttttttgtaaccgaatttagcaatcgaacttgcatttagggtatcacaatgtgcatttaaagtgggcagcaaggaataaaatactacttcctccgtttcacaatgtaagtcattctagcattttccatattcatattgatgttaatgaatctagacaagattcattaacaccaaatttaatgttttaaatgctagaatgacttacattgtaaaacggagggagtactagttagtatacacagtgaaaatggtaagtaagtaacaagtactaggtaatatgcttattacctagttataaggaataaataaataatttctctcatcttttctcatggctagtgactgtggggtctagcttaccgtccacttttattctttcactaactattatgattacaacaataactaatacctattgacatagagcttacccttattcataaaataggtagtaaatattggtgatttccttataaaaccatatattaacactatgattctgtgatctgaatgtgatcagaagattataggatggacctggtcgcgctagcgagtggacacgttcatctacggctatccattatgttaatctgttccccacgaagtaagaacaatatcaaggccttgtttagagcatgtttaatagaatagccaactactagctccgaatcatctataactaatgtaatagtcaattcatacaataattacctactatactattaatatttggtcccacctgtcatatacacattacgtcttagagtccgtgctgcagctggctacacatctgtagcatgctgctcttctctctcttcttttatttttttaatatataagtttattgctggcttatagtctactattgtatctgctcttagttgggggaaatttttgggtttggtagtcacatcgaatatacagacacatatttgaaatattaaacgtagtttaataacaaaataaattcagattccgccagaaaactgcgagacgaatttattaagcctaattaatctgtcattagtaaatatttactgtcgcactacattgtcgaatcatgtcgcaattaggcttaaaagattcatctcgcaatttacatgcaatctgtgcaataagttttaatgactacatttaatactccatacatgtgtccaaacattcgatgtgacagcgtgaaaatttttgttttggaactaaacagggcctaactagatttttttttgaaaggagggcaaaagctttgcctcgtatattaatagaggagcaggaaaacaagagaaaatatgtacagggtcagccaaaagccaacccgcaaacggaaaaagttgtctcccaaaattccaaactcctggagctttgttgctctggctttaaccaggctctcccttcctctttatttttgctaaaactgaggcaggggtggagactgtgctccaaaagattcttgcattacgctccccccaaatctcccgaacacaagcatcagcagagttcgcagaggggctcgtggagtattaggggatccagcaataaggttccaccaaagtttgacggaggggcagtatttccatttactcaattggaggtcagtttgtgtccattgttggatttcggcccagattctcttagtgactctacatttggccagtaggtgcagggctgactcatccgttacacagcacagggggtagatcttttgattttgccagcctcttttccccaatctatccgccgtccaaagtctgttctgggtagcaagccaagagaagaatttgcattttggcggcgcccatgctttccagattgattggtagaaagcagatcttgccgctcccatgaattgcagcctatatgccgatcttgttgagtatttcccattcgccgttagattccaacgaatgctatcttgttcttcattcaacggggcattcttctaaccatggaccatagatggacaaactggcgtaagtgctccgcttctgtaatgcggaggatgtcgatatcttggatccaattattattctatatggcgtcatgcaccgttctattcttccgtttagaggctaagaaaatgttgggtgcaattttctggggcatctgattttccagccatctcgaatcccagaatcgcgccgttttgccgttgccaactgttatggttgttgccgccgagaagagttctttatcttgaaggctacaaggaactgacatccccacccacggtttgtcaggggctacccattcgttccaaagccatcttaggcgtaaggcggacgtgaaacgctgtagatccattactcccaggccacctagatcttttggccgacatacccttttcagttgactttgcatttgccgtcggaaatactttcacccccagcccagaggaacttcctcctgattttgtcaatgtccttgagggtatcatcgggtagtttcagagatgttaagtggtagattggttgtgccgtgaggactgacttcgttaagcagatcctagcagcagatgacattagcctcccttgccagggggctagtctggactggcacttgtctatcagcggctgaatgtggacctttttcaatctacctaccactaggggtagcccgaggtatttcattgggaagcttgtcaaagctgccgggaagatgctcgtgacatcagtaaggtcaatgtcccacaacgaatgggggcaatctggcttttgctcatgtttgttcgaagacctgaactccctccgaaagctcgcaatatttctgttagattcgtcatatcttggacactagggtttacaaagatggccgcatcatcagcataaagggaggttctgaatcttggtgctctgccgcgcaaagtagaaagtagcccaaggtttgttgctttctccagtaggtgatggaaagggtcaatggcaagaataaagagcaagggcgacagaggatctccttgtctgagtcctctaccatgctttattggaattcctgggcaaccattaagaagagcccttgacgttgaggagattagcagatttgtgatccagtttgtccatctggttgtgaatcctcttcgttgaagaaggtcaatgaggtagtcccatctaaccgaatcaaaagccttggagatgtctaatttgagcagcaacgctggtgttcttgtttggtggaattttcttgccagattccgaacgtacataaagttatcgtgaatgctcctttttttaatgaaagcactctgagcctggcttatcaaggagcccatgtggggttggaggcgaagagcaagaacttttgagattagctttccgatgccatgaatgaggctgattggcctgaagtcgcctatgccttcagctccttccttttttgggacaagcaccacattagccgagttcagaatctgaaggttgttgcttcgcaattggtcgaaggagtgaattactaacatgatgtcctctttgatcgtgccccatcaagctttatagaaggctcctgtgaaatcatccggcccaggtgctttatccccaggcaattgttttaaggcagcaagcacctcctcttcggtgatgggcccgttaatcattgccaagtctacaggtggcaactgcagggcatcccaatcgaagtctaccaggcatggtggcgggcgcgctagaaaagcttcgaagtgatctttaatgatggccgctttttcctcatgcttgaatttccaaatattccccacgcggagccgttgaataaatttttttctccttcgcgcattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgcatctttccttgggagatgagatttctgctccaagctttcagtctaccagctgttgcgcccagcttgtggtagagtctgtgatgaacttcatgatatggagggctcacagcccatgcttgagcaacgatctcctggaaacctggaaggtgaatccagtagttctgaaaaccgaag

SEQ ID NO: 25250 - DNA, 13052 bp, Oryza sativa
ttatcttgctcattgctccaggtatatcgacgattttgtagtgtgatctccttgagctcgcaagcgttgagggtttctttaaatattctcaattgtcgcaggttaaggttggcattgtttttatctgaggccttgtaaattatattgaagtcccccactaggagccacttggagtcgtttctaggcttggtgtctcgcaattcttgtaaaaaggcttgtttcgctctatctcttgtgggcccgtataccacggtaaggaggaaagtggtttgacactcttttaggagaacagtggcagtgagggagaaggtgcctaggacgaagttagagaggtcgacggtgtcttcattccagagtaccagtatacctccacgtgttccaaaaggccttgtagctggcttataattgtaagaccgtaggtagctcccaccgagagatccaacaatagctacatcaatattactcatttttgtctcttgcaggtaggcgatgtggggcttcgccgtttgcagcgtttctctaaccgttgctcttctacccggtctatttaacccatgaacattccatgtcatgatgtcaactataggggtatgacataattagcaagaactctattattaaagcagaataccctaaaagattgagccccaagtagtatgaggttttgacttggtctacgccaatcctggattgggccggtatgacggcctagcaatctcaaagcgtatggattggttttgtgggcctccggctgatttaaactaaagtggcgagggggcaggccggcatcgcgcggagacctgggctggtgcagcgtacacgggctagcggggagagcttggcctgcttgggatggcgaggcagaccagttgggcctgtttggccaagttgagcccgttcggcctcgtcgcaccagaggcgatcttcttcgcaaagtcgcaggagccggcgccgcatcagcgccgcaggcaaccgttcttcggcagcacatcagagaatcagctttgtcgcacgagtgggaagagggcacgaagaaggtgcggaaatgcggcaccgaagaatcgctagtgggggtagagccacggaattgctgcggaatagggatgtttccccgaatcgaagtgccgtcgctcaggacattcacgcgtgtccattcgtcacgccactacaaagctagcaaatatgaaagatacatggagatatcaatctcctggacatggagcgcagctcccagatcatgtcgccgccgccagttcctccctatagcaggcgtccgtcggccccaggtacttcgcgagcaccgcgtccgccgcctttgcatcctccctattcagaccgaacagctgctcgagggcatcgatggtgtcttgcggcagtggtgcgttgaacatggctttgaagtcagccactactttgtcggtgagagttccttcctccggcgtcaaccccattcggcggcacaggttcagctgtgccttcaaccccgacggcaggccgaccgttggttgctgggctagtcttgaactcctgtgcctgtcctgtcgtggcatgggtggaggcggcgtctgcaggttcacgtcggcacactgcaacggtggcgagggaaggattgaggggtgtggagatttgaagaggacacatggcatcgccggaggtacctgagggaagtcgactgccgaggtagagagcatcggcgtgtgtatcgccgcctcaggttgcacagtgggccccagtgttgcttgcagatcgtcgaccgggtcatttgcagcagcctgtcgcgctggttcagcttgctcggcatttgcaggatcatcaagagcgagggtgtccgtcggcgccacggggctggcagcagcaaaaggagtgacgacaccccctggcgcaacaatggttgctggcgctgacagcttgtcaatggcaatcgcaacccagccgccaggacgagctggcatagggccccttccgcagaggccactgagatggcctcttgtatgcgcgagaagaccctcgccgcgggattgtagctccccaaccagcggaccgggcttcattcccgaacccacggagcagaggcagaggggagagcgatcttggtggctggaattcccccgccatggcaaggccaggagagatgtcgttgtcgcggtcgccacccccgagatcgccaggctcctcgcagatgtcgtcctgtctacggcgcccatcacgccgatcattgccgccacggtcacgagctcttggcgaacgcgtgcgctcccgtcggaagtgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcgttcccggcgtctgtcagcgttgcgccgcacatcccggtcatcacggcgtccatcatggtcctctcgacgcctatcacgatccccgtcgtgctgacgccatccgccatccctggcggcagcttcccttgccgtcctgcttccttggtcgtgtggctccctcgcgagaccggcattgtcctctacgccctccgcccgcccctggcggaaagcataggtcgtcggcgttggggggtggtgagggaagttctcgaagaggcacggcggagcccgttgtccatcaagaacgcccagatgccacggagggagcgtacgtgtcgctagcctgcatgacttcggattgcggaggtccaccgccgccgccgtgtagtcgtgaatctcttcaatatggaacaacaccgggtgcttgacgccttgctgccagtgctccggtggcgtctccgagatggtgactgactcaagtagggggtcacgggtttgacgcgtgattgtcacccacacgcgcttgtcgatgcggctcgggtttggcatccaagcccatagggagatcaccctcgtgtcgccagcgtccacagggtggacgaggtccgtctccactgactccagagtgcaggtcctgctgatgatgcgctcggcgatgtccggcgcccacaggtgcattggcacgccatcgagacagagcttcactctgtacatgagggcagaaccagcggcgttcttcaggcttcgccattggatgaaatggacttctatcccttggcccttagcaaaacctttcttcacagcttcttcacagtgccggtgatgtttgaacttgaggaggaaggcctcccggaaatgcagtgacatcgcaatctccccagaacgcaggccgaactcatcagcgaggacacgctccacatccttggcggtgacagacggcggggcgcgcatcgcccaggtgatggccgccgtgctctcctattcccgcagctccgcgtcgatggcgtgggacgtcgggatgaagacgatgtcttctaaaggccttgtctcggggtcacccagctgcgccatgatgcccgaaggcggcggcggcagaaggatctctggtacttgacgccggtgaagcagaggcagcggaggcgaagaaggggtggaatcacggggtgttggtggagagcatcggcggcgaagtgtggttggaggaggatggcggaggagaggaggcaagggcgaccgggctctgttcttgctgggcggtgggcgagttggtttgggggaggggcagaccggggggcgaaaattgcagtagcgcgctctatggctagagcggttgcacacgaagcaacgaggcgggtcttggcacaccgaggcacggtggtcgcgagcgaggcacacaaagctgcgacccctggttcttgccttgaattcctccagcgagagagccactctcctgccagtaccgcggccttgtcgccatgaatcgggccggtggtcgggacttgaatgttctccccctctccgcctgcgacaggatctcaccactgtccatcccggctcagggggtgtgaatgctctgtgcagtgtcgtatacctaggaggggagctccttctttcttccatctcataggcgcggcggtaggcatcgcgtcgaggcgacggcatagtaaatgtagacttcaattttgcccgcggcggtggttgggcgggaggcgagcttgcgttgactctggcgggggagaggacgacctcagcaaacgagcgtgggcgagttggagttgcaaaggcaagggtgacgctggtcggtgaccaggtggagcgagctggagtcgcggagacgtgggtgacactatccggcgaccatggagggcggcgggggtggtggcgtggcctgccagaacttactaggggagggggagcccatgctgcggctcaggggaggggcggactgcggccaagagacggcggaaatgggcgcccaaacctgcgaccggcggagaagcgtgggcaccgtcggttggagcaccggcggcggcggtggtgaagcgcgctgcggcatttcaaaaaaatatgtgaagtggtggtaattcttcatagggcctaactagattatcctagctactagtgcgtattaggagctagaattaattcgtgcctagctgggttcactgtattttgacacatgggtgtttcttgcaaatttgatgcacccccgctgattcgtccacatttgtacctggagaggcgttgtgtggggcccacatcctagaacgcagacgggtccgtgatgtgtggggtgacacgtatataactcgagtcagtcaagctattgactctttctgattttgttttccttcttctttttcatgttattattgctgtgaactactactagtgagcatgaggtttcaacttcctacttctagtatttactactactaggggtgtattatgtttacatgtataagactagttctagtttgaccgtatgatagtacttccttcgtttctaaatattaaataccgttgactttttagcacatgtttgactgttcgtcttattcaaaaattttttgtgaaatatgtaaaactatatgtatacataaaagtatatttaacaataaatcaaatgataggaaaataattaataattatttattttttaataagacgttaaacatgttcaaaaagtcaacagcgtcagatatatgcaccagcggtccttaaacttgtcaggagatttcacttaggtacacgaacttgcaaaacgcacatcgagctctctaaacttggtttatggtatcatcctggtccaaagccgcatttgaccgtgttcttacctatgtggcacgccacatggacgatgacatggattttttttattttttcttccttcttttttctctttcttccttcttttttctcggcggtgacatgcggcatgaggggaggggctgtcgtggtggagaaaaaagaaggaagaatgagaaaaaagaaggaagaagggataaaaaataaaacaaatccatgtcatcgtccacgaccacggtcaaatgtggctttggaccgggatgatataataaaccaagtttaaggaccttgatgtgagcattgcaagttcgtggacctaagtagaatctcctgacaaatttaaggaccgttggtgcattttactctttagaaacggagggagtatgatactatgtgtagtcaggtggtactagatcggtataggcttcgagcttctaacttccaacttttccgtcactgttaacagtgaaatttggtaagcccggagtagtcatcggcttagagtcagaatcggcttcgaagtcctaagattagttgatgagagttatcaagtcgtcagttgtcggattcttgctatattcggttaaggaaattgatctactaaaggaagtttatccagaagagatagagttcaaagagaatgcggcatggcaagttatctattaattagaaaattaggaatagtctgttagttttcttttatatttaggaaaatgtgtttagtgtcctataagtactttatgtttttcttttatctttagtttctttcttgtctgacaaggactggtatctccctataggtataaatatgtacacccagggtcattgtaatctatcaatatatcgatcaataaaactactctcggcgcatcgccaccctctataccgaggtttttacttatcatccgacggaacttggcacctaacgcggggctgcatcggctttcgatctccggcaaaggggtaagtcctacgttccactggccctagtgaatttgttggctacattggtgttgttcaaggctgcatcgcttcgatctcttggatcgctctggtttggttgatatatttgcctacctgatatctcaattctatctctaattacattgtgtttagagacgcatcggtttagttggaactgtctcggttaggtccgatcttctgtcttagccgatatatctctacaatcacaatgttgttctaaatagatttgtcatatccatcacattagatagatctatcggctcatcgagtattagattatcatatacaatctcgtgctgcatcggttaggttcaacctactagattgttattgataatatgaatcttgttaagccgataggttcatgctagtgttttatcggggtgctagctgataaattatctggacgttgcatcggcttataaggatttgcatatacatataagttggatttagtcgatgacaataaaggtttcattgatttatctaattgtttggattttatgacatcggacctttagctgatttatgctttaaccttcggatcaatgcttattctatcatattgtattgctagccgattggtttatactggattatattattgttatactatattatcatcagtcgattgcctgtatatcattattaaagacaagtgtcagactatacattggacataaagccgatagctcagaaccctatcgctatcggctagcatcggctatcggctggtatcggcatcggctggaactacaacatcggcttgtcagccgatcggcttattgatctactatttgcatatcttgtcagttgtagggtcaaactgactggcacgcctacatctcagtaacctttggacctgcactggagttaagcagatctcctaggccagtgtgtgtttttcgcatcaacagtcacatcaaatgtttggacacatgcatggagcattaaatgtggacgaaaaaaccaactgcacagtttgaatgtaaattgcgagacgaatcttttgagcctaattacgccatgatttgataatgtagtgctacagtaaacatttgctaataacggactaattaggcttcgatttgtctcgtagtttacaggcggagtctgtaatttgttttgttattagtttacgtttaataatttaaatgtgtgcccgtatacattaaatttgtttttgccaaaacaactaaacacggccatagtatcctctatcctggatggccgccatagtatcctctatcctggatggccttcttgtgaagacgccggccatcatcaacggtggagtccaccaacatagctttggagcttgtcactagcatccatgaccgattctcatgtccttcgcagaagtgaaacggatttcatcaacaaactacacgagcatatatagtgttgagctattgatggttttttttatacagaagcaggacacccggtgaaggggcccaccttgctctcgtgttgttaggagttgggcccatcccattcgactcccgtcccctatcattactgttcttctaagacgcatctgatttaggttattgggtgaactttatgataagcatatttctcgaactgcaacgatgtttttttaaaaaaaaaactttgcgtatataaatgtatttaaaaaatcaaataaacccatttttcttttttataatagctaatactccgtatttaattattcattcgctaatgaaacgttgtgtttttttcaccgatcagctcagccttccaggtgaagcgaacagtgccaagccggtagtgaaaattgccttatttatataaaaaaaaagtaaatgtgaatgcttaatttggtttattattgttttgtcatatgaaatagggctttgtctactgtcctcagaacagtatcgccgtcgtacgtagcaaatgaaaaatcaggatttgctaccttactgggatcaggccgagtttagttacaaaatttttcttcaaactttcaacttttctatcacatcaaaaattttctacacacataaatttttcaacttttctgtcatatcgttctaatttcaatcaaacttctaattttagcatgaacaaaacacaccctcgatagactcgaagtttcagcttaatttggtgcatggtcttgaccaattgacaagccggaagctgaagctgcttctgtatgcctcctggacagactacagtgactaatagaacatggtttctgtctgaaaccgacacacttggtcgcctcccaccggagtattttaccattaatgacctctcagagaaaccaatttataattaccatcagcatgcaattgttagttcggatttgtatataataaagtacgactaaaagtttaagataagagagaacctctgaagtctaatcctttagttgggagattttgaaagctattgactcacagacttggtcaagcagcctaaccaacaactctaggcttagcactgaagcttcttcatgacaacataatgagccccagttgatattatctgatgtccagttactatgaacgatttgatgttgacaacactgtcgtatacgtatagttagtagatatttagagcaaacaaaacttgttttttttttcaagggagtgaatgagtgatagggaggcagacacaaacagataaacaaattgcagattaaagaaggagtactaacaaacagattaagacctctttattcgcagccggatcgaaatcactatcgtcaaacatgactacatcagcatgtatactcgttcgtcgcgtttgtgttcaattgctaaaaaaatccgtcccagattcgatcgattcgagcagtaaaatatactccgtatttgtttgacctcttgttcccgatctgtgtacagcaagatgatgcacgtacggtggcctggcgactgcaaaaaccacaagaatttgagccgtctctttcgttcttgagtctgtcaaagccgcggtaattaagggcaggtagatggagcacaagtcacattgatcagcttgcagttttttacctgcgccgaactgatgcgtcctgttccccgtacaggccacaccattcaccattcaccattcactgtactgtagcacttataactaatcatggataattagatttaaaagatacgtctcccgatttacatgcaaactgtataattagttttttatctatatttaatactatatactacctccttccttgaatatttgacgccgttgacttttttaaacatgtttgaccgttcgtcttattcaaaaacttttgtgaaatgtgtaaaactatatgtatacataaaagtatatttaacaataaatcaaatgataggaaaagaattaataattacttaaattttttgaataagacgaacggtcaaacattttgaaaaaagtcaacggcgtcaaacattttgagatgaatggagtatatatcaaagattcgatgtgatgtttttgaaaaagtttaaaggggaaaactgcgccaaagtcgcaaacggcacaacaccgattgatgaaagcgtacacatatccattacatcacatgcatccacaactacaaatgcacaattgaacatgtctagctcacctgcgtttgagagggataggtatcatcaggtgagaaaggcttgggaagttggcttgctcacttcggtttgggcttagcaggccacgtgggaaagtgcctgcagtggccttgtttgttatttggcccacaatccaacaagggcctaggcacccccccccccccccccacccaaaactaacaagatcgctaccgcctggagcacaggcaaacgtacacacgccatgcgctgcgggggtatgcagccaacttgcgagagaagctcgtggtacatggacgtagtaccagtaggctcgatcagctgcacacgggcgcgtgcatatgtgcacgattgcacacgtacaccaaccaattgggagaaacggaagtgcgtagtggagaatggtcaatcggaggaggagggaccaacggtcaaaaggatggacaatgatgcgagaggggtgtgtgtgtgcgacctgaccacccctgctgcagctgagtgcacagctaagctgggggcgctgcctccctttcccctgcaagaaagcccagtaacccgtgggggcgcagcagctgctgctgctcactgcacaccaatcgcaaccgtcattggaatgggctggaccacctccctccccttctctccattattactgcctctttctccaacacgtacaatactcctccgtgtatgtatggctgtatttagttggatccaaagttttgattttggttaaaattgaagataatatgactgaaaagttatgtgtgtatgacaggttgatgtgatggaaaagtactgaagtttggatctaaactttgaatctaaatacagcctatgtactcatcacggctgcttctgaatctctgcttcatacaagaaggtgtacgtaacgtacgcaccgatccatctggatttggcctgcaggttagcgtcgtacgtcgtcccgtgccgtgcgcgcaggttgggtggccaatggtgcgttggtcaagcgcacgatcgatcggtgtccaaacacacgggacgtacagagagaggcagtgggtgcatgtggcaggggagacatggccgcgccccagaaacccaccacaaaaactaatcaatcgtgcagagatcgaatagctaaaagccatgagccagtagccgcgcagtctcccgccgctattattgatctcctttcgtctccatcggttgatcgatcgatcgttgccgggaaaagcttgctagctgctcgcctgttcggccccgcccgacagtagcgccatcttttactactactactactaatcggtccatcaattcggtggatccagcacaaaaaaagacattagcaaatcctccaaaagattggcaagaacgttagctagatcttgtgttttctactagtaagtcacaagtttaccagcatgttaggagttgcatttagccgccgtagtacagtacgtagttcctaagcctcagtttttgcctttgtctttttttttccccttctcttaccataagccggtctggctgattgcgttgtgtaaaaaaactatttttcttctaatatattaacgtgcaatcattttgcacgtttgcgaaaaacaagtttaccagcggtcaagctggctagttttggtactaatcttgtacgaggtagggttgtgtacagattcataatttcagaatgtgcggaggaagtaattatgaacggttgctaattaaccttgatttgtacttgaacctactgctactccgagaattgtaaatctactgtacagtgtatatattgacgatggatgagggggagatgtagtaaagagtgtggaaatggagggggctggtgatgcagtcactaagctagaagtagctcgttggttggttggttaggttgcatgtggtaaagctgacatggatgtaggggaaagcggggtcgagagcggacgagaccgtcagatcgatgcgcagaagtggtgctgtttgtgatagattccgcaggtttcaggacaagggcatatgcagcgagttttgctcttgcaacacatcaatcattggggaaagaaaaggagggagcggtgctttatatgctgcgagtatagtagcggtggattgttactgccattgctcgttaccgctgcccctccgagagtagcaaaaaccacgacgcaaccaagcggtttttcttgctccgagttggtagtacgtagtgatttgttattacagtcattgctcgttacatctgttcctccaagagtggcaaaaaccacgacacaaccggatggtttttcttacattcggaaatctcaccgctacatgagtagcagtattagtaaagctagcgttgtgatagaacctagacaatgaagaattataacttgttatctacaatttttctgtcagtcatcataacgcgtgtcagtgtttatgttgacaatcatcctgacgagcctactagctggctccaacactgttatctagctgttatctctcattcatataatagtggtatgttagttgtaataactaattggaagggactgtagacaggtttgaaaagagagagaccttggtgagagagctcttgccgaagtacggaagtttgtgagaatctcctacaagacctatgatagacttatgtaattaccgattctcttgagaaaatttggggggggggtgtagctaatgaaaaaaaaaagtgtacgtgcggtacttaaacttgtattaattaatgtgtcatctaggtccctaaactcttaaaatgaatatccaagtcccagaacttctcatagtatgtcatataagtcctaaatcgtcacaaccccttcaggatcctacgtggcgttgacgtgtcatgccacacggaataacgtggcatcattttaactgacaaataggtcctgttaaaaaaaattcctttttctttttttcttctctttttttccctttcttctcctttctctgtgacccaagcagaagaaaggaaaaaagaaagaatgagaagaaaacgaagaaaaagaaaagaagaaaaaaaaaagaaaatggcacgtcacatccatgtggcatgtcacatcagcgccacgtaggatactagaggggatgtgtcgatttgggatctaaatgatacactttgacaaattctgggaccgggatatatattttgagagtttagggacctatatgagaaaaccctacaagtttaagaaccgcaaatacactttactcataaaaaaaagttggctcgatcagttctcattagccgtagcagtgatggagctaactatgtacgttattgggtcttaggcaatgaggagctcaggttattgatcaatatttttt

SEQ ID NO: 25251 - DNA, 3050 bp, Oryza sativa
tgctggggtttccagctttacaaaaataacatagaaacaaaacaaacgatgagcccttgctattgacacagccaaacaagccaataagacctcatgttgacatcatcatcatctgttgttgtctccgagcgcgaggatactggcaagcagtgagctttgtgccgtctccaattctccccttagttttgctggagccatcttcctccactgaattgcaaaagatagagctctgtgaggcaaagtcataatatctttcattagacgattattaaacacccagtcatttctaattagccaaattgcccagattccagcagcaacatatacccacaaagttttgttatctacccccctctgatgttgaatgatatcgagcattttacttctgtcagtaggaattctatcccacccaaaggcatctctaaaacaacaccagagaaactgagttggtgggcatctgaacatcaagtgatccacatcttcctctactccacacagcttgcataaggggctgccaggccacttcatttttttcagttgtttagcaacttggattctccccttaatcattaaccacataaaattttttatttttataggcatcggtgacttccacaaaatctgaagctgagcatctttaatgcccccaaaaaccatctctctatataaggactttgtagtgaactttcctgacttttctagcttccaaagcatcaaatctctttctgtcgataattggatagtagcaagctttgcttgcagatctgtccattcagccacctcctcttgggttaaggtccttcgtagattaatttcccagtgccttctttatacacttgcttaaccgtcatccctggatcagcactgatgctataaatgtatgggaacatgatttttaaaggaacctcccctatccagatgtcatcccagaatctgatggccgccccattacctaccacataggcactgccaaggttcatccatcttttaacctcgtgcagacctttctaaaactgggagcccccctcaacagatgattgaaagaaacctcccccattagctagatatttgtttctgagaaggttgcagcaaagactatcagttccagattccaacttgtaaatccacttacaaagaagagcctcattcatgattttggtgttgagaaaacctagtcctccatcctctttgggtctacaaagagcctcccatttaatcatatggtactttttctttccttctaaaccatccaaaaaaaacctcgctctgatagcatccattttgtggtgcacttggtctggtaataagtagaaacccatcatgtacatgggaatactacttaaacaagagttgatcagtatcgatttacctccataagagagaaaaccacatttccaggtagccaatcttttttcaatcttcgcgactggcactcctaaatcttttgctgtcagtctcccctcactaacaggaaggcctaggtaaaaaataggtaactcccctcttttgcagttgaagagatcagccacactctctgtgcttcctggttcctctgctccaatcacaattacttcactcttttggaaatttatcttaagtcctgacatagcttcataacagtataagagaaatttgacagttattatgttctcctctatgtttgtcatgaaaagtatagtgtcatctgcatattgcaggtgtgtcagccctccagtgaccagatgtgggactaacccttgtaagtgaccaccctctttagctttatttagcatctcagaaagagcatctgccaccaagttaaacattaaaggagacaggggatccccttgtcgaacacctttgtgagtcctgaaaaatttctccacttctccatttatattgatagccaccctacccttagttgtagcatctttcatccagccaatccacttttcacagaagtctttcctctaaagtacatcaaacaggaagtcccaatgtactttatcatatgccttctcaatgtactttattatatgctccttttcttttggcatactataagtaagaaaaacttcattgttcctaattatatgcaaggaatatataggttttggtttcatgtacctttattttaaaaactcctatgaaaatgtgttgtacagttggttatctacacgcgtatgaccgaacggtgagtgagattctagtgtaatacagtaattttcagcgcttttgttgtcaatattattccttaactaccttaagcctatattggttaattatctcagtataaatgagataaaacatgaggagtaattgcattggagcatatataacgtgttggtgccttaatttgtcgttgcaaattaacatatgacaaccatgttcacgacgtactccctccgtacttataaaggaagtcatttataaaaatgtttaagtcaaaccttaagaatataagtcatgaataactctcaagttgttgagtttgaaaatataaaaattatatgtatagatttgttttgaaaaatactttcataaaagtatacatatatcacttttcaataaatatttttataaaaacaaaaagtcaaagttgtgttttggagaccgtgtcgctgttctaaacgactttctttacgagcatggagggagtactaaataccccctatagattcacacgtgtgacagtgaactgaaccgcatgcagcaataattaaccagacgtgccgtccatggacgaaacaacagtacatggcgggcaactgcgcgctgtaaaaagccgtcaaaatgtagcccccaatgacccgggacggacgaccgatcagagaacagaacaaaaacgtggagcaatgttgatcgtaaggtgattgtgggctcgatttatatatcgttcgcatgcgcaaattaattaaagtggccatacatatatcagcagctcgtagtacatgttgctgggccatgcatggagaacgatgatcacgggcagtaactccaaattaatcaagcttgcatacacatgtacgaatattgttcatgtaatgcaactatgccagtagatacgtacg

SEQ ID NO: 25252 - DNA, 41864 bp, Oryza sativa
tcgtgccaaaaacggcttctcccacaggaaaaaacggtagaaattttcctctcctcccggatcgcgacgcgcatgcagccgcgatggggggagatggcgcgcgcgtgctacaccggtgcgggggttggtgattggggaccacggtggttttcacgtacgagcgccgctagctagctgtgaagtcgatcgggataggggaggggtcgcgccgtcaccgtgtaggggtgtgcagctcgatgattgagttgtgtgtggtttgcatatgcacctgcaccaattattaattgtggcgcacccggtccagttatatgcatgtttcgtacctgggtaaatccacctttggattcgcttgtaccacgtgataattggtgtagaatttggccccatagtaaacagcactagagcagatcagcactgtcattcacattagcagaccggcaatcaactggagtacatacttcccaagtgacaaatcctgtaatagcatatactggagtatttgtgtgtcttaaaataaatacaccgcttatacttattcctggacacggagggagtacaaacttttatccttttgcgtatttgtgatacagtactcgtcacatctcgatcaaacgacggagtataccagagaagaagaacgaggcatggcggcgtaggcgtgcatgcatgatggcagggcagccgtgcagacatgcaaaataacgaaccagtgggtccctctaggagaggagctgtgatgacaagactaggcattgcatgttgcaggaacagcatactacccctagtagtactagtagtgttgcaggtcggatgcagagatcaccatgtccatgaacactgtttgccatgccgtcccgggagtagtagtagtagtagtaggattgctcgatcgtttcttcgtctcgagatcgtcgtcaacatgcatgcgctgcgggcggcggcagtagctagcaagcagcggttgatgggctaccatggacgaacacatggatcacatacgttgtgctggtgttaaggctgtgtttagttggggaaaaggaaatttttgggtgtcacatcagacgtttgaccggatgtcggaaggggttttcggacacgaatgaaaaaactaatttcagaactcgcctggaaaccgcgagacgaatcttttgagcctacttaagccgtcattagcacatgtgggttactgtagcacttatggctaatcatggcctaattagtctcaaaagattcgtctcgcgatttatagctaaactgtgcaattggtttttctttttgtccacatttaatgctccatgcatatgtccaaagattcgatgtgataggtgaaggggaaaatttttgagaactaaactggccctaagtgtgaagcgaagatgatccagttcaaacaccatgcaatgtgttgtctcgtcaatccgtcactctggtcgccgttatcttcatactggtatttgatatccgtacaaggaatccgctccactgctgccaaaattgaatcaaacagtgtgtgttgacaccaaaattagaagtttagttgaaattgaaaagatgtgatgaaaaagttgaaagtttatgtgtgtaggaaagttttgatgtgatgaaaaagttagaagtttaaagaaaaagtttagaaataaactcagccaaaagttatataatgtaagctcactgggcctagatttttattgctttatgttggctgtgtttagttcatatgaaaattggtttggttgaaattggaacgatgtgacataaaatttggaagtttacgtgtagaaaaattttggtgtgattgagaagttgaaagtttgaagaaaaagtttgctactaagattagtattatggcatagtaatattgcatactattccaaaaagaagacaaaaaggtaaccttagtagagaccataacaaaatccaaaacgacaactagaaaaccataatacatttccgcctacaggaggaggaggagcatcgcatggtgcagctttcctcggacagagcagcatgacaaagagcatatggagggccctgttcagttatccccataaccccgtttttggcgtttccctgcagttccattccatgcagcgttttgtacaactgcatgcagctgcctgtgccctgtgccctgtgccctagcaaacaagaagtacttgtatacgattgctggagtaatttgcacaaatgatgccctctttttcctgcgatcgatcgggttcagagtggctcttctcttccatcactgatctgatcatcgtcagacaaggctagctctgtagcagcagtaaacagggcgtcgtttcatgccgtgtcatgtcagctctgcttgccacggtagcgagatctacagttgcagggcttagctatagctcgtcacgatcagcaggtcagtttcgttagagttgcggcgagatgagaggaagcatggatgagccgtagcaacagtctctagatgccaagttcaggacttcaggtttgtgccactcctctctgcctgccgctaccaacaaagcctgcaactgcaagagccaagagaccggctggcctgtggcctcttctttgtactctcactctctaaagcaaagtgatttgtcgaagctgaaagcatctgacgatgcaaattaattagtactcatgaggcttaatttctgcagatctggtttcttctggcaaacacagctgattgattgtagcatgatttcagagtttggagagcacaaatgtttcgttgacagttttcaggacatgcatgtgaattccaaagcgattcagaatgaactgttccatttctccctgccagattcataggccatgcatgcattgatcttgctttcttgtggcaaggacggcgtgagtgtctttctttgtccactaatcatcagaggagtagctgcaaacggcacatgggttccacgcaaaacaccaagaacaatggcagatatggtgtacggtgcacattaaaatagacgatacggtcgtagaagctctcccgtccctccattcaagtactcccttggtcccatgtaaaaaaaaacaatatattctgataatctagataggtatacaatatagcataccctttaacctaaaaagaattaaatcctaagtacgaatctggataatgcttattcatgttaatagctatgatttaagttaagacatgtcttaaaaaaatatcattaactaaattattgattagaattatttacttgattataataataaaaataattttaaaaatagattcaacaaataacttctagcacgtggtctaagtaatgcagccgaagaaaatttgttaacaaaacttatttttaaacatgtgatgctggaaataatctatggcaataatttgatgaagtgttttattcacccattcattttacaacaagccacataaaaatttaaattttagaattgactcagagctttttctctatattttgtagccttgatttttggataactaattagaagttaaaaaaagtgtcgaagttaaaagtcttaccgtcattttttttgttgcttcattacttttttaggtttataacccatagctcaaccaataaataatttgttgcataacacaaatgttgtagtagtaggctggaatctccaaggcatggtactagtttcaattaaaccaacactagcttaaactatttcgattttaaatagtaatctgaagtcaaacgataatttagaataattctcttgtttctatacgggacccttagagcaagtataatagtagactataagccggctaaatgctaaggtgaaggagagaagagaggagagagaagaagcgtgctataaaattatagccagcttggacacaagaaccaagaaactctgtgagagagttaagtgggccctgtattaattataaagagctaactattatatggataggctgagagaaagctacaaagaatcttatagccaacaggtcagcttaggcttgctcttaacatgccacctggtctgaaaattcccgtgccacaaaacggggaccttgtgtcccttttggtcccatgcatcgtcgttcttaacaagcaagatcacgttttggtcccctttcactaatcatgggaactaacaatcctgttgataagatgttcattaggccactgtttattcagcacggtttctattttataggtccttttccatgttcttgcatagccaaacttaattgataaatgagaataggccatgtgctaacacagagttctaaacaagacagcacggaaacaaagccagtttaagcgtgacaagacatgggagagagcagcacgtaacaacttctccaataataccccagtcctattttaaatacagttgtaggttgtgtctaatatttaatcatctatcttatttgaaaaatttataaaaatatattttaaaaaagtcacatataaaataatatttatattttatcatcaaataacaataaaaatattgatcatgaaaatattttaaataagatgaacagttaaaggtaaaaaaactcattactatatttaaaatggaatgaagggagtaaaatcgacaagacatgacactacgattgccaacgtaaccgagagtcatcatggacgcctatccataatcagacgaggttgtaggttggtagaagtatactaatacatctgtcctaaaatataataatttttttggtatgaatctggacatatagttatctatatttatagctaaaaatacttatattttgaaatatatggagtatatgtttgttcagaaaatggcagagatatgtgtaaaacgacatttcatatgaatgcacactaaacgagggtcactttctcgtaaacaaactaatctagtatagatgttgaatctcgatatctctctattcatattgatagtatagtgttaggctgttagcatatgttatattcagtattagattgagtatttttagtagggctaacgccgaaaatcaaacaaaccatttgatgaacattttttttaattcacagttgttgttctacctaaaaatatgtttaaaatgaaacttaattgaaagcttctttgagttacagtgtgctgtacaggttggagtcgcatgcatggctaaacgggagaagttgaccgagagggcaaaccgaggtgtagagccgtgagcagctcagcatcgatctatggtcgatccagtaggatcggtcgatcaaaatcgaaatggatctcatgagatagctttctgaccgaagccgacacttctctagtccccagaaaataacacctttcgcccactcacacgacctatggtctggaatgattattgtttctattatgagaaaactttttgtgaattctgacttgaattaataaatagtaactctattgtatttagggttttttttagtagtttagcaaagctactaaaagttttcttttggttttgcaccaaaaatgattagaacgcgacataaacatatcagaattgtcaaatgttatgtagcaaaaagtaactgtcccattcgtcttgttttcacaagtaacagtgtgctactaaaactgtagtttggtttggcgcaaaaaaaaattctttttctactgaattatcacaaaaatgttaagatcacgacatagacaaatcggaattatcaaatgttctgtagtaaaaattgaccatacataaaactgtcccattggagcattgggacatcatggacacggttcaaacatgtggacaacactagcccgtgcaacaggagcacctaaaccgcagactccgctcactcatcctcctaatcacctcggaagtttggaaagagagaaatacgtgagtcttccagcacatcaccacaacaccgatcataattatgggtaatttggaaccatgtcattataaattttcaaagtttgaaatatgtcattggtatctcaaagacacatatgacccacatgagtcaatgacatatggattaggatggtatatcttaaattttgcaaaatataatggtatggttacaattttccccataattattgtagcataaacaaaagaggaggccagagcttggtgcctagtgagggcaaaaaaaaaaaaaaaagcttaaagagctaatgttgttgtgagaatagtcccctatgtaacaccccttaacacttgcacaaaactaaaccttcttctttgttaatgaaaggagactgtccttctaccctcttattcaaaagaaaaaaaaaacagactttttcaaaagtaacagttcttggtacaaagagcggacttttcttccctaaaaacttttaggccccgtttagttcacgagacgaaaagtttcaaagagtcagatcggatatacaaacacacattcaaagtattaaacgtagactaataacagaacaatttacagattccgtctgtaaactgcgagatgaatttattaagcctaattaatccgtcattagcaaatctttactgtagcaccacattatcaaatcatggagcaattaggcttaaaatatttgtctcgtaatttacacacaatctgtgtaattagttttttttctatacttaatactctatacatatgtcaaacattagatgtgacagggtgaaattttttttatttacgaactaaacaggtctttacatagtttgaacacgggtagggctgtatttagttcacaccgagattggaatttttgttgaaattggaacgatgtgatgaaaaagttggaagtttatgtgtgtatgaaagttttgatataatataaaagttggaagtttaaaaaaatattttgaaactaaccacggcgtaggtcgaggtcgatatggatcgtatcaatcgatcatggcggcaggcacgagctaaggtacggtggcccatgcaaggcaaccactggcaacaggcaagcaaagcacggccgccgctagctccagctccatccaactccaagcagcctaggggcaacattttctccaacgcgacacacaacacacaagtggcgagctcgatcgtcggctgtccatgccggtcaaaggacatgcacaagctgccattggtggatgcatggcccgggaccgacaggcgacagctacatgcgtgcaagtaccatggccatttgcagattaattcaatgcccaaaccctctctcgctaccatcgtttcacactatttccaatgatcatttatccagttaattgtccttgatcgcaacaaaatatagttcctccctccaggttgtaatacccgttgtttcggataaagacatgatttaaaaaaaacaactttaatcattattttttattataatatgtatataattgttaataaatatatgattttattaaagtactttctaatactaatctatgcatgtagtcacctgtcggtgatatgggcccgggaatatgcacagtaaaggaaagtatcgatcccatctagtcgcataaccacgcggcctcgtctccccacgccccacggatagcgctaaggtggccagggagcctcggggtgccacatcacacccctcgggctttcgggacgctctaccccgaggccctcgaccagccaccacgtggcggggagagcgggcgaggcaaagggcgcctcttagggcctttaatgcgcggcactccaaccgttcctcactgcatttaatgcggtgtgggtggacgtgcggccccgcccgatagacccatgtcaatcgggcgtgaccggtttatgaccggtcacgggtgattggacgggcggtagcgtccccacgtcccaccctgtgtcaggcggagtgggggcaggtatgccccgtcctatcgatgcactgccaggagcgccctccgcgcgtggtgagccaccaaagtctccatacatttaaaggggaatgacagggatgtcccccgtgtcaggcgggggacggtgctgggccccacccaaggacgcacgaccaccttgcttttggttgaaggcatgaatggcggtctgatccagacagggtgggtccccctcccatgggaggggtaggtatagacggtgcatgtggtatccccttgaactataaaaggagaacctcgcccatcgagaaaagggacgactctcgattgcttgagctctagaggaataacagctaggtttccctaggagctcaagatctcttgtaagacctaaccataatcccacacacaggagtagggtgttacgcttcccagcggcccgaacctgtataatcccttgtcttccacacaaactcgtgaacgatccagtagttagatcccaagcggaagtacgctcttgatcatcgcgccatctcccccggccgaactcacaaagggaggtctcacgaccacccgctagagaggatcactcctcgacatcacaatatttgaaagacaaatattttaaaaatgattcataatcaaagattctaaagtttgacctcactttttgtctaaaacgacaagtattatctgcccagaaggagtatatagcctcgtagcttcgtttatgtttataaaactaaaattcaaatttatctgtttataaagctaaatttcaagtttacaagataaattttgaagttgatttatggaaaaaagttaattacagtttagtgttttataacatgtgtttttcaatagctgagaacacgtatataaaagttttacgagaaacaaaacaaattattttgtttgttaataaatagtatggataaccatgtgaataagcaaggaaatgaggctaataaacacatgaagaattctcactatcttacatatataagaagatatatatatatatatatatatatatatatatatatatatatatagtttttgggaagtgtacacataggtagcgagcaaacctaattaacccccattacagcaagtacaaaattggtagccaatctttgggggtccctgcacaggggcccccacaaagtccgtgcctacctagtcttgtaacagggaggagtttgcaagcttagctgggtctctcctctctcaaaactcgtcaaaacactgcttgccctaaagatggtgaccctagccagccaaaggccacaccatcatccatcaccacaaccacacacacactctctttctctctctacaatgctactaataatcataaggggattacaattaagataggtaatgagagcaactaattatataatagtagggggaggtgttcatgattatctgtactagcgatcgaaacacggtttacgcgtacgtgacgatctgatgatgatcacgcgagaggcgacctgtgtggggcgcccttcctcctgttgttcagtgacagcacgatctgggggaagaacccgccgccgccgccgctcttcttcttcctcgggacatcggccgtcgttggcgccggcgacgtgctccggccgttgttgctggagccgccgccgccgtagtactggtggtggtggtggtgaagggggtcttcgaggatggagttgggtgtggtcacctggtggtcgtcgtcgtcgtcggagaggccgccgccgccgccgccgccgccgtcgacgcggaggttctcgaagcgcgggaagccggcggcgaggtcgggctcgccggaggagccgccggacatgtagaggatgttggagaggtcgccgccctgcatcatcacgtgatccacctgcatgccaatgcatgcacaaattaattaacgacacacagtcgttgtagttagtagctcactctcacatctctcgtgacaaaatttttcacccgtcacatcgaactcaaatgtttgatacatacacagagtattaaatatagaaaaaaaaactaattacacagattacgtgaaaattatgagacaaatcttttaatactaattgctccatgatccaacaatgtggtactacaataaacatttgctaataacaaattaattaggcttaataaattcgtctcgcagtttacatgcacaatttataatttgttttgttattagtctacgtttgatacttcagatacatgtccgtacatctacgatgtgacacgctaaaactagtcatcctagatctaaacccaaccttattatcattagagttgtgtgtcgttaattaatatttctcaatcgatcgccaattcgccatgacagtaaaaaaattttctggaagatgtgtacagtggctatactacactactgtaccttgcaagagaggcagcagaaatggaagggctcctgcaggatcctgtcacatgtcaagcagatgttgccagagcccttgaacggcctcgactgaggccttggcttcagaaatatcacctttgcgctgttgatcgtgtatggctgaaatcaaattagaaccaacattaataattagctctacataatagtaaaactgaacagattagtttcagagtttttattgccgttcaatttacctgaacaaaggagcagtcgatgagcttgtcgagatcatccaggcgaacaacgtcgttgtacacatacctcctaacctatatacacgtataagcacttcaatgcacagtatacttatacgtacggtaccgtttaattctagtgctagtaaaagaatcttcggacccatcgtttgcaaacaaaaagtaatttgtgaatataacttttatatacgtgttttagacaatataaaagtaaagtttgaaaaataaacttcgatgaaaaaactctcaaaatcagctctaaatttaaggttaaaaatttaaattttagctgataagcataggccattattccattattccatccaaattcaaattttagatgagacccttctagaagttgtaattgttgatgaggtaaaaaaaaattccattattccatccggacgctgagccaggcagggaaaggatagactcccccggtaataattgcgagcctttgaccggcggctcgtcgtcatccacatcgtgggagggagaaacaaaccctaatttaccataccacccctacaccttccacttctctcggtcacacaacccgaggtcacaaatgtaaaaaaaaaaacacctccaaattaaccccatgacactgtaaaaaaaagatagagagtgtgtgttactgcctgaacgaatgaacagtatcgtcacggcgaccttggattatacagagccggagcaacagtattggggccttgtttggtaggaggacagggtcttttaccaagcacacatatggtaaaaaaaaaaacagagacactgctcacttttttttttactgcatctcgccaatggcttctctgtggtctgtagcctgtagtttctgtcactgtgactactgcagctgcgatcttaacagctctggctttggctgagacgatggatggatcgtagctagtatggctagatagacacaggattgcccatccatttatcaaccaaccggcaccgtctatctttgcagggatagagatcaagatcggcatgctttgctattcatggctaaacaatccggataacccaacccatttttgtgctaatagatcaatcttgctcactgctgcagtttggatgtatttaagaattagagcttttgtagttgcaccagactctctctggaaacacacaaattttataaaagtttgacaaaaagaagtggttcattttatgtggtgatcagaagtttttactggttaattataatggagagcaggacacaagggctattgtttgtttaccgctgtcaaaaagagagatggccttttttcatcagaggtgatgactgtgtgtgctggcctttgctgctgctgctgctgctgcaaaatgtaacttttgcaggtggtgaggtgaacagaagagaagagagagcaatgcattgcatatgctttgcacaccggaatggggaagatgtaagatgggactaggcttaattataagactatggttatttcaggcgtatgggactgaggctcgcagtaacttcttgccagagagagactcatttttcacccttcttcccaattttaaccactccacatttctactactcatggcccaccaaacagcagccaaggacaggaagaaaaattaagtttggcaaagaaaaatacgcaagaaattaaggtggtgattagcagtgtgaaagtactaatgtgtgatttaggtgactaatcagggtgattaaccgaggggtcactttgcaaggagcacaaaacgaaggccggaaaacgacaaggggaagacgaaagatgggcacagggttctaaaagggtcgagagctatagctgcaagtggttaagtgagacaccccatgcgatgcagcttaagcccaagcaccgccgcaattaagcccaaccaaatctaaccaaattatgctagaaatactactgctactagtactcctagtggcacactagcatggtcgctgatgagaggcaattagcaatctttcctctgaaaatgacacaattagcatgtcatggcacatggaagaatcaacaagatcctctagctgcccacatctactggtactagtagaagcaaatcttggaataagccaagacggaaaggctagtgaattaggccaaagctagtgcttttttgttaagtacaagctagtagctgctatacatgcaaaagctaaaatcctagcccacacccccacaaatccactcaattcagcacactgtagcacacccccaacgatttcaaagcagataaataaacttgtaattgaagaatttcaacagactaacacactctcacatcacatgcataatctgaaattctgaatacagttaagatactgcaattaattaacgaagaagatagacatgcatcatatgatgcatgtagctagagatatatgcagtgtatcgaggacatgcatggcatggcaattgggtcgccggcgccggcgccggcgacgaagacggcggattgattacctggaggaaagggtggtggcggtgggagggggcgcagtgggggcagatgctggcgcagcagccgaggcagaagatgttcttctcgttcttcttgcggctctcgtgggcgggacacccaacgaagaagctctcctccacgagcccccctacccatccaggcctcatccccatcaaccccttcgtcttcctccaatcctcctcccaattctctcactttcttggccacagctacctagctaccaacaatctctctctgattgagtgtatgtacgtgcgtgcgtatgtatgtatgtacaggtgagaacagaaattaaagatcgatgcgagtttggagaggcgaggagaggagaattgggagggattagtggtggatagcaatggaggaagccatggcagggtatatatagagcgggagaaggtgaaggagaaggaggaggagcttggtgtggtgtggggcaatggcgtcaaggggacaccatggggttcggcggtcaaaggaccaattgggcgtcacggtccaagtgtcggggaccttctcgacaatatccaaccaacttgaggggtgtttctgaattatccttgctcccatggaaaatgatcggtctctgcaaattgattctttgctaatttaaaaagtactaataagaaaatggaattttgtagtgccgtttgtacggaaacaatgctaggccgagcggaaattttcgtgaccgtttttgtccctcacaactttgtgtgcagtcgggcaggattagaataacagcgttatggggtgctttctgcgaagggttgtttcgctttgccaagggaggaggttattgccacctgcgattcatgtcacgactcgtgagagaatataaatcatttttaagtaaatttcataaaactataaatattttaattaaattttaacaaaactagggatatatcacaaaactataaatttaacggcaaatctatcgtaactttaaggctaagtattgcaaaactataaatttaataataaaattatcacaaaactacatattttaagctttagttccttaccactaatgttatatttgagttatgaatatccaaatttagtgattaaattgacactaaacatgtagtttcgtgataattttgttactaaacctgtagttttgggatactccaacttaaatatgtagttctgggataaatttagtgttaaatctgtagttttatgatatatcatcttaaatctataggttttttaataacttgacaaaaatatttatagttttgtgaaatttactcatcattttgttttgggtaatttaatacttgttcactttattatcaaaattaaccaaatatttggcactttcaaaattcagtacatttgtcgctactaaattttggtgtcttttgatatgtcgtttagtttgaaactttttaaattttggtcatgtttttgtgagagattttctagaacttccaaattctaataaggtagatatggtaagaatgtgtttattttgctatcctaccaaaattggtaatataaaaaaatagcagggttaaaaatgataatgaagtgaacttaagctgttgtttgcactgatgaagtgatgagcattatacccctccttttattttattttttttgaggacgacccctttttttctgtcatcataaaattgacgaagatactgataatttcacatatctgctgctaatcttgatggacatcggtgccataaataaccatcttaattatccaaaaactgccatttgttcttccacctttgaccacataaaacaggagcaggcattcccacatgcaacagccgcacggctgcctgaagactgatatgattagtgcctgatcgaatgcacacaaatctttttcatcagctaccatagcattagcgtggtcctgatctatgctactaactttttaatgtgttcttgaacacagtagtacagcacagacaagaagaaaataaacctcctaggttgctgaattccagtcatctcaaaatataataacttttagctattaatttgaacacatagttgtctagattcataactaaaaatgcttatattttgggatggagggagtaacaaaaactgcaataccactcgttacaatctgaaatccccattcttgtcaagccttaatttcaattttttttcccttcaacacatacacagcttctggcattattcttccctgctcttcacaacctgatcgagcacttactgctgctaccggagtagtacaagtttggtaacgagagaagaaattcgagctgttgctggtgttcgtcgctgctcacacagcatctctgcctttccggttagcccagtacaaacagtggtacgtactgctgccttttggtttcttgttttatgtggcccgaattcttttttaccctcgcagcaatttcaaagctcctttttacaattttttcacagtttcttggccggtagcgaacgcttctagcttttttttcatctcaatggcgcagtacactctgtaccatctgctatctcctacccaaaaatataaaaaccttgaatcagatgaaacgttttctagtgcaatatatttgaataaagatatattatactagaaaacatcgagtccatccaaatacattgtactatagaaatgtagcatccggttttaagtttttatatttttgagatggagagagtagtactacggcagtgtttagttcctcccaaattcccaacttttcatcacatcacatcacatcgaaaactttcctacgcacataaactactaactttttctccaaactactaattttctcccacttttcaacttttacaccatctaaacacagcctacgtaggagtacgttgtgttgcttcaaattttacagctgtatcccatttcatatttcttggcatgctagtgaacttctctagggagcatatttggttcattggttgttgagtagtagtactaccactataatttggattgctagctactccctccgttttaaaatatttgacaccgttgactttttagcacatgtttgaccgttcgtcttattaaaaaaatttgtgaaatatgtaaaactatatgtgtacatgaaagtatatttaacgataaatcaaatgatatgaaaagaataaataattacttaaatttttttgaataagacgaatggtcaaacacgtactaaaaagtcaacggtgtcaaacattttaaaatagagggaatacattatttatagaatttcttgcccaagttttgtggagcttgtaggggatgattgtgttagctacactaaaatgtttttattttgttaggtggagaccaattatatctagctagtagtttttcctggtaccattccttttggggccggtctgtggatataattttcggactcagcatcattgcatttgatcagttcctggccagatcatcagtttagcagtttctctaacacgtgtttgtagtgcacatgacatgatcaaccaaattcgctcatttttatgccctctctggcgcatctcctgcgcccatgtagttgcgaatctattcttaaccttaagcaatttttagcatgtcctagctaagctagagtgtgagatctatattatattattccggtattatttcgcatgtgcggccttgtgcaattgtgcacgctggtggcggcgtaaatcgtttagggccgtcctaataatttgaaagccatgtgtcaaatataaaaattaaaagtcttatctttagtaatactaattacataccccctccgtccaaaaaaaaaaataatcctgagtttaaatctggatggatatatatgtgtccagattcaaatctagaattagtttttttttcaggttcaaatttaggattggttttttttaacgatatgtgtcaggattcaaactcaatattaggatttttttttgatgaagggagtaatagaataatagaataggctatatcttatatttacaatataattaaattgcagttagtggccttccaaccatgccaggaaagctagtatcaatataatgctcctttatttaattagctaattatatcctgctatcaaacgaacagaaattattcgcaaccaataattactagcgctatgtcaagtagcttaattacccacctaaatatgtatgacgatctgaccaagtagaagaagaaccgttgaaacaattcagctttttcttactaaaagaaaaaataaagctgtagccatgcatggttactatatcgaagcttgtcggaattaaaaaaaaaaacagcttgttctagccgattgagtggagaaaaacagagatttgagaaaatagaataaacagattctaattatatcggaacatattgccttgaataatagctagatacatacggagtgaaagccctatacggttgcacagctcacacgtgtctctagatatggacggacctgcgctaaatataaatttcggtagacacaacacatcaacagcctaatcaacttggcatatactactccctccattttataatgtaaatcattctaacatttctcacatttatattggtgctaatgaatctagacatatatatctatctagatttattagcattaatataaatatgagaaatactagaatgacttacattgtaaaacggaggaagaagtagtacgctactgtaaacagcgtcggtaaatcacctttccaacctacgccgccgtacgtcggatcgacaatctcgccgacccaatgattttgccggccgtacaagcccttggacctcaccgccggtgacaaaatggtaagtgcaatgcatggttaattagccagccatgagctagcaaattctacgcaacaaatcacctgctgcatatatatacactccaaaaccatcaccaatatacagacgacaggccggttcaggttcaggccatatatatatatgctctctaacctgaaactcgatcaatgcaagagtagcattggtagctaaaacaatacaacatctcgatcaaaatgtcattatctgaaaataaaacaaattgcaaatgcaaatgcaaatgcagcacatgttgtagtggatagctactaccactagtggcatgtactagtgctaccccggcctgcatgtacttgctacatgtgatggatggatcaaagtaggggcaataagtgcgagaggaggggttagccgtcttgacgacggcccttgtcgtcgagcccgttttcggcacgcctacacgagccctaggggtgtccatttccggcctcgcatgtgccttttaactcttgctccagtaacctgatcatattatgaattcagggtgtgcaagtcaagagaggaggagagaaattcaattcaatagctgatcctggcccatgtacatgcattgcattgcatatatatgactctgtgctagctgctgccattcgatcggtttatcttatccatcaagtgtgtttgtgtgtgtgtgtgcaagcaatattatggaaaccctgtgccatgtgaacggtttctttctctctcacctgaacaaagctaagagcatgccatgataggattggtggttgaagaaggcatggaattttatccatgtgcgtgcgttcgcggttggactatccgcttggttcaaggtagcttttagcagctgcagggtttatcttttcgtttttgaaataaaaaccgcttcgtattggtttactgaaaacataaaactggtgaccttcggtaagcgatgtacgaaaaccagctaaaacggatcggttttcacaaacagacaattaatgtttttacagaagatgtatgaacggttttgcgaaaaaaaaagatcggttttgtgaactctaactttatttctaatctccaactctctccaaacaattcatatttttcattcaaattcttaaaatctgtagttataaatcctaaaaaaaaataaatcaaagttggttattactacctttgaaaaaaataaatctgtagttattgctttatgaatttgatttttatgcttcttcttctctctttctttttaaatattcagctttgatgaggtttagcaggattgcagctaactgatgtctatgcatatgacaagagcaataactctgttcttgtcaaatcaggatatatagtataggtgggtgaaatagcatgtgtgcatgtgttgcatttagaagaaggaaatgcatcgagagaaattaaagagcatgcattgcattgcatgctgcctttgtcgttgtccctagccaagttttgatgaggatcacagaggggcccaaagtgcatttaggggactgtttccaatacacgcctacaggcatatatatccacggctcacatataaccaattttttgttagtaatagaagatttgactgaaactgttaccctatcataacccaagatctctgtcctactactactactatttactaaaaaaaatagggtgcaacaaaaaattaattaattaatttattaacatgcatgtcacgttttcgcaccgctgatgaagcccaaacttaatttgcagcaaaggacatatatatatgtgtccagtgatgaagcccacaggtaaaggccttcttaatcttgagattacgccaagaacggcccatgtatcatatcgtcggctgtgttgctaagatgcttgcgtgctcactttcagcttggaaaaacgcaatgaacagttgccggggcctaggcttcgtccatccaccatggaatcacctacgtgagagcagtattgcagtaggttataccacacaacgaatttctgattaagataggttacataattaacataatcgttcaattaagatgcacattctatctcgattttcattagcatgtttttcaaatcaataaacagcttttttttaaaaaaaaaacttagtagcaccctatatcacccgttggttcccttagtcgacatgtatgaatcgacctatggtgggcgggacctcatgtaagacgctgggcctcaaagtatgggtcaaagcctaaatcatagagagtgatatccccatatacgaggagactagcttttgggatctttcttggtcaggctccgattaagctcttcttagtgaaataccatgggggtggtttttcccaaccaactaggtttatgtgaaaactttatatttgtaagttgccctaaaattttaaataaatttatttttaaagtctataaaaatttatactcacttaattatataataatggcttaactcgttttacatgggctaaaaaatcttcgtgtgctagtgagaatttgggtgaatagccaaaatggtccttcaagtttcatctgatgctcggtttagtccttgatgtttcaatctatctatattagtccttcaagttttcattttagttcaaacttatccttgaaccaacaactctcttcataaatgacatttataccctcatcattcacatctataagagaaaaattgcatgcttcaatttttttatagataatacatagtatattatgtaaaacgaaaaaaaattatgtactaacaagtgtatacgatagcaatggcttaagttttatgtgcacatgttgaaataatgggaagtatatctgtaatgttgtttattcatgttgcctttctcttttctagtatatagatatatacaaaattagggtaaaaaggacattttctaatagaaatattgatagaaatagccatatggcatattaagtgcacccaaggatgatttcaagtcaaaacaaatatttgaaggacctatgtggacaaaatgaaacgtgaagaaccaaattgagccttagctgaaacttgagggactaaattagctatttacccataagaatttcagtgtggttggtgtttttgaaatccatttcatgaaacaatagagatgcaagtgggtagtctcactacctgtataaaaactcgcttgctagtttatttctcacacaataatataaaatttaaaagaaaaaataaattaaaaatgagataagcgggctaaaaaaaacctacatgcccgtccggcttgcatgcctacgaaacaatcccatgtgtggcagcagtggacaccgtgtggccgccatgtgaggcgcgggcgctgcacctgtgcgacgatccaggatgtgacgcgtgcccccttatcgtccgtacgatgggccccaccgtggcctgaagtgggggaacatgccaagtggggcccggcccggccgacctctttggagttgttcctgggccgtcagatggtctcatggaagaggtccaagaggaggacgtcgctcccgcatgttaggacagtttgtggggcccacggtgtcagtgacagggcgttgtgcctagtcaaagttgttgactggctgtattgcgtacggaaccaccgactcttaccatcgagatggattgtgacgtgcagtgttacagcttagggtgtgttcggcagctcaattactgtggctgtttagttggtgaaataaaaagttttgggtatcatatcagacgtttggtaggatgttggaagaggttttcggacacgaatgaaaaactaatttcataactcgcctgaaaaccgcgaaacgaattttttgagcctaattaatccgtcattagcacatgtgggttattgtagcacttgtggctaatcatggcctaattaggctcaaaagatttgtctcgcgatttatatgcaaactatacaattagtttttccttttatctatatttaatgctccatatatgtgtctaaagatttgatgcgatgtttttgggaaaagttttttttaactaaacaggcccacagtggttgtgcagtgctgctgctgtagcggctatggctgaaattgtatggtgctactgtagctattggctgttagtacaacttttttttaagagctacaacatgcaaatttcaaatttgattcgagcttatatgacatgcgccggtgtatttgataggtctaatctcgcatttcagatgtgccgaaacatataagctaaaatattagcatccatcccaaaatataaaagttaatatttactgctccatccgtcctaaaatataataatttagaactggatgggacatcctggatgggacatccggttctaagtttttatattttgggacggaattatcttgtggcattaaaattttagtgtaaaatttagttatctaaagttacttttgtaaaaacagtttaaaatttttcataagctaaattttgcagtgctcatgtacgactgtcattgttgtatcttcgcaccggaaaggccaaaacagaattatctcgttaggcaagtaggatgagacgatgccacaagtagcatgagatgagactacatagtggcatgtgacacctttacatactacagctcacatagattagagatccatgcgtacgcagtcctaaaatataaaaataaaggaatgaaagcaacatattctattactgtgaatctaagccgattcatagtacaaatatacatctcattttgttatataggtttttataatttaggatgaagataataatggctgccacttcactcaaaacaacacaagattggaaaagatgaggtctttcgagatagaaggagtgggaaaaggagagctcaaagctcatgactcgaatcagctcggattggtttaaaggtaaagtcgtagcgatatagtaagttcgagccaaattaggcttttaagttttaactagtaagcttaacgagttagatcgcgagctaccttgttagtataagataccaacgtatctttatatactttgtgcttacttagcattttaattacatctaaactacttacatttagtgagttctttattactttgtgtttattattatgttaatataagataaatttaaaattatgaaagtaatataaatgagatataagaagtgaagataggtactccctccattctaaggtcttcatcggttggctttttccctaacaagccaaaacggcttattagggaataaaaataaatttgtaggtaaaacttttatatatgtgttcttggtgacttaaaagccaatataaaaaagaaactacgctgaaaatatctcaaaatcaatctccaaattaagtttgaaaatttaaaatttggctttttctttggctgattaggccatccgatgagagcctaaaatatactacaacttctactcctccgtcctaaaatataataacttatgggctttaatttttttccaaaaacatagattctctttccaaccaaccataacccctctaccattcaattttttcaactacctccatttctcaaccaatcacaatctcattccatttaattctatatattttcttaataatcgtgtccaaaaaataatattccgggacaaaattagcagcatttaaaattcgtttcaaaatataacgatttcttcacttttattgagttctcaaccaatcataatcttcgaccatcaaattctccacatatcttgctttttcaaccaatcacagtcatttctcatttaatttcacctactaccactctaaaacctgttatattttagaatagaagtagtaactcattaaacatgtcctctatatttggtttggggatgaggtgggatgggttagactcatttccatttcttggattcgtccgtcaattttttagggaccagaccatctgaagggaaatatttcctctcaggatcatcctattccagttattctcgaatcaaacgctattaaaaataaatcttgctatacgtacgactgagccatacgatttgtgtccgaccgagtcatacaaccaatcactgaacttgtttactaccatgtgggcccaaacaaatagcatatatgcttatacatacactagtcggatggatgggtcggacttataggtcggacgtatagcaatttcgataaaaaatagattcagcctgatccatcccaacattcaaccaaactaagggtgtgtttagttcacgccaaaattagatgtttgtttgaaattaaaacgatatgtgtgtagaaaagttttaatatgataaaaaaagttgaaagtttaaagaaaaagttagtaactaaacaagggctaatgcataagataactgcggggtcgtcatccacccgaattgcccatccggccacggccactttggccgcagcgaacctctgaagcctgaactcggcgatgtgagatgagagaggagagactggcaaaagaagaggactgccattctgccaacaaggcagagagagtactcgtcaccctcaccggccagtcggccacactcgagtgtctggacgaccgtcgtccgtcgtgtcgccaccacacactcacactgtagctagctatcatctcatcactgaaactttccaccaatcctttcctctaaaaaaaggctccgcttttcaggcgacacacagcgccgcgccgcatccgtccacgatccatcggcatcggcatcggcatcggcatcggcggccatgtgaagcgcggcccccgccaccgccaccggcgcgcgatcgagctgagctgcgaggagaggagaggcagcgaggcaggctgccacatgggcgggagacacgcaccggcgttgccaacctcaccgggggacagccgtctcgtcgatctggtgagtgactgttgtctgctggtgtgcgcaggcgcaggcgccatggatctggatgatggatggatggccggtgtcgaaactagatttcggcaataataaaagtgtatgggtttggcagtcaaaattagatgtttgtttaaagaaaaagttagtgttgacagtcaaacttgatgttgacagtcaagatagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatctatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagtagcccccgagacctttgcagtcaaccatcgtagccttcccaaagataataatccgagtgcttcaaacttttcatgccaaggcctaccgagtagcgaagacgaagactgtaaagggcgaaaagataaagaatatggtgcatcgaatagatgcacctaattaggtgtagcccccaactatgtgattagttaacaaactaatcatatagttgagaacaaaataatagcataatcatgcatcatatgacaatagcatacgcggcgcctaaagaggcattcttgccgactgctttttagccataataaaagaaatccgagtggttaacactctaaaaggttcacgaatgaacacactggacaggcatccgaatataaaactctaaagattacccaccaagtattataaaaattatggtaatgaataagtctaatagcctaggctatgactatttaccataatgaaaataggtatataacataccaaggaagtgactatgataaaaacaagtcattccaaattaacccagacagcttttgtagcctaataaagctaacaaaaagcagtataacacctttctgtcgggcacctcttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgcacctccgatacccttaacaagaaatcccgagatccaagcgacgcttcgtcttccccgccggaactctcgccattttccccactccttgctacagtgcagaactgcgctggcgaactagggttcaccactccactcaaatccaccttcgaaaaagtgcatcaaaatccttcccgtgatccaccgcctcaattcctcacctctcccaagccatccctcgaatcaaatcagcgcattcggggaaaatcgatggcggaagagaaagaaagctttgaaggccagtgggcgccgtctgacgtaacggaagagaacctgaaggagatggtggcgcacggcgttctccctgccaaggagatcatcgggtggcggccagcgtgcggtgagatttttccgacccccgatacacacgagattgtggtcttctctcatttcttctatggcggcttcgcccttccgacctcgaaatttttccgtgggatattaagcttctatggaatgagcttgcatcacctaaacccaaattccatagtccacattgccaatttcatccatgtctgtgaagccttcttaggaattaaaccccacttcgctctgttccgccgaatcttctttctcaaacctcaaccaaacaagagtaagccatgtgtagtcggaggggccggatttcagctgaggggaactctgagccagaaatacttctcaatgcccttcaagacttcaaacaaaggatggcatgcgaactggttttatgttcagaatcctgagcctgctcttcccgaatactcttgtcttcccccggtgtaccaagatacttggaactctcttccaatcggagatgaagctgcccaagccttggaattgttggatcgcatgttaaaactcaaagaacgaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgctattgtcgtcagctactcacatcagctgccagttgtaccatataatgcattcaatccgcctccgcaggtatgtatctgaaatcttcaacttatgaccaaaatagtatcttgtcttcatgttgagttaactaaccatggaggcatcttattcaggaatatgtattgatgaaatctgatcccccaattgctcagcgccgatctcctcgccagcacaccattcagggaagtggagggccgacaatcaggtcagacccacaacctcagacctccaaaccggctgggcagacaggtcctcgcaagagaaagctggtgcttaatgacgacgagggcgatgacagcaacaaatctggggacaagggcacgcccaacaaactcccaaagcataccatgcccaggaaaaaactggctggccgtcaaatgccaaagattagaacatcttccaggtataaacttctcggtaccatctccctttgatatgcttctctcatagaaattacgctgaatatcgaaaggacactttgcaggaaaccatccgacatagatccaactggaaaagatcctgatccggctgtgacagagccaaatttatccaaagacgctgagccgtctgccgaaaaccagccgactgccgaaagccagccgactgccgaaagtcagccgactggcgcccatgcttcggatgacaaagccgatccgagtgaccagccgccaactggagaccagtcggcaacagctgaaaccgcaacaacacaagagcccccgactggaaaccagtcggatgtaggtcccgatgaagaaatccctcatgttcagccaggaacatcctcaggtaacacatcttctcaagtgatgccgatttaaataacttcagcttactcgtctaatgtcttggaaatacatcaggaacactaggcgacgacgaagaaacaattcctcgcataaaggcggctgatgattcccgtcctcctatcttactcaaatggtgggacgagaattcgcaagttgccggcatcgtcataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaagctggttcctcatttgggaactcttgaagcagttagggaccagctgcatgaggccaaggagtacgccaaaaagacagagaaggagttaagggaccgaattgcccagctccaggattcaaacttcgagctaagtggttcatcaaaaggtaatcttctagatctgtcccattaatttatgctgtcatagctgtatcctcaaacatttggatttcaaacagcgcaagctaccaggatggctcaaatggagaaacagattgaagccttgaaaagagacaaagtagaactagctgcgcaaagggactcagccttgaaggaggttgaaggtactgccaactgacaatttgaactttcctctctttaatgcagcagactcttattataaatgtgttttgtagaccgtaaaatcaaatctcaagctcagtttgatgtcctggttggtaagatcaagaagcttgaaggagcaagagacgaagtcgccaatgtcgctacaccacttgtccaagctatgttccttaataacagtggtccgagtgcacttgacgcaaccgaaatctttgacaagctgagagttgcaccggatgtatacttcaaaaatatcaagaaagctggaagtatgggagctagtatggcattggcgatgaccaaatccttgtacccgaggattgaaattgataccattgatggctttgcagacgggacaagtgaagaagctgctcttgatcttatcagtaatgctcaaagtgcggctgacaagattgcaagtgatgttgtagagcaattccgcaacaacgatcttcagccgagtaataataactctgatgacgaaaggactgactctgactgagtatgaatgtaacaaatggaggctcaatttgtacaatactggtgtatttatgctgtgcttgatagttctagccaagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaaaaaatcacactccattattatgatgatagcccccgactgacaacttcaagaagaaaacttgatgttgacagtcaagaaaacttgatattgacagtcaagatagggaagtacaatgataaacttaagcgtagaaacgacgaagatgttcaatgttccaagagttgtcgacaagagtaccgtcttcgcgcttgagtcgataagaacctggccgggtgacttcagagataataaatggcccttcccatagaggagataacttgtgccgatctcgtgtagtttgaattttgcgcaaaaccaggtcaccgactaaaaaggcacgagatcgaacattgcgattatgatagcgccgcaacccttgtaaatatcgagccgaccgaatcaaagctgcttcgcgggcttcttcgaatcggtgcaaatcatccactcggtcctcttcgtagcgttcttcacggaaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgttgcacccatttgccggcataaggttttagccggtcaaaaacacgcgctttaatcccttgaagtatcatgccattggctcgctccacctgtccattgctcatggggtgtgccactgaggcatagcaaatcttaattccaaagtcttcacaaaagtctttaaaaactccaccggtgaattgtgtgccattatcggtaatgatccgattgggcactccaaatctatgcacaatgttgatgaagaagtctcgagcattatccgctgtgattgtgacaaccggtttagcttcaatccacttggagaatttgtcaatggccacaaagagatgcgtgtaaccgccaactgcctttttaaacgggccaaccatgtcgagcccccaaaccgcaaacggccaagacagcgggatagtctgcaactcttgagctggtagatgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtcgttcagcaattgtctcccttcctctaaagatacgcagcgttgcagaattcctgaagggcttttcttgtataactcagattcatgcataacataaagtttgctccgccttgaaatccgctcggcttcatctttatcttgagggagctcttgagaagttaaaaatcgtatgaagggctctcgccagtcggcttcaaccatagctacgtcatgaatgtccgcatcttgagcagtatctttatgaggtacggtcggtgtataaaggtgttcgacgaaaacatctgagggcgccgtctcgcgcttggatccaaaattggcaagtctgtcggcggcttcattgttgtgtcgaagaacgtgactgagctcgagtccctcgaacttgtcttccaatttgcgcacctcttgtcgatatgccatcatattgtcgtcaatgcaggaccactctttcataacttggttgacaaccaactgtgaatcgcctcgaacaatcagacgctttatccctagggaaattgcaatccgtagtccatgaaggagcgcctcatactcggcaacgttgtgggacgctgaaaaatgtatccaaagcacatagcttaatctttcaccagttggggaaatcaaaaccactcctgctccagtgcccgaaagtcgttttgatccgtcaaaatgcatggtccagtgctccatcttctccgtaggggtatcctcctggcactcggtccactcggcgacaaaatcagctaacgcttgggacttgattgaaattcggggcttgaatgatatgtccaaagacatcaactccaaagcccacttagcaatacgtccgtttgcttcgcggttgtgtagtatgtcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaatagatcggtcgctggactttttggacatggccttcttcctcgcgctcaacgaccaagactgtgctcacaacctgggatgtggctgatacatacagcaacaacggctcttgcgggtgtggtgaggctaagactggtggctcggtgaggagtttcttgaaatcttcgaaggccttctgtgcttcaggtccccactggaagttatctgttttcttcagcagcttaaagaagggcatcccccgctcgccaagtcgtgaaacaaatcggctgagcgccgccatgcatccagttagcttctgaacatctttctgggtacttggcggtttcatgttgaggatagcagtaactttctccgggttggcttggatgcccctatgagacaccataaagccaagcagcttccctgacggtactccgaaggtgcacttttcagggttcaatttcatcctgaaagcacggatgctcacaaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccaaacggcatggtgacgtagcagtatgccccaaaaggcgtgatgaatgaagtcttcaagcagtcggattccttcagtcggatctgatgataccccgagtagcaatccaaaaaactgagaagctcacagccggcagtcgagtcgactacctggtcaatgcgaggcaacccaaaaggatctttagggcaggatttgttgaggtcagtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactctttgaaatcttggtagcgggcacttctccttcgctcgccgtggctgcagccagtcggatatcctctcgggcagacgccatctcgcgagtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtttcgaaatcagcgacttcaaagctgatgttctctgtgcggaagttttcccgagtgccaaaagtgactgggagggtgatctggccgagtggagttgcggataatcctggaattactccgtgaaaaggcgcattgcttggttttagctcggagcgaggaatctgcatatcgtccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtgatcttgaaaacctgccggggtgtcgccgtcgtccttcttcctcgatgtgctttgttcttcgtcatagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtacttatgattgttacttccacctcctcccgtagtcggcgtacccttgttttgcttccaactgggacccgactgctttgatgcggtgacggcgtcttcagctttggcgtactcgttggccttttcaaacataagcttgactgtcctgggaggcttacgcccaaacttgccgactagttcttcgtggcgaattcctttggtgaacgcggcgatgatgacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcagtccatggagccaagatcgggcggaatccgctaaagccactggtaaatagttcgccatggccttgttgtctcctcctgctgcgcggattgcgagaccgtagacggtaagccatgattctgggttagtggtaccgtcgtacttctctattccagtcggcttgaagccggccggccaatccactcgacgcaggtcgtcggtgaaggctgctactccatcaaggtcgtcgttgtggcggtccggtgaaggatgatagcctcgagctgctcggcgttgtatgattgtgtcgcgaagatcgatggggcggcgacgaggtggtgagcgaggccgttccactcggcgctccctatattggtcgggaggtgagtgaatggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatccaaacgggaccgaaatccggttctctcccgactggtctgattccgagtcgaggagagaaatcttgccgaagttgttggtgacgaagtcgaggctgccgaaccgaaacgtctgcccgggcgggaagacgaggtcgtcgatgccggagacggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttagagaaaatcaacatccgcccctagaggcgcccagaccctccttatatatgggaaggagtccgggttacaaaagataatcgatatccctaacggaatacatagatacagatcaaatacagtcgtgaccgactaagtctcaaggtgtttccttgatgtacaagttaagaaacaaacccgagatacaagtaagatattctatctatattcggtatcctatattcagcccaaatattgtcgccttgtagatatgggatatccataatctccacagccggtgcgtgcgtgcatgcatatgcatgtactgtagtactacaccgtagcctgcactgcacctggccactactacacctgcgttcccgccacaaggcgctgtgcgtgtcaggcgccattggatgctttgcatctttgcttacgccatgtttagtttcaaaatatttattcgaacttctaactttttcatcacatcaaaacttttctacccatataaactttcaacttttccatcatatcgttctaatttcaaccaaattccaattttggtgtaaactagacacaattttggttgggaaaagggccctctccttcgttttccgcgcgcacgcttttcaaactgctaaacagtatgttttttacaaaatgtttctatacgaaagttgcttaaaaaaatcaaattaatccactttttttaaaaaaatagctaatacttaattaatcacgcgctaatggattgctctgttttccgtgtgaagggttcggttgggaaccaagtacaaccagcgaacacacccttatccgttaaaggacctctttgatttagaggaaaaacatagtaattttggaagattataattctatatgaaaatttcctatgaagccctttgaatcctatcctttcaaatttctatagaatggacaatcctatagagattttggaggaaatttagtaaaagcccaaatcgatctcttggaaacttttctttgagtctatctctctcatccgactcttgcgttttttccacggttcaatcaaaccgtcattcttgtgtttttcctgtgttttgtaatcctctgttttgcatttctattcctgttagaatcctgtgtttttccattcctgcgattcaaagggaccctaaagcttgttttttttattcatcccccacataccaatataaacattagaatgctcttactttatcaaatccggaagttattattttttactttatctacttccaatgtaattattccatactttcataaactcaaactctgatgcaataatttaattacttagaaataaacttattttgagataagtaggagtaaaaaataacttaatatgatacggaggtagtattatggtggatggagaataaagttggacaaacgaaaaaaaacaattgacgtatgattaattaagatttaattattacattaaaaataaatttatttcattttaaagtaatttttatatagaaaattttcatatgaaacatatttaaaaaacatgctaataaaaacctaagataaaatatgtatcttaataaaaaaagaacataacatttttactgagttctcatggtagttcagttcccacaaagttccttacagagttttactccgtgtttagttccaaaatatttattcaaacttctaacttttttatcacatcaaaattttttctacacacataaactttcaacttttacatcacatcgttccatttcaagcactttcaattttagcgtgaactaaacacagccttagtggtagttcagttcgcacaaagctccttcaaattgcctgcagtttcgaaggaggcctttgaatctggagtgctaattcggcaatggcatattttcgttcctgccgcctcgcatctgtccgtgcgtggccgttttgattggtcaggttttctttatgtccatctattttttttcacctgttcaagaacccctgcatctgtccgtgcgtggccgttttgacctttggagtatggatagtctggatagtggcctagtgggtagagcacgatcacagtatacggtgcaacgcaccagattgctcagaaattcaggtgaaactcaagcatttaatttattttttttcactttcgagacgccaaacatcgtaggttcatgattaacttgtgccgatggcgagaaaaaattctgggggacttgtagcccaacactggaatggttgaactatgacaaaggcccagaaaaacaatggatggactgacaggcccagaattccttcacgtctatcccaacaaaattagtgggttgctgcatcccaacagaatgtttgcgttgattctgatattagacatgcagactatacaaagttgtgctaaataaacaagaggtgcaatgtactgaattcagcatgataaaaaacaaccagaaggttcagaaatatcaatgtcaaacacgttgatggaaggcacatggagacatctggccacctcccggtcatattcttccacaaaacttctatagttgcctgtgcaacaaaagcataataccaggggcacttagtaagtgatggacacaagtgtatgaactcgtatgcatatcttatcatcacaaccaaggttttgcttgttttgtagtgacaggattaaatttaattggtcaggttttctttatgtccatctatttaacaacagagataacaagggaataatataaattgaatttcttacttgtgaagactttccatggttgattcaagttttgtcgcattagcaccaaccacctcacctgtcttccgaccttggtagtagaaatggaatgttggctacaagagcaaaacatgttggcaacaaagaaaaagagatctagataactggaggaagctgcgcagaaatttaggcacacagtcatgagctatagtcatagtacaatgcaacttaccacagagaatatttttagatcacttagtttgcttccaacaccatcctgcaaaagcaacacaggtcagggaagtgcctatcaataaacatgtccaagcatggccataaggttcagataattatttcagccataatcaaaattggtaacatagtgaaacacattttgcctttcaatgtactgaaagtataggagtgttctcaatagagtattccagttattgagtgaactaaccaaacagtgtagcatattagtctttgaaatcagaatacaaaggtaggaagctctgaaccggacaccatcttgattaacagtgattcatggaacagtattacggatattcagtgaaaaattcccatctcataactttgccttctacatatgcagatcccatacttgaacataagtagtgctagaatgatgcgaaatatttcagactagatccagattggtcaattgactcgaggctttctacagaagaacaggattggttcaatcactagcacttgagttttaagcattgtagtttactaagggcacgtttggatttctggaatattttgcctagccaagcaatgccaaagtagtcaggttaggctatatagcctatggcaacaagagagttcatttggtttcatggctgctcaagcaaaactaccaacgatcattgcttgccgctggaggagagctgatttggctctccctggtgggcaaggattttgaggcagttattgcctaacttgccctcaaaatctaggattttttgtttgtaccaaatgcctctcctaacttagcaaggatagaacttcccttgctcaagattaaaacacaccctaaaaagcataagccaaacctaaactttgaaaggacaggggtcaaaaatactactctgcagttaacacatgggaggtaatgcaattatacatgacaaacaatcttcaactatgaacatatgagtaaccaaacaattttgcaattttaatcccaacaacacctatttgagcaagaagaacacttcggcgcatcacaatcgcagcgagatttggatccgcccacttaccatgtcaatgtcaactttgtagataggtatcttggggtaccggctgctcagttttgaaatcacgggtgccatcgctctacctacaaacaccaaacaacccatcttataacacctcacatcatcatcaaccatctaattccaaaaatcccaatttcggcacgaagatccggcacttacaaggcccgcaccataccgccgtgtagtagaacacggccggaagcttctccgctgcaaaaaggaaatcgcgcgcatccatgagaccatgatccaatcctacccaccaaacactaacaaacaacagcagcaaaggtggaaggggagaggaagaggaatcgggcgcgccgcaccttccaccttggacatgatgctggtgaaggactccgccgatccgaccaccaccatgctggaatcacctgcaacaacaaagaagaaaaagaaaaagaaaagaaaacacgattatctcgagtccagtaaccacttgaggagaagtggtgagtacctgaggaggagggggtggtggagaagaggcgggagagagagggaaacggcggcggggaggagaggggaggaggaggcgcggggctaggttttccggggaggtagggtttggagtcgcggcgccgtcggcgaggggaagaaggcgaggaagacggcagagtcggtgagccagagccatactgtgccacgtcgccgtgaaagattttgcctcttttgtgcgtaaaagctcggagacgccaagcccacgacgaaaccgcatgggcctgaaagtttctcacacagtaggatgggcttccggcccagtgtatttcaggcccatttattctttacaagtctgtttatctttttatttgattgattgaataataaatactctctctagtttttaactgatgacgttgttagattttgaatatacaatttgactattggtcttacttaaaaataaattttacaatatgcaaaaatatcgaaaatccttattttttaataagacgaacaatcaaacatatgtctaaaagtcaaaagtgtgatctactgaaaaccggatggagtactaaagtagcaaaccgatttttaacaaaaatttaaaatgagttttttctttaggaaaaccacctaagctcagacagtgagcgacagttgcaaagctttgtttgagaccttataaagaatatctttatctttagaccacaagtagagattactaaagaatgggatagtggagcattattgcgcattatcggtgactgcaaaatccatcataaggcttggttataaaactcttcactaacattcactagttgggccacatgacctaacagaaaggataggaaattatttagggagagaaagaacctgatccaccatgtaaaattgagttgcaaggaaagaccaggacctaccaatctatccatatttgtccctaaaggctccaccagactgcatgaaatggaagtagctatgatgattactatttgagagtgaaactgaaaccaaatctgacagacaaattgtgtgtgcatgtgagtcatggtcaactaggtggcactgttgtctctaattaaataagattagtactctagcatgagttgacagagtctgaacaggagaggggaataaaaaggttagttactctgtctctccatgtgctttgtactttaccttgtagaaattcagattctcattttcaagtggttagaaaaaccttgctggtttgctgaatattgccactcaacgttgccagttcttaagagtttgcatatcacatgactagaaactgtaaaatggagtagaataccttttctcttgtaccttttaagaaaatctattgtgcatttgtgatactaataacatacaaaattcctttattgagagtgccctcaccatttgacagcacttgctgctgttgttcagtcaattcatcaccttgcttcagtaatgggtatggtttgatcatcaacctagctttttagcaagtattcaaaagtactaatgcacactgacctgcacccatgcacctaaaaaaaagacagattcagcaaaccaagaaaagatagctagcatgggctgcgtagttgggctatatgtatgaacatataaatgcaaaagaatatcctctgaaaaaaatcaatcgtgaacacatctcagtgtaatataacgaactcaaaatcagcgcaatgatcgtatcctagtttttttttgacaagttcagaagagatccagctcccaagttgacccatg

SEQ ID NO: 25253 - DNA, 955 bp, Oryza sativa
ccagaccatagtaacaaaggctgagtttagatccaaagtttggatccaaacttcagtctttttccatcacatcaacctgtcatacacacacaacttttcagtcacatcatcttcaatttcaatcaaaatctaaactttgcgctgaactaaacacagccaaactgacaggtagtacatgttgtagatggtgaccattgctgctcagatcatggtagtacaagttttgccaatgttcaagtacttgcaactagaagcaaagtccaaagctatcagatgtaggatgccttgtcgatttcccccttttttcactgaacagttaggaaattgaagcttagcttcagaaaagaagttggaagagaaggtccaacaacttttgattaggtgaacaggcataccaataccatcactgaaagtgagactttggtgggttcagcactttgcagctgttcttccacaatattcggatgcttttgatcaagacctccaaactaaagacacattcagatatgactaatataaaccattttcagtgtcttaggtactagtactactatcaatttacataatcaagctgaaagaagtaggacatttctgctgcccctttgtaacctgttctttaagagttaggacatgttcagtctgtctgtctgcaggaaccgcacaaatggcacaatcgatgcatgcatggatagctggatatcaagctagtagttaatttagatgtcatggtccaggaagaacatgctaagctacaacatggagtatactaaatcatgatataggaggatatcatcgtcacctgacctaacaagcgtttgcacttattcattattaagccgtggatgattatttattactagtacaatcgtaaagagataggactaatgggtgattaattaatgaagcatcataagtatggtggtggtggtcgtactcttgatctggtcgatcgaat

SEQ ID NO: 25254 - DNA, 6908 bp, Oryza sativa
cagatcactgtttatcatcagaagtggtggtgaaggattctctgacctgtgagtcaggaatcactgggcgtgtgcttgctgaggcagcatccatggcgaggccagggagatgcagcgcggacggcactgcatgaggccgagagctcatcatcatccaaaagctgctgtttcctttaggctttagcagggtttatgttatcatcatcccacggtttagcggttaccacaagatataccatgattttgaaactgaaaagggtacccgcatattccctccgtcccataaaaaaccaatctagtactgaatatgatatattctaatacaataaatctaaatatagaatatgtaatatcagtcttggattaacgaaacgatggagggataacaatatgataatacggttttgtaaatcccaggttttagctactgaacaaaccaaatatcgtgtctttacatgattgccatcttgcttacttcgctgatagctccaactcgtaagtcgtaactgaagcagtgtcgatctcaaacacggaagttaaaaccaatcaaatgcgaactttgtttttgttattactactcctagtacctgaatctttgcctaacttcagctcgttcatcatcatcatcatcaccaagattcatcatcattcattgcatcgaaagttgaaaattgaaaattatagaaacgaaaaaaaaagcatacagtactaagagcaagtataataatagtaggctataaaccagctaaatgccgaggcaaatgatagaagagatgagagagagaaaagaagcggactgtaaacttacaaccggcttggacacaagaaccaaaaaaattctataagagagacaagtggaccctatagagaaggctaaaaaaaaacttataaacaacatatcgattgtattattagccttgctctaacacacaccagcttgtatgcggaaatgctaaggggcgatcgatcgcccctgggcgctcccctttcctccatatggtttcattttttggcaccacattactttcttattttagtaaatttacgcacctaaagtttgtacaccttaagtttacacatctaaagtttagagacctaaagtttatacatctgattcaaatttgaatttgaattcaaatattttttatatataatatttctatacatctaaagtttatacacctaaaatttatagacccaaaatttataagtcaaaagtttacatacccaattcaaatttgaatttgaattatatccaattcaaatttgaatttgaattcaaatattttttatatatagtattttgtacatctaaagtttatagacccaaagtttatgtcaaaagtttatatacccgattaaaatttgaatttaaattcaaatattagtttatagacccaaagtttataagtcaaaagtttacatacctgttttaaatttaaatttaaatttaatttttttatatatagtatttctatatataatttttttcaagcttatgttttttattttttaaaaatttatggtgtagtaggaagagaagaagatgaggagaaagaaaggatggggggtgttagccgcccccgcttgtatgtgtctaacgcgatgggtcaacctcgacgaaccggatttgtgcatgcgtgtcgtcttggcttacacaccacgccacgtcggatgggccccacactcagagccaagcctacctacacacacctacccctccgacggacggcctcacccaatcacgacccaggccaccccgggcccaccgtcacagcgaccgttatcgatcagcaggtgggcccccacggggatctttgattattaggtgactaggtgaaatcccgcgcattgctgcgggaatttagtatgataacaataaaaaaataacgtgtaagatagctaaataatatcagattaaataaattaatgtggtttatgataatttaaatttaaatagtatgtagaatgatgattcaaacgtaaaaagtaaggtggtatgactttatagaataagaaaagtagggagatagtttggaccgtagattaatcatctaaaggctaaaaacaattgatgtgatatgccttaatgagaggaaaaaaggagaaagataatttggaccatagattaatcatttaagcactaattaagtgaggatgaactatataaatatataggatatatcataaaacataataaaaatatacattgaaacattatgtgaattatattggatgataatttaacatgtttatatttgaaaagctcttaaattataaaaactataaagatatagcatgtttgtatgatgtttaaatgtgatgattgttagtagatgatgatgtggcatcttgttaattaatggattagtggatgatgatgtggcatctttgcatgcatgttaagtttaaggagttggtgggggataactttatagtaagataggattagtaaggcgctaatcacccgattaaagtcgtaacatactactccgtgattagccgcgcggaacacgtgctccggaacctggccaccggcacgcggattcccgcggcgaaaccgctcgtctccttctctcctcgcgcggtcgctctgaatttgtttgattttttttttttgcttcgattgcattttgaatttcgatatgatttgggtgcattttgcgatgggtttatgaaatttatgatgggggttacattttggcagaatgggcgttggttttagcagtggagtggagtgcctgcatccgcaaacacagcgacagcagcgtaagaacaaagcttcactgtcagagcgaaacaaaaatgtcgctaacctaatgttttggactttgtaaagggcatgttggtttagctcaacttatcccaaatcatgctaatttcaaccaaacaaagcccctactatattctaagccaaaaatgtcagaacaaaataatcacaacaaaagctcacatataaccaagcattaacttactacaattacgaaagcagttacgctatagtagaccgtaacattggcttccccaacacggtgatatcatgtactctctctgtcctaaaataactgcaaccatagtttttcgcgctcaactttaatcattcgtcttatttaaaaaattttaaaaaaaattaaaaaaattagtcacgagtaaagtactattcaggttttatcatcttataacaacaaaaatgctaattataaaaaaattttaaataagacggacgattaaagttgggcacggaaacttatggctgtacttaatttgggacggaggtagtaatactagtactaccaaaaagttcagaattcgaaaacccggtcagagagattttcttcgaaccatctgagaagaagtcaaaaacgggaaagttcatatggcgaaatttgcctctcccagctaaacgcacagataacaatttcgagcatttgactaatccataatttacaaataacctcctaaaaaatgcaaaataattccactttgccccctgcgctttaacttttttttccctctccgtttatataatccgcctcgccccattctccatcgtttcgtctcctctctctcttccaccaaatattcccacctcgcgcggctactctctctctctctgacaggcatggcccacctgcagctctcggcggtcgccggcggcggccggccggcggcggcgggtgggggaggggacgagatggaggacgtccggctgctggactcgtacgacgaggagatggggggcggcgccgccgcggcggcggcgggggaggaggaggaggcgcacgtgcgggtcaccggaatgacgtgctcggcgtgcacgagcgccgtcgagggcgccgtctcggcccgccgcggcgtgcggcgcgtcgccgtgtccctgctccagaaccgcgcccacgtcgtcttcgacccggcgctcctcaaggtgatttccgcgcgattgcgattgcaattgtgatgtgatccttttgcgtggctgagcccgtttgtcgagccgagttttgcgcgtctccgggagcaaactgggattcgtgagctcgttgacgctcacgcggtggtaaattttttgaagttttttcttgcgctggaattattgcgtaggtgatggttggtgcggtagaacaggattctaggaagctggatcgcgctgcttgctcgtggtttttctcgagcggttagaagttggtgaatcggaatttactcttgtctaataataagttgagtttactaattactatgtgtgtgagtgtgagaccgagtcaatcgtgtatgatattgcaattttgggttttagctggagatgattttttttttctttttgacttcaccttgcgatgacgacttttcatgagttgattcgtgaaatgtggttagcccacagtgcccagaggccagagtttttgtgctccttttgctttggcggttggatgagctgtaaccttgttgcaagctcgtgattgtggctggactctctggattgtgggatttgggagctcaaaaaggctggcagtttgctgcgattggttgttgctaccggcagaaatggggtaactgctgtactacgataggtttgattggctggtgaggcagggagcagccgagtcatgttttcggggggaaagggtgctaagttaaggatcccaatttatgtggcttctaagtactcattgaagtttcctttgagcaaaattgaatgcaaaatgatgttacatgctaattttgggacaagcatataatctcattattctaggcccagtaattaccatgcaagtgtataaactttcagcagtgataaaatttagtcttatcatagtaataacagtgtacttcacaattgaaatttattaatgcttatggttattatgttgtgaagtactctacagtttctggttttaatgactgttaatgtgaatattagttgagttgtagcgctagcaactttttgatgagcctattgtagtgcagacggggaatgttgtgtttcatccttttgcttttgttggaactattaaggatggctttcctgactattaagtagacatttaccagcaagttctatctgctacctcctgttcataataggcattcatttagtttgtttttaatggccacctactattcattgttgacacacatttttagattatatgggtcaattagctacctgcaatttttatttgggtacttgtttatacaggttgaggatataatagaagctatagaagatgccggatttgacgcagaaattatcccagatactgctatctctcagccaaaggcacaaaagactctgtcagcacaatttagaataggaggaatgacatgtgctaattgtgtgaactcagttgaggggatcttgaaaaggctatctggtgtaaaaggagctgttgttgccttagcaacctcactaggggaagttgagtatgatccttctgtcattaacaaggatgaaattgttgaggctattgaggatgctggttttgaagctgcattcttacagagcagcgaacaagataagattttgctaggcctgactggattgcacacagagcgggatgttaatgtgttacatgatatcctcaagaagatgattggtttgcgacagtttgatgtaaatgctacggtctcagaagtagaaattatatttgatccggaagcagttggtctgagatcaattgtggatgcaattgagacaggaagcaatggaagattgaaagctcatgtgcagaatccatatgcacgaggggcttcaaatgacgcacatgaggccgccaaaatgcttcatcttctccgctcgagcttattcttaagtgtaagttttgacctttgctcttctttttcaccaccagcatagttatgcatttttgcacaaagatttttagttggatcaatgtttgtgacaatatccttgacatggttgtgacctggaggacccttctggacttctgttggagcattttagttatgtggaaaaacagcaatcatcatgtccctgtgccatttgaatcagttattttctcctaaccacataatagtttagattttttctatttactttcttctatcttacatgtgagatccacttgccataggaaagcatgctgctttaattctaggtttgggggtttgggctgttcataaagataacaagcacattttacttcatacttgaattaaatttggcagtactgaacatttgggagtgttagatgatatgttccctagctacgtagttcttttgcttctttatatttcagaatacttttgaacttctcttctgcttgcttactaactctatccaactgtgtccttgcaccagattcctgtattttttatacgcatggtctgccctcatatacctttcattcgttcaatactaatgatgcactgtggaccatttcatatgggagatttgctgaagtggatattggtaagcattgtacagtttgttgtcggcaaacggttctacattgcggcttatagggccctgagacacggctctacaaatatggatgtgttagttgttcttggcaccactgcatcatatgtatactctgtttgtgcactcctatacggagcattcactgggtttcaccctcccatatattttgagacaagtgcaatgataattacatttgtgttgtttgggaagtatcttgaggtgcttgcaaaagggaaaacttctgatgctatcaagaagcttgtagaattggtccctgctactgctcttttgcttctgaaagacaaaggtatatggtaaaattttgtccttcaaaacatatacaattaagtcacagtgccacactcatcacattagttttagaagttatttctgacttgttttaggcaaccgcgtgtgtttttttttcatttatactatcaagttacacaaactcacattgttcttt

SEQ ID NO: 25255 - DNA, 10414 bp, Oryza sativa
  unsure (1)..(10414): unsure at all n locations
aagcccccattcagaaatttgctgattatgtgagtaacctcccatattcttttctgtgatgtccttcatttgctttgtctgtacttattttaagtgtttaccgtgtactttacatattaactttaaaagcgtcagagcattttttgtgatctatttactatttccgatacttgagaatgttgcaggcaaatgttgtttgtttatgagaatttgattgttcatatgccctcttttaacatcatcattcttatgttgctttctacttctgatgtaaaaagttgtaacttgtttaatctcaaaacattttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggttaatgctgacactgcctacattttgctttcaggttgctagcatttttgttccaattgtcatcaccttgtccatgattacattccttgtatggtaagttcaacatatactaacacaatttttgagtgatactatgtttgaaacttcaatttttctgacatgtacattggctgcttttgtaggtttttatgtggatgggtgggagcatacccaaattcatggatttctggaactagcaactgcttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggaatggatcttggggatttcctcacattagtagcatctgcagaggtgaggttgaacttaagttgcttgtatggttcatatcaagctgtagtaaatgtgtttcggtattgtaactatgcttcatatgaatgtggtaatgccaaaatatgttttgctcctcagggttttagttaaaaaaaaagtgttttggtcttgttcatattgacttgtcaaaagtaaaaaaagttcttttgttttctactcagcaagcagtgagcatcctctggcaaaagcaattgtggaatatgcattccatttccatttctttggcaagctccctacatcaaaagatggcattgaacaaagaaaagaagacagattatctcagttgctccttcaagttgaagacttctctgccttgcctggcaaaggagttcaatgcttgattaatgggaagagagttctggtgagtcacataagctaccataactcttccttgcccttcttgcagctgagttgaaaacagtgtacaagtctaacccatctactgctgtaccatttcttttaagcaaaccactgattatctagacataactgttttgcaggttggaaatcgtactttggttactgaaaatggtgtgaatgttcccccagaagctgaaaatttcttggtagacctggaactgaatgctaaaacaggcattcttgtgtcctatgacgatgattttgtgggtttaatggggataactgatcccctgaaaagagaggctgctgtagttgtggaaggactaaagaagatgggtgttcatcccgtgatgctcacaggtgacaactggagaaccgcaaaagccgttgcaaaggaggttagtctctaatctctattaccttccttgatccataatgttcatcatttacctgaacacctcttcatatacatgtctgcgattttctgctcttgcaggttggcattgaggacgtgagagccgaagtcatgcctgccggaaaagccgacgtggtccgctctctccaaaaggacgggagcatcgtcgccgacggcatcaacgactccccctgcgcgcagcggccgacgtctggatggccnnnnnnnnnnnataggcggcggcaccgacatcgccatcgaggccgcggactacgtgctggtgaggaacaacctggaggacgtcatcacggcgatcgacctgtccaggaagacgttcagccggatccggtggaactacttcttcgccatggcgtacaacgtggtcgccatcccggtcgccgccggcgcgctgttccccttcacgaggctgcagatgccgccgtggctcgccggcgcctgcatggcgttctcctccgtcagcgtggtgtgctcctcgctgttgttgagaaggtacaggaaaccaaggctgaccaccgtgttgcagataactgtagagtgacattgacattgctcctgtatacgtacatagattccccctcttcaccgtttcatcacagaaatgaaatgagatgagaaaaggaaggccgatggcgtctcttgtaatttgtggatcgctctggacgctgtttgctttacaggttttttcgattttggtcgggttcttttattcttttattttccattttatctctcctggtgaattaccagctgtcagtaatcggttgtacgtttttgcttatcttttcgctacaaagcagttctcatggaaatgcttaccatcggctgtccggctagaaataaaaaatcggacgtctcagttgacaacagtgtaggtgcatagtgaaacaggttaggtgtactcacgagccaacggagcaatgcattcaagcatgtttcaaaatttaaatgattttttctcttaaactatttatccgaatttcaaactaactatatcattggattcgttataattaaatctttataacaagatatcacatgactacattccgacgactttttattttactttttaaatgttgcacacatttttactgaaatgttccaacaagcatttgttggtgttttactagtgcattagtaatgtttcatgttatcttttttatatgtttcagcaaatacattttttatgtttcaacaataattataatttgatatttcagtctaaatataaaaaatatttcactagtcgggacttaatgtttcatgtaataatgattattgttgcagtcaatactttttatatgttgtacctctttggaacaatttgtgaagtgggttgaaacatctccacaagtgatgaaacaattatttttaaatagttcaacataagtttgttttttttctaagaacacacatatatatttttattaaaatatattcatgtgagatcttgttataaagatttaattacaacgaataaagtcatctaatcaaattatagcggtgttattggatcatttccggattagtttcgcatctcccactttcagcctgtccttttttttccagtttcttttcatcttttatctacctttagtgtgtttgtaaataacttctatcctatttaatataacaccagcaaatcctggcatcggttctaaaaaaaacattcataatgctggagggcccattcaaaattttctttcctcttttgacctagtagtgatttgttagtaggggtggaaacgagccgagccagttcggcttgcagtggcttgtaacaaactaggcttggcttggctcggctcggctcagttagagaaacaagctaaaacttgagctcggctcggctcatttcctagctcgagccagcttgcaagccttcctgttgaaacacctcttcatatataatttgtaattattaaaaaaagtaagaacaaatcatcaacatgtaaaatttaaataagtttttatattcaattcttaaaaatcttaatgataaatttcaagttgtcaaataataactctataaaaagttaaataatcgatataaacacataatggcctaggctagcgagccaaaacaaacggctcgtgagccagcttgggctcggctcatttcagcaacgagctgaaaaggatacttgggcttagctcgtttggcttacgagccgagccaagccatccaagctcgagccaagcccgagctgagctcacgaatccgagctttttttccacccctatttgttaggtctttatttcactactactacttcagatttcttagatggtgtgcttcaatattgtattgggctcgatccgtctgtattttatgggccaacagaatattttttttcgtatatacgtgcgtatacatacaaactttgtatatatgcgtgcaaattttttatgtctaaatagtgtatacacatatgaaaaagtttatacatataattttgttggatactacctccaccatttcaagttataagacgttttgactttggtcaaagtcaaactactctaagtttgactaactttgtagaaaaaaatagtaatatttacaacactaccattgtttcattaaatctataattaaataaattttcataatatatttgtcttgaattaaaaatattactattttttttacaaattagtcaaacttagagtagtttgactttgattaaagtcaaaatgtcttataatctgaaacggagggagtacaaagataaaaaaatacacttacacgtataaacataaactttatacgtatacatataaagggtctcatctttttgcttatgcttatgcttatcagctaaaatttgaattttcatccttaaatttggagttgattttgaggttttttttatcgaagtttattttttagcctttgtttttagatcgctaagaacacatatataaaaattctattcacaaattacttttcattttgcaaatataccgtttctcttatttcgcgatggctccgaaagtttgtacacataactacgtaagggccggactgatcgtgcattaaggatttctcattccgtgctctcacgtattatctcctttgatttctagtgtaatgaaccatccatttctacatgtcatgcatatgcttaggaaaaagctatacatatggattttatttcttacaaaatttttgctaacgctaatgttacatattgtagtaaatcaatctagatctactatgacatcgacctagttaaatcaaacgggtgagaactttgttaacctttgttaagagtttaatttgtaagattttcttttaatacatatagcgttgttcatattttcaacaacgtttgcttcctactcttaatttcttttttaattactacaatgtgacgtgtctgaagttcacatggtgtacaacgtggtcgccatcccggtcgccgccggcgcgctgttccccttcacgaggctgcagatgccgccgtggctcgccggcgcctgcatggcgttctcctccgtcggcgtggtgtgctcctcgctgttgttgagaagatacagaaaaccaaggctgacgaccatgttgcagataactgtagagtgacattggacgagtaaagaggaggtgtgttgacggctgttaagtaccaaattaaattcgtcaataccagcataagaccgtaaatataaaacatccaacatagtggtagagtttatttctaacaatttccacgagtgttggtgtatattcgtatgcaggtgacaaactacctaaattgagaagaaatatatatgaaagaggaggagaatcaaactcgtatccgaacttatggagttttggacccaaaaacctaattaaacacctccaaatgtgtcaaacattcataccaatggattgaggggaccaaaataagtgtccaggccgaaaaccggagcgaacatagccgtctcgggtttggtcgaaccctcacggaggccgttggcccaggcccaagttcagttcggtagaaatccgcttcccaattacggttatggccgttttcaccggtagaaaccgtcataagcatggacacttgtcaatacaaaagagaagatgctctttggatgcttggagcatctccatactcccaagacacttttctacctataaatacccctctcatcctcacttgtaaacagacatcaagatgtagagctgaattataagaggctctaagtatacttagggctctttatatgttctatagtatacttagaatagggagagagtaaagtagaaaaaattggaggaattccagagttgtcggtaatcctctcattattcttgtactttgttaattactccactttaatagaaatatcattctgagtaattaagatttgcttagtgagaattaattcttggttagttcctaattactatatgggatcattgttcactatggtctagtaatatgtagtgattgctttaatgcttggccaacgttagagtagtaattaattgcgtagacgcggtgtctggctaattaattttcagtgattactgtgtatctcacggtacgtaggtgggtgtagaggtggtgacaaccctcaagagcacttaagtcctccacagtacgtaggtgggtgtagaggtggtgacaacctcaagagcacttaagtcctcgtccggtacgtattagagcgacatctggaaatagcgggttgacagttcctgaagtatcgtgttaggattaaaattaatctttctatagacactgtttttcacttgaaaatcctctctaccatttgcatatgtttgctttgtgtccttggatgaaattggagaagagctgagcacacacgttccttgtggaaatcgatactcggaatactgaatactgaagctacatcggtattctccgtgtgcttgtagattttatttgtgacgttaagaaataccaacaacaatctcgtttaccatgtacgcggattcgaggctacttcaaagttaatgtcagggatattcacttgataactcggtttatggccaatgggtttcctttaattggtaatatcccctttacatctttgtttacatttctgaatgatggcgaaatatattatcctccaatgctagatgcacattatcactcggtagtgttgattggttcagagattggaatcaacaatggaaaatcatcaacattctatgtagttagagacagttttggattcattcactgcagctaccaccttcaaaactatggcgcactactagtttatttgtgacttgtcttaaattcttattatccagtttagtaggtggacctatctttgttcttatgacgaagcgtcaaatctatgtatgcaattatatttgtggagttttgattctcatcatgaaggctcaaatctatgtatccagtgtaatgtattagtgtagtatttgtgaacttgttctcttgttatggatgaaagagacattatccttaatttatcgatttatgtatccaatccagtatttgtgttatttcttttattttcattatgaacgaaatagttatcaatttatgcatccaatccagtatttgtgttatttcttttattttcattatgaacgaaatagttagtattgttctggacatgttcgtgcgacggaaaaaataattacattacttgcttcaaataatttgttgcgtgcatgctggaacacattgggcatattttctttttaattaagtactacactaattactactagtaatcgtattgcacgtttcccataatatataagcatactcaaagtttaatgcattgattttccaatgatatgtatatcacacgacatatacaaagtactaaaagtataaaattgtctcaaaatagtactctagtaaataacatttacatgatcaacaataatattctatcgtgtgaccagtagaaatttatatggtaagcaaaccatagaggtttatatctcagttactttcaagacattaattgtcacgtaatagtactctagtaaattgttatcggaatagtactcggtgtagttgccttaactgcagtgaacagaaggaaatgtcgagtgtgaacatgctggaaacgtcttaaaaattgaaatggcaactctgtatttctggtatggacttacagtgtatcccgtgaacatgtccaaactatattagttgagcactggaagggatttcacactgcacatgtccatcatcctagcagttgcaacccctcctaacgaaagaaaaataattcaataaggaaaaacttatcaaaggccaatgattttgaacccatcccttcgtccaaagaaaccccttctagttgtgattctaagttatttcactctacaagtaaagtgatattcaaatgagaacacatcatatatacatatattatttgtatcacaatactccacataaacttttgattgctgagaaaaatagcaattcaaaatagcatcctcaagcattcatatcatcaaagatcttgtaaaatgtgaggcacatgattttctagtagcagattagaatagaaaaataatatgaaaaacatgaattatttaaaaattacaactctgacaaaatgaagaactaatgaatgcattgaattccctcaaatctggacctaactacataacctaacagcacaggaatcaacacttcagggtatttatggcctaaacagaattcacatgacacccattgttgggaggaattattccttaatgaaaattcaaaaatgatgaggaaaaagagcaccctctctttgaccatcgcctgtacatcgcaatggttcatcatcaaccatccataaatcaagactattgataccatacatcagttgtcctcacacacatgatgtaaaattgtatctttgttaaaaaaaagtgtacatgttagtttggcaaggtaaaaaagtatcttgcagtgctttatagggaaacaaagaaaaatggagaaaaaaaagctacaattgacagttttttagaaatattgtgaattgaagaaaatcataaagttctacacgatttatatcaattaagtagactaaatacacattattcttgttctccatgaactacagtgtagtatacatgtcaataccaataaacatttgcactaaaattgacacatcgacactcaagaggtgtactaagccatttaggaacttcaagtgacaccctttctcaccttttcttttcgtttcctgattgcaacctttgcatagttggatttgttcaaaacattagtctagaccagatcaagagagccccagatggttcattgtaatgccatcgaatatattcaagtcatctaggctcctgtcatcgttgaacacctaacatccaatttatgcttcagaataatagaattcgaacacctgacatccaatttatgcttcaaaacaatagaattctcttggtcaccgtttctgcaagcacaaccttagagcagaatgattcagcaatttcactttaaaaaaataaaaaaaaaagtcctcgagctatttaaagtgtaatataagctcaatagtgtacagcgatcgcaggcttcagatttaacacgctatggacttttttgtattccacgttgaatttctaatcctacttgcgttatacttgaaaaatacgggaaataaaatttaagaattgctaaaagttgtttgacaacacaaagaaaaagttaggccctaattagcacatctatatcttgtatgacataacttaaaagtacatctatatcttgcaaccgatacatagtttgtcctttaaatagtcagtgtaccctaagcaagcaaatattccactaatttcctcacttgtcgcatagcacaatactcagtgtacccaaatctaaattggattcgacaataatcatatgtgaattccttagattacaaaataaatatcaaaaaagaagaccatttaactgaagatataaaaaagaactgcttcaatccaaggagctaaagctttttttttttcctttcaaaactctgtagaaactgcttccatctatgcatatnaaatcttttcacagatgaatacggaaacaaagatttaaacatgttcatgccctctcgacgggaggtaatactctactcttgtttgaggattgtatccgtcaaatattgtatttgatcaaatgatcttgttttggccaatgccctaagaggggtcccagctctgtttatatgggttgggggtatgtgttgcaagtagaaaatctagccaaactcgaccgaagcttccttaataaatattacaaaagaaaacccaaatagggatatagaatcgtaccttctcgcagttgtggcccaccttctgatagcagtcagatataaaggctatatgtaggtatcccatatctataatctccatgtgttctaataaatatgtgccataataagatgctaaaatgatgattttcaattatatccgtatacaagttaaagcctgaacttaatggaaaatgaactaatcctaccaaaatcttgcaaaggttctacattcctaaacaggctacgaaagtgtcgaccaaagtctgtctgca

SEQ ID NO: 25256 - DNA, 20970 bp, Oryza sativa
ctacgtttaatactccaaatgtgtgtccatatatctgatgtgacttgccaaaattttacacccctagaactaaacacagcctaaagcattgtcacgaggaaagctaacaaggcgcatacaaaatcatctcaaagcacctacagctcatcatatatcaggcatcagcttgaacgaattttcctcagatgaaggcaatagaaatcaactacatatcagaacaaacgctacatccaacatacactagaaaattagcacgccaagtggcgcgctcattatagctcgtgtctactttctaattagtttccaaaattcaggtctataaaaggttggcaaatgaaagattcaatggtgttattaacttatgcaacaagtttagctaaattagcttccatggcacttctgctaaaaaaaacccttgaagaacgatcatcgaaaactggatagaactatagataaatatattttcatgaattcactaagataaaaaaaaagcctgatactaccatagttgttccggtctagcttctagctatggcacaatgaataaacacaacaatgtagttacacggaaaacaaaaataaagtttagaaccacagtctttcacacattttaaatgccagaggtcatgatttcgagcaccttgtaggcggtagcaatttccatcttcaatatcttacatatccctagaaatgtcaggaggtgaacacaaattagttggacctagactgactgatagaaggagatcaagagcaagagacataagttaagccagattgtcctggtgggctagtggcacaacagcaaaagcttgaaacaacattccttagtttttaaggaaaattgttgtttctcaattgttagttcttattatgggtgcattcaaatgataatggaacaacccgttgatagacccatcaaagtgataacatccacccaacagaacaaataggatgagggagcgatattcagaaaaaaatatctcctcagaaaatattatattctttatatatttgtcagataattgcaaaaatgcatattcagatacagagaatgtggaaagaaatatacagagaatgtggaaagaaatataacaagctcatgatgtattaacttaagaatgtggtcattatgaacagttgcaatcgatcgcaacttcagaatttctcaagtaatactcaggacattcccttgaatagaacacttgccattagggcactaaccaattatgatgcaaatgtcagtaaatggcgccagttttatagatcattttcttttgtcaagaggagaagtattcttgaaagaaactattgtgcaggattgagaccaaagaaaaaaactatgtatcaatgcaggatgattataagtgttattagaaagggtattcaggaaaaaaaaatcaaacttgagttttgtcaagaactattcctgattatgttctttgagcacattaatatttctgttccagattatgctaattgtgtatatactaatagatctaactcatgtataattcgattgctactaagatgaaatcagtaatacataacttaactgattaataatccatataagagtttcatatgacagcatcaaattctgcaattccaagttgtgtgtttctcctggatttctgcagaagtagtagtagcaatagagcaattaatacactatccaacaaaatagtcctaactgtgctatcaaatgcaactctaagaaagaacgaaatattttctttcttggtcatttcatcgaacaccatgaatgcacagttcgcactacaaaacagcaaccacacgtttagggaaataaatggaacaaacagtgcactgtagcttgctcaccaccgctggccatggccacgaccgataagcgcggccttcacggcctcgagcggaggccagcagtggggccaaccaccgcggcacgcccggcggcatagtaggagtaggacgcggttgacgacgcagggaaggggcgggcagtgggcgaagagccggctggccggcgcacgcgcagggtggccgcattggctggcgcctcagcaacgacgatcgtggaaggaggtggcatcttacaggtaggggtgggcattcggttttaccgaaaaattcggtctcggttttcggtttttcggtcagttcggtctttgaaaactcaggaccaaatttcatcaaaaaaatctcaggatcagcaaattcagtctcggtctcggtcttaccaaaatttttcaggagtaagtttggaatgaaaaaatttgacagaggcggcgctggcgcgatggaggacggaggcgtcgccaacgcggtggagggcggaggcggcagcggcgcggtggaggacggtggcggcggcggcggcgcggtggaggcagtcaggcggaggccaagcgcgatgggagtgcggcaatggtagggttgtatcatttctagggtttgttttagtgggcttattgggtttcctaggcctattgggctaaaatttcggtcattttggttaaccgagcccaataaccgaaatgaccgaaataattcggtctttcgagggctgggaccgaacagataaccgaatttctcagtgttggtctcggtctttttggttcacttcttcggttcggtctaaatatgcccacccatacttacaggcgaggggtggctctggtgcggacgtgcggcaagggaggctccgaacggatcgacgagggacggtactgatgcagagcagcacgctggagacagcccgcgaatagtcggtaaaggcacgactatttctttgcaaggcttcaccatatcaaccgttggttcctaatccaatggatgtgtgtgcaaattaaaccctggaatcggcagccacgtggcgcactaatcacccgagatggtgcgtggaattcggtataagagattgagctcaagctctgtctctacttcctccttcacgatccttgcagaggctagccggagcaccgcatccgcttcattcactgagctcgcatttatcccctccaccgagctttgcacccctaagcttaaccacctcgtcaagtttgagagcggcggtcagccaagcagagaaggcggtgctagagctcgacagagcagtgacactcttggcatagaggagggcggcgaagagcgctggagtcgagaggatggtcactagcgtagctcacgccatcctccaccacactgatagttcgacgcccaccgaagtcattgccaccaccgctatcggctcgaatcgagtatgagcccaagcggcagtggtgcgtccatcgggtttccttggaggttcagagaggatactgatggcaacgtctttaaaagaagtccacactcggcatcagtaatcaatgcatagattgaatagggagggaaatggagaagagaagggagagagaaagcaagatggtggtcaatggcaagtggactctgtaattttttttttaggatttttcttattggatagccacatcaacatcatgcaggtgaaatccgccttggtttggcctaagcagggtaaggtaaatggtattaaaaagctaaggaggtgtcgatacacgattttaaagttgaaaggtgaactttaaacaaaatgaagaattcaggagatcaaattaatggactaatccctgaacactaattccatcgagggattaacatcctagtccaaagttcttctctggacttggactagtgcctggcttgctagctgccctgcctgagctcgtgagcacatagcaaagagaaatgtcacatatatggcacgtcatcagtatcggacaatgctggccacttgtcatagtgcttttcattgagactttaagaagtttctactccctccgtcaaaaaaaaaacaaatccgagttttcgtgttcaacgtttgactgttcgtcttatttaaaaaaattataaaaaaaattaaaaagataagtcacacataaattattaatcatgttttatcatctaacaataatgaaaatactaattataaaaaaatttcatataagacggacagtcaaacgttggacacggaaaccaggtttgtcttttttttttttggacggagggagtatgtcagtattgactagtggctattggtgacgaagaagacacaagcaaactgtaaacaacacatacagagaagaaagttgtaggcgatttttaattttcgctatgattcgatgatagtgtcatgaactcatgataaaaggcacacgatagtgtcaaaagggcaagagaaatgccacatgtcacatcatcggtactataggggtttgggccatcggtgactcggtgctgcaaaagacaaaccatttgtaatgttctctgatcatgatagcactgaatataccaaaaaaaaaaacgtggttcagctaatgcagacatgaaaaggtcacatttacgatcgatcgtgtcatcgatcactacgtacggtgcattcttaaccattggccatgcattattgtactaacttgcctagttaggacttaattttgctccattatacagtgcaattcttgcgtggaagcataataatctcaccttttgcggctaatagtcagagattcttacacaaaacgtatcgattatcatcattatcactttaaccattcatcgaaaaaacttcaatcagcacagcacttattgtttttaagataataaaaatggtttacattttcggactctatcgacagagaaacaaccaataaattaaaataattatatagagtgattggacatgttgcattgaaagttaagataaatagaatatattttagtaattaattatataggtactatgctatccaaaacgaaataaaaggctacaacctccaagagtatagcaccacagtgtatagtatcttactatttttgtgctagcatcaaagataagtgtgaagccagatgagagacctgaagataacctgcatatagcctattttctattataaaaactttatcattttagtaataccaattaatttaccaatattatgcaccagcttcaaatggaactagttttcttgacctggacatcccccacaagtcaattcgcaattatatttttgccacaagtcaattcacaattatattttttgcaccatggagaggaggacttttcaaagcaaataagatacatcgccaagcaaattgctcaatatgacattcaaagaaatggtattgaattgtctcttgcacattagaaaacaattttgcttatcaccccttaatccccttttgcaaggttatcctttgataaaagattaattacttgaccaatattatgcattggcttcgaataaagccaattttcttgaccgggacatcccccataagtcaattcacaattatatttttggcactgtggggaggacgtttgaaagcaaataagatacattgccaagtcaagcaaatcgatctatgtgacattcaaagaaatggtattgaattgtctcttgcacattagaaaacaattttgcttatcgccccctagttcctctttgcaaggttatcatttgttaaaaaattaattacttcttatgaaagaaccacataaacattttgatgatttttagtggcaccttcgtcttctataatattgccttgcggcgcatgatcgtagtgaacattactatatcataagattgagtgaacattggttatttttatgcctcaatcgaataaagcaatcatttttatttgaaaatgttatattagctagccaggtacgtatcaaatcatctccttcgactagcttgggaccaataattatcaacatttagtgatattgtgccataacattgattccttccggctacgttacataaataacgtatttatcttttggaggatatgttcaatcaacacagcactcatggattttagtgatggcatgcaaatggttctttttggaaaagataaacaatgaagagaataaatgtaaagaaccagatttgattataaatatgcggccggattttgcatatgtaagcagcagatcatcagaattcagagctaatgcattaatccatcatccacactcgtgagggctgtcaggtgcccatctgacgccacgtacgtccaaccagcgcgtttcatgctctgcacaaactagtactccctccgtctcctaatacaagagaatttgatattttgctggtactgtttgaccactcatcttatttaaaaaatttatataaatatacaacataaaaagttatatttaaagtacttttgataataaagtaagtcgaaaaaaataataattgtaaaaattcttgaataagacgatggttaaacagtgtaaacaaagagtcaaaatccgttatattaaagaacggaggggcggaaaaaagagagcaatagtttgattgttattcatgtactccctccgtaaaaaaaaaaaaagaggatgtgaccactcttaggagtataaatctggactatcctttgtccagatttgttgtcctaggttgagtttttttttgacagagaaagtactccatccgttttaggttacaagtcgttttgactctagttaaagttaaatcgcttcaaatttgaccaaatttatagaaaaaaacagtaacatttttaacccaagacaaatttattataaaaatatatttaattatcgatttaagaaaataatttggtattgtaaatatactatatttgtttataaagttagttaaatttgaagtagtttgactttgaccaaagtcaaaacgacttataatatgaaacgaagggagtatcgttttgtttattaggtgaaagatgcatatacaaaactattctcaagcatttcacgtgcctttttatcgtgcatttaatgtgacaaaaatcaacggcaaaaaaccctacatcaataaaattatattaaaaatgcacatgtctaagtagtactgtatatatttgtgaagaacaagattcaagtgatacttgtgaacgccaaattaagttttgaaattgatggcatatggttccacatcacaccactggtgcttattaattaactaaacgatcgatcgctatcattggctgattttcgtgaaatcaacatttgtccccccgccaaatattggtaattaagtgtgaattgagcataaagttaaaagtgccaccttttcaaatgtggtaacaacacttttattggagccatttattttctccgcaaaaattttacttcgttacaaataaggccttagcatgttatggttgatgggactagggactgtttaagtaattttagattatgagaatcaactaatgggaattcagatggtagaaatctagaaaaattggaaaaaaaacatcttctgacttatagtgaatttcctggattttaatttctttatgattaaattgattgtaagagatgccgcagcggctaaagacaccctaaatagcttgtagatattaagatacacatctagattcatgatgtatcacttctggtggaggcctaggatacaagcttcatgcaaattctatacaattttttgagagaaaaaagcttggattttacatatagaaccagggcaagatgacataacttagttgtaggcgtgtcttcaagctgactccataatttgagtacatatataatagtctagtttagtatacgtgctatgtatatcctatcggttcattctactttacatgcgagtggtggtcgatcgagcagagaaacttgtgggttcgtccattcttatccgtcctcagattcagcctaaagctcttggcccgtcacactcaacctattgatctgaatatttggcacaagtaactaacacttgaacccaccaataaatcaaaataaataaatttacaatttattctaaactacaaataagttaacggtttagccgcacaccgttaaagccgctttttgggtctcctcacgcaccaggctgcacttgagcggcagaatccaaccccaacacgtccatctctccctcgatcacttggtgaaaaagttttttttgtgtcgcattaaatatacggacacgctaaaatattaaacatagtctaataataaaatatattatatattccttctgtaaactgcgagacgaatttattgaagcaccatattatcaaattatggtgtaattaagcttaaaagattcatctcgcaattagtttttctattatatttaatacttcatgtatatatccaaaattttctgttcgagaactaaacggcataagataagctagttgcatgcaccacggcgtccacccgtggaccggccccacaccatcctcgtgggcccgcttgtcagtgacgttacgggagctacaacttgggtaggtcgcttgctgggtttgttgttgttgggggactcgctggattccagattctgttcggctggatagcgacggccaccgttttgcgaccaccaccagattctctgcgcgccactcctacctacgatcgacttgtgtggatctcttctacttttcgagttttgtcccgtgtgtgtgcaatgcattgcacctgcatggtcagccagccgcatcatccgcccgtacacgtgtcctgcatcgacggcgcagacggtctgtccagaaaggtcgtcagctcagggcacttccgtgatgcaagggcactgtgtgttgccaaacggaatcccttcagttcgctccttttcttttcttttcttttcctttttctataattttccttgctttcaccattgctctcaaatctggctccgttcatgccatgcatactctcctcctttcgtgtcactaaaagatacgaaatgttacacattattagaatctgaataggtactaaatgtatcatattttatattggacttatttcaccaagagagtaattattgggaaggttttacagaagcagatttggcaagaggctcatatatgcattgagatcctctgcctctaaagatatcgtgccattatcattctcatataggatatcttatagtattacgaatataaacaggctatcattccgaattcgtagtcctaacaaatatcccattcaattataggttctatattttgaaacggatgagtatattcaaggttcatcggacccacgtgtcagctgattgcttattcttatattataagacagatgaggacctgtttggtagaactctaactcctaaatttaacttcagaagttagttatggagtggagttgtggagctgcctaaacctagcttcacttctttagtttattttgtgagagagctacacctagcttcgcttctatttttggtggagctgaaactgtagatgtgcccggagtatattcagggttcatcggacccacgcgacagctgacggcttcaagggctctcgtgggaaattgagggtgctataaaagcagccgccatgagccacagccacacccgctgtgggaagggaagagccagagaggccacacacacacaagcacaacacaaaagtggccatggctctcctcctctcctaccccaggcgccacccatccatccacctcctcatcctctccgcctacgccctcttcctcctcccaatcttgggtgggtcttggttcttggatcatccacttcattgccatctatcagaaattgcttcttctttctgattttgtttctttgtttgtgatggatgtttttttgtggtgtctgattgttagatggattggagctgggaggagatgggctctacagggagatcctcagggatgagacggtgctcaggctcaaagaacttggcaaggtcaggttcttcatgtcgttggaatattcagttctttgatccactttttaaggggaatctcgtccggattgtatagattgtttgggctcctgcatgctgctacctctgtttgttgctaattcagatagcttcataattggaaatataaattaattctaggtgttatatgtggacagctattgacacccaaatgaccatatataggtttaaaaaaatatctgtggggttcatgtgtgtacacttctttgttcatcagatgaacagtgtaaatttcatttttaggatacaatttcactctttcctcggagagaatacaatttcattttgtataacttaccagtacagaccatatcaagacagctagctgcaggctactcgaaaattatgcaaaaggattgcaaatatattctaggcttctcatctcttcttttttggggtgaatttcattttactaggcgttaaagcatcaaacttttgtaaggcttttgttccttttctctattagttatgtttattggtcattccaaagaatcatatccatctcctgtattcgggtgagatgaccttacgctatgaaggttgctcaatttttacgttctccagttgaaatattaaatatatataaactgaacaaaatcctggtttcaaagatccgtgctgcaccttatttttactctattgcctaacagtttagccatgcagtcctaacacggcgtcgttttgtgtgaatcagatatctgatggggaaggttaccttgagaggacatttttgagtcctgcctcaatcagagcctctgctgtcattatcagctggatgaaagatgccggacttaccacgtagatttttcttctcttgtttatactgcagtcattttctcaaactttgacctttgctgaccaatatatgccttatattaaggtggattgatcaaatggggaatattcatggtcgatttgaaccgaccaactcaaccaaggaggccttgttgatcggatctcacatggtgagaaatagatatatcttttcatactgtcgcacatcttctagttaaataaaatcactgataaaaaaaataaatcttgtttttttttggggggaaaacaggacactgttattgatgctggcatgtatgacggagctttgggtattatctctgcaatctctgctttgaaggttttgaaagttactgggagacttcagagacttactagaccagtagaggttagataaaaattaattaccctagataaaatgttttcatcagtgtgctagtgatgttactactttatcatcatagtttgtttctttcataagaatatatgtattgggttacattagtcgctatcctactccttactagttgcatgatgagtcacatgtgtcctacaaataagacatttatctgcacataacttgtctctgtcttgtgtattttactagtatcttagtatgtgtcatccacatcatcgatctcgtgttgatttaaattagcatagtaggtttcaaagaacgtgaatgggctgctatcacaatagattatcagaaagactacagatatagacatatttaatccaggatgaatccattatataatgtctctttactcagttggctgtttccctgcttatgtagagaagaacctataccttattctgatatctataattcataaagctgttgggcctcacggttgcctggtaaacctcaggtgattgcattcagcgatgaggagggtgttagattccaaacaacttttctgggaagcgccgctgtagctggtacactacctgaatcaattttacaagtatctgacaagaggttgtcttttttcgcataaatcaaccgaactgttttttgaaattgtttgctgattcagtatatattttgcattcaacttcttcagtggcacgacagttcaagatgtcctaaagctgaattctcttgagggcactgctaatgctcttggtgaagtaaggtacagcccggagtctgtcgggagttatgtcgaggtatacaagactgtattattttaatctaggtgtataacagatataagaaatttagcatttaccattctttttcattactattttggttaggttcacattgaacaagggcctgtcctggaagcccttcgttatccgcttggtgttgtaaaaggaattgcaggacagacgcgattaaaggtgcaatcactttctagttaatacttttttggtcaagagtaagcggtgacacttatagaactatatatgtgagccaaaacaaaaatatgacttgtttctgaaaacaaaactaaaagatgaccaggtagcattgcatactaaatttagaccaacttttccaaacaattggcatgctaaaatgaccaggacctagtaaacaatcaagtaagcaattatattgctggtcattctttagcaaagaatgtcagtgctcgaagtcaacgctgaggtcaggtactattaatcagtgacaactgaagaactttattagtacttcacaagattctcgtttaacaaactattttgaaagactgcaccagcgtagagttggtacttgcaaatcaagtaaaatgttatagcatgagctttctttaataaacagtgataaccagcttagctgactatcaccaaggttgatgtttgatattgttctgaattatccaaatccgttaatctcagtgtgattttagcatgagcagtgcttccttacactacaaaaactaattaaactagttttcaatctcgatgcccacagtaacagattagtaggtgctggccaaaatataatcgatcaaacaagctgggcttgctttcaactgccattgcttagcaactttctggtttctttaggtaattataaatggttcacaagggcatgctggcacggttccaatgaaattgcgccgtgatccgatggttgcagctgcagagctcgtcctgacactggagacgctctgcaaagaacccaacaagttcctcacctacgacgaggaatgcggctgcttcactgaggaatccctcgccggactcgtctgcaccgtcggcgagctcctgacatggcccagcgccagcaacgtcataccaggccaggtaatgtaatgtataattcagcttgatcattgctggtgatgatgcttccaggtaagctaagctggctctgctgaagcttttggagtttggtgatcttatgcaggtgaacttcacggtggacatacgcgccatggacgacaaggtgagggagacgatcgtcaccagcttctcgaggcttgttcttcagagatgcgacgacagattggtcgactgcgccgtcgagcagaaggtgccaagaaaccgaagcatttcgcttgtgatttcgcgatgttttttttgttttgcaggtggtctggtgttaaaactgcggattggttggtgtttgtttttttgcagcacgcggcggcggcgacgccgtgcgacgcggagctgacgtcgcggctggagcgcgcgacgcggtcgacgatctcgtcgatggcggcgggcgtgcgccgggccggcggcgagacgccggtgctgatgagcggagcggggcacgacgcgatggcgatggcgaggctgacgaaggtggggatgctgttcgtgcggtgccgcggcggcgtgagccactcgccggaggagtccgtgatggacgacgacgtctgggccgccggcctcgcgctggtcaacttcattgaccagaacgcggtggatgcggcggcggcgacggcggcggaatcgtgacgacgacggcggcgattcttttggtaggtgtgtgcctagtagcctacaaattgtaaatatggatttgcttgttacatttgtcaagaaataaaattgaattcaattcgttgagacgttcagtactgcttatctttattttatattttatggttgcagttactctaagttcaagttcttaagtttaactctctatagaatcgaatttcagactgcattatttgaaaggctaagtttacaattgggaggctgcatatatttaattggatgtagatgctagataaaaagtaccattctcagagaaaaataataattttatcttttttaatgttttttcgttatttttgagtgagaatcgtgctgcatcacgccatcaatactgtaactgacgagttggcccaacagatatagaacgtaagtttgccatcaatcccgttccagcccaaccaaatatatataggcccaaaatggttccgagtgccgctccggcccaatatatatgagcgtcacgtagatcgtactccctctattctaaattgatctacatatttcatagttacaacgagatcaagaaaagctaataactttctcatactatatttaaaagctaataactttctcatactatatttactctagcaacaaactcgatgcatgcaccatccctattatttcctagccaatagcaaatcaagatattacatgtgggttataaatacttatgtgtatggatgcatgcatcaatatacatttactccaatgcataaataacgaatagacttaataaatgaatataaatatgtagatcatttagaaataaactaaaaaaaatatatgtaaatcaatttggaatggagggagtagtcccgttccggcccaaatagtatgggccgtacgtagctgattccttttacggcctgcgaggtgtacgtgaagcagccgcgtcgagatccaaaacgccaactaacgtgtgggcccgaggttgttggggcccacatggcagtgaaccgtattgggccgggaggaaggagcggacggggctaatgttggatggcacgaggcccaagtttgctagccgaacggataaaagaagtgaaataccggctttggcatggcagtgggtaatatgagtatacactaatacgaaatagtagtagtagtagtagtaaatgataataagattattagatagcacacatcgagagtactagtgatatgaactagtgtgtgtgtatatatatatacacactgcagctggttagtatactactccctcaattacaacattaaagttttgtcctgaatcaaacttcgacctctaattttaaccgagtttaatagacaaaactaaatatctataaacatcaacagttttattaaatccactacaaatatcatcatagttaggatttcatccattccattttgttaatcctattacattttaacggaaagaaaacaacggaaccctaacagtgataacatttctaggaaaaattgattcatgcgatggtatttcttgaaagttacattcgtcgatggtattttttttggaataaaacacttagtttgtcaatgcatggcatttgtccgattttcttctttctatatactcgggagatatttgactttagacataactaaaatgacttattatgtaaaatgatttataatgtgaaacaaaagagagtattattttgttttccattttacatggtctctagtaattaatcctattatggcgtgtgtacaaggcagggatgtggcgagtggcttcgctaggccccattggagccaggtggctcaccagcttggttgcaatcgtgccccatagagggcacggttgagttgcagggctgaggcaaccacgctcgaagtacggatcacgagtcgttacatgttgggcaaggccgtggcctcgtgacgcatgcccctgcgtgttaactaggctagatttgacaaaaggtggtggtgcgatggatgaggttgaagaagataacaagtgcggtgggaaggaagagaagaggacactaccaccacggacaccgtcgagttcatcactacatctgcggatgctgctcaccttgatttgctcattgccaggtggcgctgccttgatctgcaccattgagattgctgttcaatctttgctcgccgatgagggaggagaagaggggccgacttgatctaccagacgcaccgtcgatgtcggatcccaatctctgccgaggttgagcttgccaccaccacctagctcctccctcgttcccacatgtcgtcatagagcttcttctccattaactcgtgaaagagatggcagcaaagagagggtgtgctgagctcctcaccaattctgcaacaaggaataagggatagcggcgaggagggtccgagggtgccacgacagggaaggaggagagtacaactccatcggcgcatgggaggagaggtcctcaccggttctttgaggacaggctatgggggagagagagtgagaaacaccgcaactgggagtggagaggagatggatgaggattttttatattattttctcggttttaggatatgtttagtatacaattttatatttttatgtaaaatgaataaaatatgagtgaaatagaaagcatcaggggctaaaatgaatgaaaaaatgaaaccacgttgtattatatgcaaaaatcactgctgggggaatcatctttagtcccagtttgcaacctcctttagtcctggattgcaaaccgggacgcccaatccaggactaaagctgccccatctttagtcctggttgaaataaccgggactaataaatgtttttttcttttttttcattggtatttttgctacttgcatattgatttcgaaccgaactcaacaacaaaatcatccacattcacaaaaacatcataaaaccatccacaaattcacagatcgaatgaacatactcaaattgacatcacaaactcacagatccacagaatgaacaaattcacatcacaatttcacagatccacaaaatgaacaaattcgcagacatcacaaatgaacaaattcatagacatcacaaatgctgcacgcctccaagtccgtcgccccacatggtgccagcaatcacgctcgcgccgtcgctccaccgctacacaggccgccgtagccagccacctcccctcccaccggatccggcggaggggagggcgctgctgccacccgtcgcctcctcttgcgccgccacctaccgcctaccgcctaccgccccaccagatctagcgggaggggagggcgctgccgccacccgctcgccggcttgctcgctcattcgctccttgctactactgcacgaaaaggagaggataagggagagggaagagagagagaggagagaggaggaacaaatgaggaggaggagaggataagtgcaagggattatatacggcgcgtcgatctttagtcccagttggtcggttgatgacaccagccgggactaaagatagtgaggggcctgacattttttgaaccgggactaaaaatcatttttagtcccggttgatttatataagtgtcgttgtgcttttgaaccaaagctaaaggtcttatttagtctcgattcctattcgaaccggaactaatgtgatttttatcattcgaacaaagatcacttttccagcagtgaaccagctcagattttagaccggtgacctcaacttaattggcactgtcactgatgcctccatttttcatgtccttatggttccatgcatgcaatgctagtaggaaggttctgcatgcatccctagaagaggccacacagctgctgggactgtaagctgcctgtgagggtaattgtactcctacactactatagtcaaggcaagaaggatggcatgaaggactaacatacaacaatacacagacccaaatcatacaaccatgtgacccaaaaaaaaaagattccccttcttttgtaataaccaaataaaggtttctctcctcctaccaatgcaaatatactccctccatcggtccatcccataataaatttatttttaagctccttttgtatatcctaaaataccttttaagtaatcattataccaaagtttataaaagtagaagataaacatattgggagtagataaagtatgagtaattgtattaagatttaataaaataaggatatttttaatttttcaaaattttattggtagatgtatgtaggattagtaagaaataaacttattttggaaccaagaaaggacttatacttgttacatgcatggccgccggactcgtggaagattaaattttctgccgtggcaacggagcaaagcaaaagatacactgtacggttactgtaccctacacgtatcatgcacctggctggaaatcgaggcacgtcgtacagtacagtacaagtacaagtattcgctgacatactacgtgtagagatcagtacttgtactagctaactacttactccctccttcccataatataagggattttgagttataagggattttgaggttttggttgtattggttgatcactccgcttattcaaaaaaaaattgtgcaaatatgaaaaacgaaaaagtttccgtttaaaatactttgtataataacgtaagtcaaaaaaaataatttcaaaattttttgaataagacgagtggtcaaacagtgcaagtaaaactcaaaatcccttatattataggacggagggagtagtagcttcctcttgtgcatatgaatgcgtatgtattgctgcagcatatatacagcctcgtacgctacgagtagttcgtactagtatagagatgcagatcgatcgatgcatgcttgtacgtataaacttaataaaggtgaagtgacttggaagatttaattttggacgcgatttgaaagagagagagcgaaaaaaaattgaagtttggccagtagatcgatcgagctagctatactccgtaattataagtacgacgtactccgtacagacgacgcgcacggtagatatcgctagatcgagaagcaagatggtgcgcactatactactactctgtgtaccgctaccacagctttgtgccaaccctgctcttgttaaacgattggggacttccagataatacacaaatggtactgttatatcatgtttataattatataattagttgagtttgacaaaagctttcattgtattaaaaaaggagtaattacatatgttgatggtatataaacttggtgtaataacttagtttccgaacttataataggctagcttgttatgatacacaaacttatctagtgtgtgtaatccaggttcaaaacaacatattataactgattatgttgagttattaggacacccacgatgtgagaacatgggtggggtattctgatatcaaaatataccttagagcaagtttaatagtatagccaacagctagctctaaattatctatagttaatcttatagcctatttatacaatagttaattataaaaatatactacattattaatattcggttccacctatcatacacataatattttagagtgcgtgttgtaactggctacaaatctgtagctcgctttcttctctcttttcttttttcttctcgatatatggttatagctggcttatagcctgctattgtacctgctcttatatattgttagggtcatagagtggtttctagatacgggtgtccatatgattatagcctgccctcaaggcattaaaaaatgaaaaataactcccttctctcactgaccaagagaaaagaagagacgaagggagagagaaaaaaacgattttcttttaaaagtgtgggttccatcttaattaggttggtcccaccttaacatcatcgtactacatatacactgctaaatcatcatccaatattttagacgacattagagaatcaaaatccatcgcaccatcagttgtatatactccctccgtccggatcacgagtttttgtttgtattggttcaccactcgacttattaaaaattttttggaattattatttatttttttacttattttattatccaaagtacttaaagcacaacttttcgttttttatatttgcacaaattttttgaataagaagagtggtcaaacagtgcaagtaaaaactcaaaataccttatattatgtgacggagggagtacatgggactctatccgtgccaaaatacagcaacttttagcacttagtaggatttgtctcaaaatataataagttatccaccaacattcccttcccaatcaatcacaaccctccactattcactttttctacctacctttacttctcaactaatcataacccctcctatttaattatacctattttcttaataatcgtgtccaactctaaaactctctgtattatatgtatgataagactgagggagtaagttgataactcttttgaaggcattagttattcattgtatttcaccgtggtgaatctttcaaagaactcgggggttgattgtttcaggtggtgtgtcaccagtgtttacaatactgtgtggtaaccttttcagctttttaaaccgcggtatatctcacggtagctatacagttttcacggtaaccgcaccagttaccgcgataacctccaaactatggggtgacgggaaccctactatcacaccccgaagttcttctccgaagtctaaatttaatttataaataaccttgagaaaatatcagtgtaaaagcaagagagaaaccctaaaggaattaatgcaaatactaatcggaaaggacatgtgggatttttcttgagttctacatgtcgaaatatgctaacaagatttttagtggaatgttcagagctctagaaataattttaaccaattaaaatttagcacgagcaattatttaatccatgggtattcatttctttctttttcctttcctttttctttttcctcttttttttttcttttcgaatgggccgctggcccattctcttctcctttccctccccgctgggccggccgaaggccaaggcccagtagccagccgcccacgcccctcctcccctagggtcaccgacaggtgggccccacctgtcgggcccgtctcccacctccggccgacgccaccacgccgcaaccgccgctcccgcctctttcgcgcgttcgcacccacgtattccgccttgctggccctctaccgcacacccctgaaccaccggcccactttcccggccgagcccgcgcccgcgctcgagacgaccgggattcgattttcgaatcccgactctctctcctccccacctctccccactccgtcggcgaaatcgcggctatctcggccacgatcgatcccttgagcctatataaaccaccaccgcccttccctctctttttcactattaccgccgagctccctcgtgccctcttccgtcctagcgccatcgcccgcctatccgccgccgccgc

SEQ ID NO: 25257 - DNA, 5988 bp, Oryza sativa
catggacccgatccaccatggaccagcgcccgaggccactgccatgtggggcccgcatgtcggagccgacctctatctctgatgatgtaccagggctaataattgcacaataaatcaattaaggatttctgtttatagtaaaacacagtgaatcttctaaaattcatatctaattcatccgtgctccttttaagcccattcaagtctcagtaaatcaagaaaaatgcaaagaatccattaaaaatggttttgttctctgtttcagtagtcttatagcctgtttgtatggtttgttttgtatgtcgcttagattccgactctcctaacgctccggtgtactttgagatagtcgccgaggttcctccagcagcagagcaaggcaagtcatgcttgtcacttgaacatattgaacctatattacaaatgctctatcgtttttcccttaaatactgcattgttttataatgttactatgggatgtttgtctattgttacagccatgccatttttgtaccttactcctttgttagcttggggttgtaacatgattagatgttggattaggaagtgcttagccatgcttagttcaactagcacacaatgggggacaacattaatgcatagatatcaaattttagtaatgatgttggttagtgccaccgctccggtgttggttaattaaaatatattaaatggtgggctgtgggtgcatggttttgatggtagtgcccatggcgattaaggaccggttcgcgggaaaccctaaaagaattcttcgtacttaccataagccagcgtgggcaacggctgggcttgtagtgtagctttcctctagctgacgcatccaggcaagggtgggccctgcgacggcctctgtcgcttccggattcacctagacacgagaggggactgcccgttgcccgctggggacgggggtgaaacctgaggtgtggtgtgcttggctagaggggggttatgcgaaaggtcctgtcacggccttattccggtatgtcatggtggcatgtcggtgcacggtaacgtgtcgtggggctgtgtcttgtgggtacagttgtacacctctgatcagagtaaaactattcgagtagccgtgcccgcggttatgggcggtcaaccagattcaccgtgattagtctcaccctagtttagtctgatggaattgattagttcaggtggatggttgggcttgttgcaacgtggtgtagcgttggacagtggatggttgatgttgattaattaatacaactgttttactgctttcaactactgtttataaatgctcgctttatgtaaatgaaccgctctacctatcctttggttatatcctacatcacaccccctgttccggtatgacttgctgagtacggtggttgtactcagtcttgctctattcccccccctccccagagtttgagtatgcgtcagatggtggcttttccgagttataggcttcgtccgtgccgtcgaggatgcctgtggagtggtgttcccgctgcagtccaagtcaaggcttagctccagttatccgttaattttccgttgtatttatgtaagactttataatgtttgtaagacgtggatctgtatgtcaactttatcgtttgtgtacctcggccggtcctggacggggggttttaatgcacattctgcttggaattctattcgggaatttctggacgtgacacctacccaaaacgatttgggaaaccctgtgtgtcacttcatcaaaagcctatggttttgggccgctactaataataagtcgtcgttaaaatttaaaattttattttgaaattttttatcataatttatcttacaatattgacttttacgaaaatttaaaatttacgaaaatttattgctgcgtttattttaggaccgagtagaagataagagtataaaatgtgaccggagcatgtggagaacttgagagttgtttggtgtatacccctatgccggttgcttcatattcatcacagctgaactgattgattgacctgcgtgcagagccttgaatatttctctcctacactcacctgacagctagctagatcgatctatcgatttgcctgctatcgtgtcactcatcaggaggagaaacagattgatcatcccgtcaccaatcgatcggtcgatctatgatctctctaaacgattgatgagcgaatgtacgaagaagcatttcaggaagggatagcactgtgcaaaaatggaagtggagtagcagtagcagagcaaacgcgaaaatgcagggagcatgagctgagctagggcgtagacgcgtagtagtagtagtagctagggatctctgcctgctttctagggctagcttagcacaagggacagtgacacgagagtggaagtggtaagagacaaactggatgatgcatgctttctgaattctgataggcaggtgcagagtgcagacatggttttgccatcaacttttggcctctagcaacacacacacacacaaagtttggatgtgttttagtttctgaaattagaaaaaagttcaagaaaagttgatagtttggaaaaaaagtcgaaagtttatatatataggaaagttttggatgtgatagaaagttaggagttgggggaaaatttggtgtgaaggccaaactctctcctaatctcattcactctgtctcttctctctcttccttcggctctctttgattttgggtttagttcacgctaaaattagaagtttaattgaaattggaacgatgtgatggaaaagttagaagtttgtgtgtaggaaagttttgatgtgatggaaaaattgaaagtttgaagaaaaagtcgggaactaaaccaggcctttgtttacagaagttgttagcagcagtagtttcttccagagtcaattttttttttcaaataatttagttttttctagattttgaaaatttataattgtaactcgtagaatcttaaaaataaattagaagctagctaacaaccaaccaactgcttattgtagtcgtaagctgtcccacgagctcttatattactaagtcgattttagtcgtggattatctacttgattatagaggtaaattaaatattttaaaatttaaacttaaataatttgaaataagtagtctaaataatgtagcacaagatattttttttaagaaaatgtatttttttgacaatgtaatgtaaataatctgttttaataatcgatgaatgagctgaagagaaatatggtgtgtgtttctcttatctctgtgtgtgttccttctctctctttttatgtgtttgtgtgtgagagagatactacagctttttggaagagaaaggctgatgataagtttcgagttggcgacttcaagtcaattcgtgtagctacgataccaagtgcactagctatagcttagccctagtactgcactggagtaggagtactactggggttgtcctccatgtacgcaaacaaaaattttcgcatcaaagagacaacgccacagaagatattactgcagagtattaatttatctctactactcgcgatgcactactagccggagtctcaagcaacacatcacacagtgtaaaacaaatccagccacgaatttatacagtgagaaaactatagcaatatccattgcagacgtactcgcgtatattagtagttgtgagataacgctacagccgactacaggtaagggctccgttggaagaatttttttatatttttttagaattttttacttttaaattttattaataaacctctcaaaaaaatatttttcaaatctaaatcttttgtccacgccttgcagtgctggcttgccacgctagccccttgctacgccactatggctagcctggccaaacaacgctggcatggccaaaaggttcagtttttgaaaatatttttttggaaatatatattaataaaatttaaaaataaaaggtctaaaaaataaaaaaattcatgttggaacgcatcattcgaagaacgtaattaagaatagaaaaaaaatagagcatttaggcttcttatttgatttatatagaaatttcataggatttaaatcctatatgatttttttctatttggccctttgatacaaagaattaaagcttttcagatcctatgaaattcctatggaatggctcattgcatgtagatttaggagaaaacatagcaagagcttcaacttcttgaaaaatttcctttgagttatctctctcatctaatataattcctgatttttcttgtggtctaatcaaacaattatttttatgtttttcttggggtttgcaatccactattttacatttgcattcctggtaaaatcatgtgttttcctattccgccgtttttcttaaccctgcgattcaaaggggccttttatggatggaccaatcccgcagaatttccaaaaacatgaagttgtactggatatactagggatttagtgttcttttgaaacacaaatgttgaaaaaacttagggatatgcattgagcttctgaaaggaaatcaaaaccatgaggtttgagcttatgtttgaaatccttcaaaaagtggaggaaagaaaggattcctatgaaaattttcttgaaaggaatcctatgaaaattttctaaccaaatcattcaaaccatatgtctccctagctaggaaaattttcaatagtatttcaatcctacaactttcctttaaaaaccctttgtttcaaaagagcctttaatggaggggaggggggggggcagagagaagatgcgttggcctcaccaaacacaggatcataaaaacgcatgaatgatcataaaaacacagaaatagaaaaaaaaatacaggtttggagtacccctaccacttcaaatcctatgcaggaaaactgcatgaatccgtttagatggagcgcaggaaacacacaggaatcagttcataagagtgaaagacacaaatgatatttttccaataggttgtacctcatgtcaaaattcctatactttgaaccaatccaaggaatttggtaggattttcggatggaaatttcctttgattcataggaccatgtataaaaattttccttaggattgagttccttcaaatttcttacaaacctgtcccaaaggagcactaaaataagatttgagctcatatatagtaaaaaaaatttccaatggaagtgatgcatatgataacagtccatagaaaattgtcatgttcatatcctttgttccaaaacacactagatatatataggaaaaaatccttcaaaattcctttgtgggctcctttggaacaatgtccaacactttcaaaggaattttaaagaaaaatccgaagatattttttgaggaaatgatgaacactgtccaacaaattgtttaaaatcaaccactgccgtgtgcaaaaaataaaaataaaaatgcatagaataacagatcagagctgagacaaaccaaaaccggcgttgcgctacccagacaacaacaacaacatgtcaacaactgctactctactccatatccaatcctttcccctctcaaatttaattacgcaagaacacacagtccatcgatatccatcatccatttatataactgttgctttgcttagattgcgattctcaaatttaatcatgaattctcatatatgcatacctttagctttggcatggctagcctcacatgaattaatcccttggcatctcgagtacaagctagtaccacagtttcactatcatttgatcgcagctgccgcttcacagctgcctcactccactccacttcacccttgaaaattttcagctcacgcagctgcagctgacgacgccgcgcgccgacgacgacgaccatgatgaaccctcgccgggtgccgcctctgccgtcgtcgacgtcgtcccgctcggcagcggacgacatggacccgcgcgtgtggcgccggctgtcgcagccgctggtggaccgcattctggcgtgcctcccgacgccgttgttc

SEQ ID NO: 25258 - DNA, 4599 bp, Oryza sativa
aggtaagcgcgccgcgccattgatgacgcatgggtaaatactcttgcacagatttgctgatcttgccttggttgttgttcttaggttctactgcatgagctagtcgccgtttgccgttctggtgttccacgtgcggaaaacgtatgaacaaggggcaacccccgatgaggcggttcctgaggtcgccggcgctggtggagctcgccgcgggaaggaaggaagcggcaagggtggcgctggtgtcggccgtcgagaagagccgtctcagcgtgccccgcagcgtgcgcctgtggacgctgcgcggcggcggcggcggcggcggcggtggcgcgtggacggaggtggcgcggatgccgccggaggtgcacgcgcagttcgccgcggcggagggcgggcgcgggttcgagtgcgcggcgcacggcgactacgtcgtgctcgcgccgcgcgggcccgtggcgcaggcgcccacgagcgcgctcgtgttcgactcccgccgcgacgagtggcggtgggcgccgccgtgcccgtacgtcgtcgtcgcgcaccacggcggcgccggcgcggcgggtttccgggtgttcgcgtacgagccccggctggcgacgccggccattggcctcctcgacgccacggcgcccgtcgccttgcatggcatgcatgatggttaggagcatactatgtgcttttttgtgcatgctgcctgcatcaactaatcaatttgttatggcctagggcatgcatacacatgttcatgagcaagctaggtttgtggtgtattaaagttgtttcagcaatggggatcatatgttaatttcttatgagcaattaagtgtgttatatgataggttaggtatgagaattagcatgattctagctagtagtatgtgcaagttagtagtatgtactaggtagcttaattaattaattaggttgtatttgtcatctgagttggtagtgtgctagattgacagtggtctgaactctgaagtggtttcatctctgttaattcagaaaacactaataattcagaaaacctactgaagggtttctactcaacaactactactactttgatcttgccatgagatctgttgaagaatattcatgcatgtgattttctgaagagtgttgatttagatggtttatcatgatcacatgaagcctacaacagtatgtgatcatttgagtatgatcttctggccagcatgactttgtctgttgaatccacctcagatcggtatatagtttctcagtttggatatgcatttcttccatatatttgcttaatattcacacatacttatgtgtgtagttgcatctttcttgtgagtgaaattagtacgacctctattaaataaagctagatactctgaaaaagtaagatgcccaaacttagtttatgtagcgcccttggtcgatcaaattttatggccaatcttttttttttcttttgcaagcttactctagctagaattgtactcctaacatagacattgtatatatgtaaacatagttttcccgatcgatcgagttgttgattcagtatatcatgcatctctggggaagcagtaacaagcaccagagatatggtggttcagatctttagccacccccaaccaggttctaatcacatccatttaattttaaaaatcatgtgtaagtaatatactgctagtatatatagtatgttctaaagatctcaataggattgtagaaatcccaaaggaactaaactgcaaaacatgctacgcactgattattacagtcatttggaacacactacgaagtgatcatgcatgcatgcatgaaactgatgaaagtaacttgtgtatatttcagcagactctgaataaaagagcatatgtgtttcagaaccatgaaattgtacgtcttctgtttttctgttgcaaagtatgacttcactagcttgtagagtatactccatcgcactaactatcaaattgcattttgacatataaccatccagtagcaaatatcttctgtactatatatcttcagatactggacgcactagtgaataaattttcggagaatatatctaacatacgtaccatctggtcctacgttgctctattctgggacggagggagtagcttatctaacatgcatcctgaatcagctaggtttgatagattttgttcgctactacttccgttttaaaatgtagctatttataatattcacttatactaaaataaagctatttcttcacttacttcatcttttcaactaatcataaccgttcttcatttattttttaactatttttttctctaattaatcacaacatttttccaatcattttcatattctagtaggtaggaagtactagtatatatatatagaatcataccgaggaaattatgttaactaacaaatgttaattataaaatgtgatcaaagagaagatggatatatctgatgttgttgttgcttgcacagtagaactatgtttggtaatgtacagtggaatggaggaatctcttatggggaatgcacatgagttaagtactgtaggatgaacagcaagctagggcaggggtatgagtatactcctatatgcaatgcaggtagtactgctgctgctgctactgatcttgaccggatcggccggccggccggccggtcggagggcctctgccatggccacaggaagctctggctcatctgcatgctgggcttgctgcaacaatcgcagctggaatcctatcatttctttggctttggccaagaaatcaatggagcagtagttcagcctcaccagcaggctacacaaccttagaccccgggccctatatagtagacctcgaatattaattaacatgggtactgtattagtagtactttaattatactttaattagagattggattttaatttgctgatacggactatacttaattaatctgttactacttcattttacatgttgggagaaaaggatttctaaccattccaaccggtcactccgttttgcaaacaaacatatccataagtggccagttagccacttatccatatttctaaccatcccaaacaaacgcagactaagatgtaaaatactccacaattgatccttaatcttgtcagttaagtttataaactttcatgactcttttgaaatgacgtagaaagtttacaagatttttataagaaatagttcgtttcatgtaaaattccttgattccaaattaaaccttaatttgcatatacagtacagtgcttaaactctgactacctcaattctcaaaaggacggtgatttggacatccacgtaagcttcaatataatgcatatgctttataattactttcttaaagtatttataaaacatattaaaaatataactctaggaatagttttgcacagaaaatctactaattaatatcatttacacattttaaatcataatatttttatctactagtgatttaagattttaagatttgactacacacattttgggaattctcttaagatctagaaccaatgttgttgtaaagcatcgatatacacgtcaatagtttggatataagggtgtgtttagttcacgtcaaaattaaaaatttgattgaaattggaacgatgtgatgaaaaagttagaagtttgtgtgtgtagaaaaattttgatgtgatgaaaaagttaaaagtttgaagaaaaggttgggaactaaaccaggcctttatgatggcatgaagacattatactatttggtaactacgttatattgaattctacatcccaggatattaattatgggcactcctttcccatccaacatccagtatttatatgttctaggtatgcacgatcctcaacaaactagacctcgacttgtcgtactcacaccaatattactattagtaacatgtagttataatgtttgtctagaaaaaatgtccaatgctgcttatatcctactattacaattctaaattttactttgcactttaactgtagaacaaagttattaaaacttgaccaaacagcctatcagagatctccaaattaaatcacctctggtcgccaagtagcagttagcatgccatttatactacatatggtgaattatgtgacttggagaaaacatataatatttttaataagaaattatgagcgtgttggaaattaaacatgagtatcttagggttgagatcacacacccccttctactaaactatcaggtgcatctcaaaaacgtatagtactatgattgtaagagaaaatattgaaatcgtacaaggtatagccttatgatctttttttctctaaaatatctatagggatagtccatttcatatatgaatttcaaagaaaatgatataattaattgcggattattgtactccagtctcctcgatctctcgtggacgttggcaacctggcacaaccaccacccctcgtttactgacgtttttgtgttgttttcaacaagaagataattattggatgtttgactacactttttcataagagaaacaaataaacaatgtccggtgtctctagcttcatgttaatttctaagtcattcatacgtttcacaatgtaagtcattctagcatttcccacattcata

SEQ ID NO: 25259 - DNA, 23380 bp, Oryza sativa
  unsure (1)..(23380): unsure at all n locations
attgtttttatgtgtcattgacatttagcagacaattcatgcattaactaccttttgcgatgagtacattgtaaaatcttcacaccggtattttcttaatttctctaccaaattaaacgatgaaatggccatgtgaaaatatgaagtattccatatttatgtgcaaacaagtttgcaatgatgtatcagccagttgtctctgcttgagtggaaccaaagcaacgaaaaaggacccatcccatacgtgcaactttaatcaaatttcctcttttctttttatttatttatttcttcttcttcttcttcttcttttttgaatttctcattgaccaagcaagcacatgtgccaaaactgcacctggagaaaagatcaagaatccgaacaaaatgcgccgaaaacaacagtgaaaagaaataaacatttgcagcataaccaattttctgaagaaccaagtaaccaatattcttatgcaccttagcctgcatagcgaaatctggctagcatctagcatgcagctggaaaattcttcctgcttcccctttgcctgctcacctgagacttgttaaccatttgttgcaagctcttttaaacttgtatctttttactcaaatattatacatattacctctgtcctaacatctaaaatattagtgattgatcccatatagttacataggaaaaattcgttatatttttttaaaaaatatattcaaacaatatgataatattgtgtctttcatcatctgtttgttgggtgcaaccaaaatttaaattttgaaacttaatgctagtggctgaatttggcgctttcttttccattcacacatagttttttccctagccttgactagtacagatacaaaatttttacctataaatatttttttcctttgttcattgacataaggtgtaaccagccttaaataataaggcttcaaataattagttagtgcgcgcaaatgtgtaattcaatttattgctagtacaacgaatctggataggtgcaagataatgtaaggtatggtaatgtcataccataacataaattcgtttattttagaatagaggactctctccgttccaaaataaatcaacttctgaaattcaaatttttgtcccaaaataaatcaacatctaccttcttatctactctcggttcgcaaatcaaaaaattttattccttcaataccccttatctatctacccaccaatactaatttactaataataagggttatttggtcatttatcctctcctttaattttgcattgggatgctaagatttgtcttttttgggacagagggtgtagtccatagaaggattagaatccttctccttatattcctttgcaacactatatcaatgtctcactctccccgtactccaatgtcttacaagcatcagtttggtagcctcgcggccgtagtaaatttaatatacatatataggatcatctgactagatgaaattcattgtgccgctaatggtgatcatcatcaagcgctacatcctcctagctctcatcctctccattcaatgtggtaattatgcatcaagaattcaatctagctacaaaatgcatactaatatatacatgtatgatttgattttgtacttgctcatatatatgtatgatttcgtctaatttggtccaattaatctagttaattaccttgtttaattatcttttgtgtgcattgtaggtggagcaaatggcacctcaagagagtactcaccgttgccaccgttcaaagacgtggtgggcccatcaactccggtcgccgccgacgacgttccgccgccgccgtactgcgtgtaccctcctcctcctaccaagccggctcttccggccccgctgccgccgacgccggcgagccccggcgactcgccgccatcgatcgcgccagctggaaacccaccgacgccggcgcaggccggtgcgccgccgccatcgatcgcgccgggaacgggaagcccgccggcagcaacgacgacgccgtcggcgccgggggcgagggaggccggggtgtggtgcgtggcaaacccgacggtggcgagcgcggtggcgcaaacggcgatggactacgcgtgcgcgtcgggcgcggactgcgacatggtggcggcgcctggggcgccgtgcttcctgccggacacgctcatggcgcacgcctcctacgccttcaacagctactgcagcgcaccaaggtcgccggcggcacgtgcgacttcgccggcgccgccatgctcatcaccaaggatcccagtaagtacgcagccatgtcgatcgtttgcattattgggccaaggccttcttctgctcattaggcccaaggacggcccattcccattttacttgtttatttacttccccctccatttcatgttataaaacatttttcctattcaaacatatttaggttcgaccatgtttataacaacaaataatttcataaatataatattgaatatattttgataataaatttgtttggggttggaaatgccgctatatttttctataaagttggtcaaatttttaaaaaaaaagttgataaaaaaaattcaaatatgaaaaggaaggaatggtagttctgaaaattttctccttttctgcatgaattttattgatgaattttaatgggttttgattattgtcacattgttttgtttcattaatttgtgtaggttatgatgggtgccggtatgtgtacatgtgatgtggtacggatctcttcgggaaatgaagatgttttgcaaggcttttgggcaatcgaatccatgggtctcctgcacaagtatatttaccgaagtaaatatctcatttttgaatggtcggacagtccacagtatcagagtcaaaagcataccactttgtatggtgtattctctgacgtccacattcacaggctagttgttctattaaaaatgtacaaatagatgtgctagactattattaactgtgtcaccattgatccggttgcagtagtacaaaaaaacagcgtattaaaaaacagtgtgttatatcataagaaacttatgggcttaaaaaattgcaaatcttccacggaaagaaagtaactgaatttattaaaaagacaggggcttaaaaaattctaagcaaacggtaaaattcggaagcatcattaatcataaaaatagaagaaattcctacttttaataaagaaagtactatattattacttctgtgtccgtccgagcacacatgtgcagctcacagctcaagaacaacatggtcgatccgtttagcggagggtcgtgctggcacgacctgtctagccaggctgtgcttcagttgctacccgggttgtcatgccaacacaacaagtgcatgtgtgagccagcacgacatgacccaggaatagcgcatagcttggcccgtgcgacacgatgggaccgacggagtaaaggaaaacggaaaaattgaagaagccaagggttcagggaagaggaagcgacggaggatgcttgtcgacatagatctgcacggtagcatcgtggtatggccaacccaattcgtgagcacaactactaagcatagcgatcactatggactcaccagctcggggcgaagaaagtaggaagtgaagggccatggcattgcttgacgatgaggatgaggaatgtgctattaatgagcgggggatctcatttgtgcaacatgtgccgaagtttgtgcaacatgatagaacagactctattcatattttttttcttagtatatgttaaatttgggctaaccggcctcaacacagtccacgtaaactaatcgtgccatgccaactcaacatgacccgacatctcatctcactggaccgtacctgggctctagacccagcacatagggccgacacagcatggctgttcggtcagccgtgcctaatcggacagtgccccaaaggtagctattttttatccaccatctcaaccatataaaaaattaaaataaaaacccgccgtgttaaaggttaatcccaagggcttaatttgaaaaatgggattggaagtgatatatacattgtttctatttttcatatttcgggtacggtggggatgggatgtgcaatttgcaaggaatgggatgcgctaggcgaaattactaaactgccctcgccattttgacgcttctatctcgcccaccggccaccgctgccgtctccatccatcccgcgaggcgccgccgccgactccgcctccgcctccgcctccggcgatccccatccatcacgcgaggcgccgcctccgcctccggcgacccccatccatcacgcgaccgccgcttcgtcggcatcctcccaccgcatccatcctggtgagtgagcacatcctcccgccaccgcagcccgcttgcgccgatccccatccgtcgctcgttctgctccttctgcccgcatccgttacgcacacggcacacctctctacccacgcactttctgtctttcttctccaaatttgcgttagcctctagcttctgttctagagatctgccctcaaccttaatactagtagtagtaacagtttgatggttccccatgttagatccgccactgtagaattttcatcgttttatttttttgctgctcagaagaagatcatcgtcaaaacatgtcgctcatttcgaagctgcggttgatcactgtggatgtcaccggtactctgctgcctacaaagggcagcttggtgattactactgtatggcagctaaggctgctgggaagccatgtcctgactaccagcgaatgcatgagggcttcaagcttgcatacaccgagatggcaaggcaatacccatgctttggatttgcagcgaagatgccgaatatcgactggtggaggatgtgcgtcaaggattcttttgttaaggtgatgccactgttttgtaggtctgaagcttttcaggaactagtgatgtctttgtgttcagaggctaagtgcttcggttgcttgatatgtgctgtcttgtaggctggttatgagtatgacgaggagacatttgagaagattttcaaacggatttactcttcttttggctcgtctgctccgtactcggtattccctgatgcgcagcccttcatgaggtggcttcgcgggaaggggctcacggttggaattgtcagcaacgcagaataccgttacaaagacgtcatcttgcctgctctaggactgaaccaggttcgatattctccgcataacaaattacacctcatgctcctctaatgttatcatcttcacaagtaaatgttgtggttcatgacttctcttgatttttttttaaccagggctccgagtgggactttggggtgttctctggaatagttggtgtgaagaagccagatccaagtatctacaggattgcactggaaatggcgggcaaggtcgcgccagaagaggcgcttcacataggcgacagcatgcgcaaggactacacccctgcacggagcatcggaatgcacgcgctgcttctggaccgattcaagaccgccgatgctgagagctggaggaagtctggagcaactgtgctccctgacctggtagctgctcaggagtggctcagcaagaatctcaaggatgagccagtagcagctgaacaaaatgtctgaccttagaaaattcagttcccctgtcactgagctgaattccctcttgtttcctagttatgaaacgagggaggcaaaagaaatgtgccattgatgtatttgtattgtactgatggaataggttatgtgatggttcttggctgctggattatgtaagctgtttggtgttgaactgttgatgctgattgctgaatatgtcaagcaaatcagtgtggcagagcattgttgtagtctcccatgaactgtgtttcagcgaagaaaactagttttgtttggcatcttcgcctgtctgaagcaataaaagcagggcaatttcagttctgtttgtcattctattccacacctgtctgaaaaaaaagaacaaaaaaaaaagcaaaggcatttgattctgccgctcgtgtttgagataatgtgagaggtttgcagcatttgatcatggtagacaagcaaatctgttaaaaattattcaatcccatattcccattatcagaagacagtttgtttgttttattactgaagcatgcatatcagcatgatgaatgaaccacttaagccaataacagaacggtttaggcattcagaatgataggattctattcatcacaaaacaatcagtaccgattctattcatcactgctatatgcagttccgaaataccaaaagaaccaatgaaacaaaacagcgtggttcttatgctaagatgtacatgaaggtctaggtcaaaccaaagacctgattacactccctgacaattttcagtatatcatcattaagtacatgatacatgtcaccggatgagccatttttatgcgacaagtgtttgacgtcttaacggcctccaggatgtctgttccaggacaagtagttgtgatcacccaatttcctgcaaaaataccgcagataaatatagtagaacgactttcatataccaaatacagcatgtggttgtgtgtaaatacaggtgcatatcaatgcaacatgagtatgatactaactagctgtgccctgtgctgccttagtattttaccctaacaaaatttgcaactaaagagattcttctataaaatctcagtcagcaaaggaacgaaagtatgcatgttcaatatgaacattttagctttgtttctttattttgatacaatgatacaacccagtacagcaatgccacatcactcttaatggcactaatagtcgtaagaatgatatgcaccaaaaaatgatcgacagtagacatgttctcagaaaacataataatccaggaaatgagctttttgcataacacccatgtcatgaatgtagcattccacagcatatgcatctacatagtgaactataatgagaaggttaactgcatggcctacaagcatatcaagtatatagcacatgcatttccatttaattgcagggaacatatgttaccaaccttggttttatgaggtatagcaaggtgaaagcaaatgccaagaaaaagcagacccctccgactataacatacgcaaatcctagaaaatcattcttcccaccaagccaggttgcagtagaaaggaccagctttttcttgccaccaaagttatatgtattgtagttgttactcagcttcacagttatggtatcattcttcttgaggtcaacatatattctcccatacaactttctgaatgtaggaagtgccgcagtccgcatccaaacgataaggtcctcttgctcactcaactgtcacatagaatgcgaactgatatgagttactcatagaaattccaaggctaggcaacttttttatatatctacgtgaataagaactcaaatgaactatagttgatattagcagaaaatcaagatgttaagcatatgtaataaaatgcgtaacagtttgcctccaactacatgcatgtgcaacagcgtgatagcaaagatcaagagttcacatactgggattgccggatcaagtgttcctccacctttgagcaaaccattctgaaagttgcttggatagacatttttgccaaatttgtgctccctatcacttttccaagagatgtccttcttgtctactgtcaagttctcattgccacgagtgaagctatatgtatcattgaacaaactccaagcaatcagcccacaaggaacaatcggttttccatctgccgtggttttctcaggttcacaggcagatgtctggtttgccttcgcagcgtcccttagctgtccatcatttcggctcttcacatatctgaatttggaaagagttatacatactaggtatcaaatgcatgttattgttatcataaggcaaaaagtcataggtttcattgttgccagattggttaggaaggctaagtaatcaaattcttgattgaaaccttgaatagaatcatgtcatacctcctatgattctggtagaaattatcaagttgatagtatacaaaaattggctgattcatatcctctgtaatctggagataaaaacaaaacagttcccatttagccaacaaattttgatacaatgtccacttacaaccacatgctaattaaagttttaaaaaaatgtcccagatatatttagctgcagtgttgctccaactatataccctaatcattcaatatgaggtaactgccagaaaattaagctcattactgtcagagtccttgtgcactctttggatatgtttgggttttggatgtaagcaagcttgttatcagtcatgttggctggcacgcatgcatcatcataccgatcaactatctcaacaacctgcaacagtttcaaacagataaatacagaaacttccagaacatgtcctattgtgtaaaagatacagagcatacattttgtgcagctagcagcgaaacaacaccaactggtacgaagatgacgccgacaaggaaaaacaccgatacaacctaagtagcacaaagccaaaacatcagtgaacggctccgcacatatattcatcttttatcccctaaaactagtaacaccctaaatctattaatccttggaagtatgcaacaagtaattaaacttacccattttggagttagaattggtttacaagccggcagctcctgctgcgtgaacttggaatctgcgcatgaaaaatttacggagtaagaatcagctcacaacctggaaacgctagtcagattcgcttcccctaacacttgatcggcgttttcgacctaaaatgttcgtctatgcaaagaacaaaccaaacaatattagaattgcgcacagctcaatttaatcaaggtttctcctggactattgaaactagctatataatcactagaggtaagtacacccaacataaatcattacctaccatactaatccaaaaagaaaacatgcatgagctagcatccatctcgagagctgagaccccccctaagctagccagattaccaccacctttgcggggtgaaattgcgaaaagaacccaagctactaactactacatggacttcgctctcagcaacagctctgctcatcgcatcctgatcttgcactaaggctagacgagacaagaagcaagcaaagaagagcaaagagagagagagatctcgcgcgctcacacttgggcatcttggtgttcctcctggccgcgccgccaccgccgccgccatccccgtcgaccccggatccgccgttgctcgtgctcccgcccgccgcgtggttgttcatcgcgccaagccgcagccaccaccacccaccacctcctcgaccccacgaccaagaaacctcaagaaccgggcccccggagcccgaggcccgggcaggcgggcctccctcgaggctagcttgccgcgatcttggagcttgctaggattgcaagcaaggaaggggaggatttgacctgtggagagaggggagggaggaggaagacgaagagaggaaaggaagggaggctttgctgtggtggttggcttgggaattgggagttgggattaatttttttttcatatggtcaaaacaggttttattttcactgtctttgttctagaatatttttttcttttcttttttaaggacttttcttataaaggtttaggccctgtttgcaactgataaatatgaggattaagaaagtatacgcaaaaacgaaaaaaaataataacatatgattattgagttttgattattataaatttagaagatgagttgatttgatattgtagagcaacttaatcagaaaataaaaggcctaatactaatatatagtttgtttttcttttttttagagattttttcacagctatcagttagatctattttgttccttttcaagcacttttcttcccatgtttagtactaatgggttttttttaaaaaaaatctttgagatttttcgtagctactatactcatatttacgtagttgctaaaaagttttatgataatatgttaatacctcctcttagaataaaagaggttttagagtttgacacgattgttaagaaattaggtagaattaaatagagagatattgtgattgattaagaagttaagttaggtgaaaaaagtgaatggtggaagagttgttattggttgagaagagaatgttggtggagaagttattgtattttaaaacaaattttaagtgctagaaatagttatattttggaacagactatacctaccataatagcacatatagtccctgtattatggagaaaacgagatagaaggacagtctgtactctgacaaagcaagattatgtgttacaaactatggcagaaatagtgatacggaagtatcatttcaaacaaatctgcacatgtgattttagtcagcacaacaaaaatatgaaaggtactcaaagttcaccttagactaatctggcccttatgacgaactcaatatacggaacatttttggtcatgcatgtgacacctggcaataagatattggtgcttttgtgctgcgcctctaccctctagcctttctagaagatgaacaccgttagtcgttaattaattaatcttctacagttgtagtttgacttgttcatcactctcttgctgataatttatcattatatatggaatcaatgttggtcactcattttcgtacttacggtagaaaaatcaacgaccataaatgatgtatcgtatacgttatctcacatgaccatgacctatagaacattgacacttaatttcaagttaacagtcatcgttatcatcgccgtttaggtttgggtctcgttgaaatttgaaaattcaaatgtcaaggtcaaacaatgtcatcttggaagacaaaataaaatgcgattaattagttgccctcttgtgcatcctgtccgtccaatgccattttccggccatccatcaggtaggagaatattgcgttgacgttgggaagtctttggtgggccccggctgcaggccgcgctgtattgggctgatagtgggctctagtatgggccctgatgggctggatacgtcgtttcagcctgattcgtattatagctaatttttatatattttttacgagggattgcagtttataaaggatgagtttcaccaccatctcgaataaatattgatattataagttgataatggcacaatgcctattggagactctaggatgaaaaataaaaataaaacagagaaagaaaaacaaaagaaactccggttgcgcctaatttttagcaaaatcgtttggttataggttattacatttttggactctgggagcagttagcaggtgctgagtcatatgcctctacaaataaattcggatatcatattattaattatgccattttggaacaccatcaaacaagacagtgtacatatacacacacacatatgcttattgagtgatcatgcaagaggtttattacacctcttaatcataaattatgataccccatagccatagaagatgttcctctaaataagtaatacctaccttcctcccaaaatatagttgctatattttgaagcggaggtaaggctattatcctctggatttttcacatattggtccttttgaaaaacttatttcgtaaatagacccctgaaaaaacttatcccagaaatggtcctttttggggtgccagggtggctggcgccgcgccgtccccctgccgacgtggcggggcgatgctgaggtggctagggggagcacgccaaagtggctggcgccgccctaggaatgagggcgccagcatgactggcgcccccccacccctcacctccattcatgtttctctgtatggagttgcaacgatgttatttttgttttattttttcggatgttttttcacacttaggatcacgatacaaccaaccaccaaaaaaaatttcaactcgaactaccacttagctaagtctaccacttagtctactttgcaccttcactaaaattagaccataacttctttagtaaaaccttttgatcagcatgttaaacataggagagatcctttagtaaattagactatatgaaattacttacttaatctaattcaaaatataaccatataaaatgatagccataagttaaacagtatagagatgcaattttttatttttatttcattttttgatatttttttcacacttaggagaacataggaaccaaccatataaaaaataaactcaaacggacaaaatgtgacttgtagaattttccaaaactcaccgaaacggacaaaatatgtcatttattgaaataggcgtaactttctcatacggactcggaatcaggcaaataatatatccacggacatctacataaaaagttacacccgattctcccttgctttgccaggttcggcgatattaaaacctccaaattccacttgcaagattgtgtttttgaggagagaagtttttcggtagagctttgaaaaattccacaggccacatatttcgtccgtttgagtttattttttatatggttggttattgtaagttcctaagtgtgaaaaaatatcaaaaaaaaataaaaataaaaaagttgcacatctctctcctctgcactagttcggagagagaggagaggagagaaaaaaattctacgggttacatattacgtccatttgagtttattttttctatgtttggttcttatgtatccctaagcgtgaaaaaaatatcaaaaacataaaagaaaaataaaaaattcggggggggggggtggcgccagccattctggcgcgctctccctagtcacctcagcatcgccccgccacgtcggcggttatgggataagtttttttaggggtctatttgcgaaataagtttttcacaagaaccaaaatgtgaaaaatccagatttatcctctcacttccttcctggaggtgagatcttcgcctgctcattggcggcgggccacgtggcaccagatgcgagggcttggtgtgctttctccatcatggaccgcatgtatttctcctgggcctcaaccctcatctggaggtgcttttctgcctgcatgcaaagaaatatattcactttctgggtgtccaaagaaaatgcatatgccaaatataatactcatgatgagttgaaagattattgaaaaaaaagttgtgctagcactagcagggtaaacttcccaagaatgttcctcttgcaagagacatatcatttaattttcagatagaacatgtgagaatttaatggggaacgttcatgcatgtaaagttcagaagcaacatgctattccttccgcaaatatcctcttttttatcaaatcctaataaaattatactacattttatatgctccgatcctaatacatatatctgctacttttataaatgggaggagcaaataatgaacttaaaggggtactaatttattttgagataaatgggaggagcaaataatgaacttaaaggggtactaatttcttatgtgaactagtcatcagtatgcaatgatgaatttaaaaatacatatgctctctcacctcttgttgttcttggctctgggccttcttatctgccccattcacatgcacgttgcggctgtgaagatcgacagaacagaaaattaattttgaaaacatatgaacatgcatggagctagatcgatcagaaagtatagacaaaagaaaattaattttgattgtttggctaaaaagagggtgcattttgaattaatgaacaacaaattaatatagccatggtaaatcaacttactctgaattcgtgcctgaagatggcgctgcattccattgattgtccattgctgaagtactgggaattgaaatggcgatggatcgatcgaatgcacgaagaagatgatgaaataatcagtactctgaccggtgtaataagagatatatataggagtacagtggcgcagttaaagggtttgtctatggtaatattctaaaatcatccctaattatcatcaggtaattaattagcatgatcagaggagccacatatatgttaatttgcatgcgcagatcacgctactaccaaggaaaaccgcttgtaataatacaagggacgagggcgggtgcatttcaggaacaaatatttctttcctgaaaccagaaatattccacctttctagtggatttcaggaaagaaatcgggaccatatataattgcaagtcccatgtactcaaggggatatgaaaacagccagtttttttatacagccaatataattggggtgcatgaaatgggctgattcatacccgccgttatctttactattgtacaacctgctcaccgcccctcctctttattgttattgggcttttaaaaatcaaacataatcgttattttggttctgttttatatttttttaatatcgcgtcaactgccccaccctatcatgttgcctcttctatttattattattgggattttaaaggtcgaacacgattcttgttgggattccccaacatgaattaacatacacgtttctcaaactcttaacaatacgtgatttttgaaaaatttgtacatatatgaatttcttatagtaaatactatttaatttaaatctatttcctaactttataatacttcattcatttatacctcgaataattaatcttaacagctgctgaaaaaaaaatagaacagttgcttgtgtccctgaccatatgatatgatctgaattctgaattgtacactagcacaagcagtgtgaagttcagcaattccaggggcactgtgtatagacattagactgtacatacatatgcagcattgcagaaaggaggcgacgcagaacaaacgaagcttccactctcagcaagaaaaggctgcatgcatcatgctatacagggctcagtcactgatataattggagcaaaattaatccaagctaattaactgtggatatatttgagctagctactttaaattaagccattgcatcgtgattcgggaacagtgcttaattgtgctgttatgcagtgttggtctttctctctccccttctctcccttctttgcttctctatcggtgagaggaagacagagcaccggcgacgagggccagtcccctccacccgccgctccgagctccgccgccccctcctcccgctgccccgaactctgtcctctgctgccccgagctccgccaccccctcagccctaagctcagctcaccaccgtcccgagcgccggtggttgcgggcgccctttgctgccgcccactccgcccgacatcgtcccgagctccgccgcccccttcgtcgctcctgcccgccgccgtcctcaaggtgaggaagcgagaagagtgaggattttggagagaggtagagaggtgaggggtaaaagagagggtgagagactgacatgtggggcccgctgatttaaaaagaaaaaaattgctgactggattgccacgtaaaccaaaaccgtttgtaaagctgctggggggattcatccaatatcgatagttgagggtgaaaattgactggttttcaagtttaggggataattcgtactcatccaatatttcagggggggtaatttatactttttccttttaataatccatagcaacaaacgagtaattttggctagtagttgatcgataaaaggaacgccaataatatataacatttttaagtgcttgggctcattaataatctttttaaatgcctacccccaggccccgagtaataatcatgaaaatttctagaaataatgttaatataatctagatgacatgcaagtatatatatgtttttttttttgcaatgaacggggatatattactcatactcagcacccaacaggtgagagataaaattacaagtatcatccggccggtcagaaagcagttaaagcctcgctacgccctttattagccagggcgtggctaacactattctagttacgatgaatcttcagaataacaatatccctattcccagccatgaggtttcttatctccctaacaaggaaagctaactccgagcgctcctcctcctttgactggattagttggattgcccgtaagcagtcagtctccaggataattggcagtaacgtccattaattggagtgccaggatatatatatgttgactgtacgtagtagctagatacatcagatacatggataggggaactaactaaaatctaacagctaggaacactgctgtattttcggtatcttaggtacgttcttttttctccacttgtaaatccacctttctagaatttcatgaaacgatcgatcaagcacttgcacttaattatatccttaaaatatttacccatgagtaaaaacatgttatcacatgcatgcatgccgtactgtgacacgactccaaatacatatatataagaaaactttcgttaatgttcagacaagcatggatgaattaagacaacacaaaattaaaatttacaaactttaagccaaaattaagaatgtaggcacgactaattatctagatcaccctcctctctcaagaacttaattaattgcatgcatggatgcatcctaattaattgaacgatgcataatgcaatactacttttgtatactctcccaactaataacaagacagttacatatgcttattcagtgatcttgcaagatcagttcagcctgcttgctggtttcaccacaaaattaaacatgcagttaatataattacctcttcaattcatcatcaattagtttacccataggagatgttcctagccttggctccaacaattggactactcatcctctcacttcctacaggtagcactgtttgctgtggaggtggtgatctcatgtcaagcttagagctcatctgaccctcaaaccccttactgcccatggagtctcctcctgacatggtgatggcctccatcatcatcgtcgtcgtcgccggcgccgccatctggagctgatgatcgccggagatcttcgccggctcgccgccgccgtcgtcggcgccgggccacaccattgggctcttcccagtactggagctgtaattgaatgccaagaaggtatcaattgatggcctgatctccatctgctcatgctgctgatgcaggtgatctagatggcttcctccatataactgcagatcatcttgcagagaagggaagctcatggagctgccaatgtcaaggacagcttggctgcctagagatttgtatcctgcgtgccacgtggcgcaatctcctgaggacgagatggcttggtatgctttctccaggatggtctgcatgtatttcccctgggcctcaaccctcatctgaaggtgcttttgcacctgcatgcaaagttagttatattcacttcttttgtgtccaaagaaaatgcatatatgccaaactcatgagtgccacagatgagtataggaaaaaaataaagttgtgctagctaggtaaacttcccaagaatgttcttgcatggatgcatctcattttcagaacatgtgaaggacaaacattgacatataagctgtccacaagcatgtaaacttcccaagaacgttcatgcatgcatgcaaaagttcaaaggcaacatgtgaaggagcatatgcagaataaagcaaagcaaattaataagtaatttcttgggctattaagttcagtatgtgattaatttgacaccatgctgaattacagaaaattaatttgtttctgacaatgctcttaattacctctaattgttcatggaatcttctctgaacttccatcttcatccttagtgcctcattcacatgcacgctgcggctaacaattcatagaaattttgaataataagatagttattaaaaaccacattttgaattaatgaacaacctaatctagctagggtactctatgaaaaaaaaatcaacttactcattcatgcttcttcccatgatgcccgaagaagacgctgcattccgttgcatgtccattgctgcagtgggaaaatggacgaatataagtttgaatataattcaccttttgattatattcagagaaagtgtgaaattaactattctgaaagaatcatggtaagtaaattaagctgtttaaatagctagctagtacaaacgaaacagaaattcactgctaacatatatcaagtcggtaaactttaacaagcggaattaaaggaaggaaaaacatgcatgtgcgaacaaactaacaagctaactagccagctaattataagaacacaattaggaatgtaatatgctattttaacaagtagatcgtgtgtttaccatccttaaccgagtggtcgttgaaatccttgtgctgcttcccaagtctgaatttctgaaaaaacaacaatctacaacacatgagagatccagagatacagaagtctgaatttctgaaaaacaacaatctacaaaacatgagagagagagagagagagagcataagctaaccctagttctaaccatgctagctagtgcaactagaaaaccatatatagacatggatctatatatgtactgcacacacacctgaagatggctcttgagatggtaaagtgtgagtcccttgactcccataaccctcatgatcgtctttggagtcgcctctacaattgatcaagagtttgatcatgaaacatacaagtaatttacaattgatcaagagtttgatcatgaaacatacaagtaattaattaagaagaaccgaactcgaaccaaataaaatcaaatcaaattctcagcatcaagatcagtcatgtatagagcgtagctacgtactgtccgggcctccgagctgggtgacggcgtcgacgaagcggtcatggagctcgacggtccagcggaggcgtggcttggggtcggtggtgaggacgaggccggagtcaccctggacgcacaacggcggccgatcattcgagctcgccgccgccgcggcgccgccgacgccgacgccgccactgagctgctgctgcttcttggaggaggaaggagaaggagaaggagaagaagaagggaacattctattctcctagctagctttcctcctcctcttaagaacctctctctctctctagactcactagatctcctccctctctctctctctctgttacagatttggaagagattcaagaacaaaggaatagggttcgatcctctcgcggcacgcggaacgaggaggggagggggaggaggagagaaaggactacggtgttggtagagaagctgtactgctgctacggcgacgaccacatcacttgatctctcttagcttcttttcttgatgatatgttctcatctctctctctctctacacctctctttgttgctttaggggctttgggtctctctctttctcctttctctctctaggtctcggcgtagaaagcgcgcgcaccgggtgatattctatccgggggggaaagcggccaccgccaactgctagctagctcgaagcctcgccggtctccttgtcctgccgcctcgctttgtaacagaggtgaggagagagaccttgaattatattactccctccgtatcgttaataaaaagtcaacggcgtcatatattaaaatacggagaaagtatttgttagtactacctccttgtacaaatgtatttttgagctaaccaacgtcaaagaaaaaaaatgaagggagtaataattaagctttttttactagctagctagtatagtttttaagtcataattaatcagctttgaccttaaatgtttgtgtactaatgaaacataaaaactcctatatgacgcttaatatatatatatattaccaattattatgctgcgttcggcagcaacacaaggagaggaaaacttttatttattttttttaaaaaaaaggaagtctcaccatgttttttaaaaacaaagagaagaaactgttgtgtttttattaagaaaaatctatagaaaaattgtttcaaaagtcatatttatctgtttttcagttagaaataattaatacgtaattaattaatcatacgctaatgactcactatttttttcttaatattctctttttttctcctcaaacacaccctcagagcgccggtgcatatatacgtatcctcgaaaatattaaattagtttttcctgcatttattaagtttttttaaaaaaatcaaacaatatttgttaccatagggtgtataacttataaagattgttagataagtaaatcatatattgttgaattctcgattctagcaggtatacttcacccaatttgcaaaggtttatccattaataagcaggggtgaaaacggatcgagttcggtcagatctcaaccttttcatatcctaacccacattttataatcggaatcgggtcggacaaggatagtgtcaaatacggatacaaactcgtataatgtcgggcaaaaatatggaacaaatacgtaccaaaatagatacacacactattggttacgaatatttattcggatatcaagtcgaagcaacaaccttatatatcacatagacaataaccatttaacaattccatatatccataatacaattatattaggccattaggaacttaggaaataaatagggtataatacatcatagcagaaccaatacatagtaccaaaaaatgcctcacaaaaacataatataggtaatatccgtataattatccgggtaaaacccgaattttttaccggataatccgtatccatcggatactatatttccgaacccgatcttatatccgcaaaaaagacatgtattcggacctgatatccgtgaaaagtctcgggtacccgaatttgtcccgaaataatgtggccgggcaggagggcgggaaatacccgccccattttcacccctattaataagaagcattattaattccacatgcattgttcatctatcaatatatatattcttattgctatgctatgagaaggatttttttacctacttaattaattaccaggagatacaacatactccacattcttatgtcctccggttacacgaattaacactaaaattgtcgacctaattaagctgaattatgcgcgccaacagagaagctagattagtggaaacaagagatgacttcgtcttttatcactagtgcatccaatcatcatatcgttatatatatgtgggtcaaactctataatatatatgcatatatctagacacatcatgcaattagtcatggaaaaaggagtgtactcaaaaaacaccatcatatccaaatgatggcttgcagattgtgagggaattaaaaagacatgcatttgcattgagccccgtgggaatggttggttgcccaagtaaacatcacaacatatacactgaaaaaaaaaccctaangtatatagtgtgcattgggaccaaatcaccacaccagtcacggcagctttagttttaagtttggttggntnctacaaccataaacccattaattgcatctgtggcacttaattttttttaagaactggctagctagatattcactggtgcatataaattgatagtaatatactccatattggtaaatcaaacaaattaattgttgtcaagaattgatcaggttcatgcatgattagttgactgaaccaaatagcaaattgatattgaacttgttggtagctaaattagtttatttccatcaatttcaatttttccttttgtatgttacatatatataatgctggaactgctagctactctttttctacttaaaagatgaataggtgaatgcacactctccttgatcttctaaacagtgtgttttttcagaaagaaaaaaataaagaactttctatacataaatttcatttctgtttttttttggcacactagtatgatttgttcaaagcaaattaatgtgatgaacaaattgtctacaggtattgatgccacaaagggtcaaaaaagtgagcagcttacaatcaatctcactgagagtagtctccctttagtacaatagaagattgtctcccatacatgcacacgtcactaagcatgcatcccattatgacacatacaaatccaaacaaaaaaaatggtggtcaaaattgtggcttgaggggcccatttgggagaggatgagtgagaacattataaagcaattaagctctagctcaatcgttcctagcttactcttccatgagggggatggacaagccgttttctttacacgagagggaatagatgctttcttctttgacaattaagcaaagattcctagatagcttccaatgaaacacccattttggttttgatttctagtgcttattaatataaaatttataggttagtgctgcataaacaaccataaaatcaacagattaaacaaaaggacagtttgtagtacttactcattttcataatatatattaaaaaagtcatttaagtcttaagttatgttattgtaaataactcttaacttgtgttcagtcagactcgaatattatatatgcacgttaaacttaaaaaaactaatcattttgcaccatgaacttttcaatctagagtaatattaattagcatagttgatgagacttcagaataacctagtcatttccgatatatagcaccaaactctagattcacaatgcacagaaagacgtacaattaatgaataaagaagcaaataacgaagggaactagggaagcaatgatacatatgatcgatgatgtgatggtggatcacactgtatatattctcgcgttgcaaacgcacaccataatagaatgtatatatttataagtaaaatttagttcatttaattgaaatagggtggctaagcaatgatatatatgatcgatgatgtgatggtggatcacgctgtatatattctcgcgttgcaaacgcacatcataatagaatgtatatatttataagtaagggcgtgttcagattgtagttaaaataaaccttaccaagttttggcaatgccaaaagtttagcaaaattttgacaagatagtaatcttggtaaaattttgccaggatttcttatgtattgatcaaatttagcaacaaactaattaaatatatatattttttaacaactttataaaaaaatgacatggttgaaaatggcatcaaagtgaacagacgctaaaatttagttcgattaattgaaatagggaggctaagcagtacttgacttgacttgttcaagtagctcgcgaatttgcggagcttgataagcaacgagaggagtaagtgagattcgatatatatgtatacatatatatacatatatatgtatatatatatatacatacatatatatgtatatgtatatgtatgtatatatatatatatatatatatatatatatatatatatatatatatatatatatatacgcatgtacgtatatatatata

SEQ ID NO: 25260 - DNA, 6994 bp, Oryza sativa
atgtatatgtatgaatgtatgtatatgtatgtatgtatgtatgtatatgtatgtatgtatgtatgtatgtatgtatgtatgtatgtatgtatgtatgtatgtatgtatgtatgtatatacatatatatatatatgtatatggggatatatatatatatatatatatgtatatgtatgtatgtatgtatgtatatatatgtatgtatgtatatatatatgtatgtatgtatgtatgtatgtatgtatgtatgtatgtatgtatgtatgtatgtatgaaaataatccacgtgcagcgagcaaccagctgcaagcaggcgcgcgcatacgtacttaaatatcaacctttataaagttggtccttaacttttagctctcattaaactaagaaaatcgctgtcaccagttactatggatggtagcttgagtttcaagcacacatttgagatgctgtcccatgagacatgacatgtgaaatgtttgcatgtggatcaccctagctaggattaatgagttttctcttgcccgaattaaagcgtacacgtactactatcgctttccaaagcgattttttgtaggcacctatttattattattatttttactggcagattattaaaaatcagtttgcaataataccaatgagctcctataatctcgtgctaaagagcatcgcctgtaaaaaaatgttgccaccttaaaagtgtgagtcacctcgatcggcttcttcgactagcctcaatattggctaagtccctatagcctctgttccctcaatactccttccagccactctacctcaccatcaccacccttcttgccaaaagcagctgatcaagattgagggtccttatcgttgggggcaacaaagaggagggacgaatctaggcagcgaggatggagacagatatcctcaccgtcctccccagcccaccttcacactcttcctctactcctcgccgaggagagaggaggcatatctaggcaagcacaaaggagaggggcgatggcaagcggagtggcaggggcgaagcaaatatggactgccagatccatgacaacagagatgagtcagcgatagcaacaagggaaggggtgcatggtgaagagcggcagtaaaggaggcggacctaggcggcgagagatgatcagattaatttgggctaccagattcatggctcggcagtggcctggtgacaacggttctgggataagggcggtggtacgaagaggaggggcgtaaggtggagggcggcagtggaatgtgagtcgaggtggtgacgacaaccgctcctagatctagtacagtggctccacaacgacgaccatgactagggatgcgacaacgatctcgacctcaatcatgacctgttggcttctagtgacgacgatcgcgatcgctaccagctacgacgtaggcggcaagcgctattttttcccctgaaaaattatcttcatatgtgggtgtcatagtgactcgcttgcaaaaatcaatgatttttacattcatttggttagatacgggccgtccgtatggaaaaattatttcctagtggagtatatatgattaatagatatatgttagctttatcagtgatgggtagtacgctttctctgtcatgaaatgattaagaccacaaagatcttctcctgcttgccaatcttataaaatatatgtaatgctttacgtggcccattaagtagcaactttaataagtacgtaatcatggttacccaatatttgatgtttagattaatgtctgaacacgtatgaacaaaacgggtacacgcacacactcgagttctttcggccgtcggcaaaatgtccctttgcaaaaccgcccagattatactactactatagtcctagaccatacagatgatttggaaggaaatccactaaagtgagcaccaatcaacatatttttgcatttatcggtctagcttctctcgtgttagaaaaaaaaaaaaaaccaacgtcacgactgctgggtgcgcatcaaaattaaactttggatctaaaataaaagctattaccgataagtcatccgtaatggtctcaagacgataccaataaaaggtgaccatcacatttttttggtttatagtacgttaccatgtatcacggatgacttatcttcaggctttgatttgacttctttgttgggttaaaattattagtgatggtcttttatatcggcctgagacaaatcactgttatcggtgaccaattatccataacgcggcctgtcggcgatgcagatgaaggttcccgtccgacacagatattttttttccacactagtgtctagttctgtctcgagttagcacttcatggccgaggtgccttgcctctctaggttggattcatcatcatcttcttcttattttttcaagaatggcaacaaaagtgtgtatcatgctagctaggccaatcaactttggacgtatacacgcgactgcattggcagtggcactttcattcgtttgtttttctcttgtgtgctttggcggcgttgagaggtgtgttgctttggcttctttgcgtttgtgtgcttttctctctctctctctctcttgttcttttttaccacacgtaccactttcttgaccttctttgagccatatgcgtgagatgaggtgctgcactttcgatccatctgaccatcgatctctcgaggagggacggcaggttggttgtgttgagtgtcgggtgcatgcagtctaggactgtctgcactgggtatctatagcacccatctccatacctatgtccttatggatagggagaaaaatatctattttaattttggataaagaagcgagggtaatacctattgttatccgggaacatatcctatgcacacaagccccacgtgtacagtgtacacactgcacataccaattaacaaatgccacaaaaaaatctataaaagtacgttcatacatgtattttcaattgtatatctacgtgtaaagtcgtaccttcaaattcattttacatagagataaaaaaaagcaaaatttttgatagaaaccttaaaactgtgattttttttgttacggctaaaatataatcaatttgaggttaatattttacgcgtaggagtaatactattggaagtacgtctacgcagtttctagattttttttatgatatttgttatttggtatgcacgatgtatacacgtaaagatttgtgtgcacatgatatgttcccatcattacacactttatccataccattttacgtgtgtaaagctcgaatccaaaattttaaaactcgtgttcacattataaaaacgtttcaaattgggttgaattcgtagaaatgatttattgtatatagaagcactttttgcaagttttagaccatttctatatagagcccacatataaattacctatacccattggataattttcatacccaataggtatgggaaagctaattataaaatagatatgggttacccataccctccccagtgacatctaaaactccaatttaaactcgatgaaaagatgaggaatgtaaagtagacttattccgttgaaaaatggccgcttgaagctgatgcggcccgtgtcacaggcggcagcagatgccgatcgagaccgagcaggagaagcccatctgtcccgtttgtttcgtgctgaacgctcgcgtcgcgtagcgtgcgatgaggccgtggaagtggaactgggcttgaatcaaggacaccaccgttgcaggcctcgctgatatgggtttagttcgcaggcccacataaaataggcaaaacctctttctttttcccagacaacaaaatgctcttttgcactaataaataacggaagcatgaaattacatttcaaattgctagttttaattaaaaaaacaaaaacccttcaaattgcgcttgcaaagccaccgatataaaacgtgtttgaagaaaaggtttgggaaccctttacgtgaacaaaaaaaaaactcattagagcatgtttaattaagtattagctaaaaactttaaaaattaattaatatgaatttttctgaagcaacatttttatagatttaaaaaaagacgcaccatttagctgtttgggaagcttgcacgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacgatggcggtggcaaacgatgaagacaatgattgtctcgttagggggattgcgagcgggaaaccatggtggcgaggaggtgcgcagcggcaaagttccacttgatctgcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagttttttttaccataatttattttcttctttggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcctggctaattttgactcggtctcgatctgacgtggtatgacgtggcccttacgtggcaatttgacccgggaaaataataaaccccgtgggacccacatgtcagtttcacacacaataaaaataataatataataatggtgggacccacgcggaccccacatgtcagtctaattaacccctcctcttctgcttcctctctctcctcctcccctctcttcgtctctctcttgcgctgggtcattctgattctcctcttcaccatcttctctgtcttcatctctctcccctctcctctttctcttctctccggttcacgggcgccggaagaggacggtgtccggctgggagaaggggcgcggcgcggcggccggtgggagggaaactagcggagagaaaggaaccagcccggcggcggagccagcgcgccgcgcccgtggctgcggacgatgttgacgtcgacctcggcatcctcggcggcgggatgaacgtgtcccgccgaccggccgacacacgcgcgcatcctagaaggcggccgtccacgtgggcgggtgagggggccacctcgccggcggaagagggaagaggcggccgactgcgaagacgaccccagtgatgatgacgaccgtgcggcgcacggcggaggccgatcccgtgagcaggaagctcttcgtccacggcctcggctggggcaccaaagccgacgacctccgctccgcgtttatgtgcctaatcatacaaaggtaaaagcaatagcgactagtactagctgactagagtatattttgcttcgtcatcatcatttgcttgtgttatgacggggttgatgaatgaatgaatgatcattgttttaggcaagaaaacactgttccggccggactgacgaggaacccatatcgatccgctcgccgcggcccatggaaacccaacaggagatggcggcgctaccttccgccgccggcgactactaatggtgggtgatgctcgagcacattgacgaactctaggtcgacgacaaggatccaactacaacttctgctccaccgctgcggacgacaccgccaatcccgtgagtccatgacgacctcgctcacctccgacggccacgtcggaagagtctacttccgcctcaaagcgcccccagcgacgtcacacctatgcccc

SEQ ID NO: 25261 - DNA, 2990 bp, Oryza sativa
  unsure (1)..(2990): unsure at all n locations
cgaaaatcggattcgttgacaagttaaggaaccttagatgaacttattcccaagaacaatcggtacgatccaacggcccagaaaccaccgcatcgcaccggaccagcccaaccatttcgtcgagcacctaacgcacgcgctcccctccaagccctaaacccattccccaccaccatgcgagccatcggcgccgccgccgccgccgcgaggcggcacgcgcacctccccaccttctactccgccgccttctcctccttctccggcatcggcggcggcgccgggcgcgggcgtgggcgcggcctcccgccctccgggacgccgccgcgcgcccccggtagccccgtcccggacgacgacgacggcggcggcgcggatcccttctcctccccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggccgccgaggcctcgttctccgagccaccggcaccgccgccggcgcgcacgctcccttccgctggcgctggccgcggcgtgccgcggatgcaccagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacgacgatggcgggcgtggcggcaggggtcgtggtgcccgtggtagggagcgcgggcgcggcagggaacgtgatggcggccgcggccgccgctctgctgatatggaggagaagcatgggatctacttgggggacaatgccgatggcgacagactccagaagcggctcggcgaggacaagatgaagatttttaacgaagcgtttgatgaggccgcagataacgcgctgccagacccgaagcaggatgcatatctggaggcttgtcacaccaataacatggtctgtgcagcaatgcggttgaatccgcaaaattgttagagttgttagatctggccgttcatgcaaggttcctgaattatttgtttcctgtgggtttatgtatgcagatcgagtttgagccagagtatcatgtgaatttcaataatccagatatcgaagagaagccacctatgtcattggaggatatgctacagaaggtgaagccattcatagttgcgtatgagggcatccagaaccaggaggaatgggaggtgatttctttgatggaccttgtactatattatttttctccacagaaatgtttgtgcgagtagatgttttggtacatatgttctcttgcagcattgaggaaccagattgcattagaaaatgccggagaaagcctgcataaatagtgtaaatgatactttgtttttccagcaataggattatagcatgctcaacgggtgcaacgctgcaagtctatagttggatggcattagaatcctagctgcattatcaagttttcataaataaactgatgaactcgagcatgttaatagacttgttccctgtttggaataatcattcagcctgattgaggcttcagaaataattctaatgagtttgcagatgcatattgctgtggtacgtaagtatgttcacagccagattggcctagctttgcactgatatacctagatcgggctgaaaatgatattagtagattttgtgttgtttcacctttcagaacatgttatttggtaagctgatttatgcattacaaatggagcggatataaggtttatacaaaggatttattatctttgttgcatgaacgctgtccagctgattacttagtaattgtgcctgctcctttctgatgaggttaaactgtaatctccagataagtttcaacttgttctaaaatccaagtaaagagggactgttggctacgttagattagagattttaacaggattgggtcattctagcttttatgtatttcctgcagtcctggacttattgaactaaaagaatatctattattccgcttccatgtttctgctaatcagctttaagtccctgtttggaaattcctgtatgacaccacattagacacttgtctcataggcttctactattacatgaaccagtacatgcttgaacttgcagctgtattcgccttgctgctaaaatgagtttttttttttttggtgatgtatacaactgacccagtataatgtaccgtatcactaataggaagctgtgaaagatgtaatggcaagggcaccccatatgaaggagctgatagatatgtacagtggccctgatgttgtaactgcaaagcaacaagaagaagagctgcaaagagtggccaacactctcccaggaaatataccctcttcagtaaagcggtttactgataaaactctactgtctcttaaggtttgttttcttgttataattgatgctctgaacagtatacacatttttatagagaacattattcataatattaatggtctgatatttgaatgttgtcatctttataattcaacttctgatttctgaatctccagtggtgatagaataacacaattcctgtctaattttctaacttgatagacatgtgaaattatagtatcaccctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25262 - DNA, 380 bp, Oryza sativa
atattgccagtatggcctttaatgagccgctgatgcttgaacccgcctatgcgcgggttttcttttgcgcgctggctggccagttgggcatcacccggctgacagataccgtctctggcatcacgcttgatgccggacaaatagccgaaccgctggcgctgtttggtgaggatgatgacatggatccccgtccatcacgcagctatcaggtggcaaatggtatcgcggtcttgccggtttccggcacgctggtcagtaaaacccgtgcgcttcagccttattccgggatgacgggttacaacgggatcattgctcgcctgcagcaggcaatcagtgaccccggcgttgacggcattcttctggatatggatacgccgggt

SEQ ID NO: 25263 - DNA, 583 bp, Oryza sativa
  unsure (1)..(583): unsure at all n locations
tagggcgaattcgagctcggtacccaaaaaataaaaaagaaaacatgcacacatacatagtagaatcgaaaagaaatactaacaagaaaaaatcatcgatgttggcacatatttgttgtcaacagcctttaatctatgattttaagatcttcctccccaatctaatattatagtcccggtgtagatagaaatttctttatggtctaattccgagtggtagtaaataccatgagttagcaatattttcattgataataatttggtatattccatttattataaaggttgctaaggaattcctatcaattatagggatgcttccaatagaaatggtttgcttatgcacatcgaaaccaaaaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25264 - DNA, 1324 bp, Oryza sativa
  unsure (1)..(1324): unsure at all n locations
nnnnnnnnnnnnnnnnnnnnnnnnnnnnnnnnnnnnnnnnnnnnnnnnnnnnnnnnntatgggctgacctcttcttcctcctcctgtcacgccgccctgtctgagcagcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaagagtggacggacgcgggtggcaagttcattagccaaccccgtgtctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccagaaccttgggggccaacggacgttccgaaggctcgccacaaatgctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcgaaggcgctgacgaaggagtggcggccgaatggcgagcaacagccgccgctcgccgcgccctccgccttgacgacacggagccggtggtagcagcgcgagaggtcttggtggcggaggaccgcccaccatcacctaggcgctgccgtgccgtcatgaccaagttggccacgtcgtccagccaacgttgggctggagactccgggtcagggacaacgggcgggtgacgtaggagcacgcccgcatcttggagcgcgccctggggcgtgctgccgtcgccgtagacgaggaggcgacactccccatctcgccgcccttccccatcacccgtggacgtcgaagtcgcggatccttctaccctttcgagcgcctcctcccggctaagaccttggcgtggagggggcnnnnnnnnnnnnnnnnnnnnnnnnnnnnnnnnnnnnnnnnnnnnnnnnnnnnnnnnntactc

SEQ ID NO: 25265 - DNA, 639 bp, Oryza sativa
  unsure (1)..(639): unsure at all n locations
tgcatcccacacatcatacaccgggacatgaagtcgagcaatgtgcttcttgacaacaacctcgatgcccgtgtatcggatttcgggatggcaaggctgatgaatgcgcttgatacgcatctgagtgtgagcacacttgcaggtacacctgggtatgtgccacctgagtactaccaaagcttcaggtgcacgaccaaaggcgacgtctacagctatggtgttgtgctcttggagctcctctcaggtaagaagccaattgatccgactgagtttggagacaacaaccttgttggttgggtgaagcagatggttaaagagaacagaagcagtgagatctttgatcctacattgactgatagaaaatcaggggaagcagagctctatcagtacctgaagattgcatgcgagtgcttggatgatcgacccaaccgaaggccaaccatgattcaggtcatggcaatgttcaaaagctgcagcttgactcggacagtgatatcctcgatggcttttcgatcaattcgtcaactatagatgagtcaggagagaaatcaatgtaatgctgtctagttcttgcagattttgattatccgaagtnnnnnnnnnnnnnnnnnnnnnnnnnnnnnnnnnnnnnnnnnnnnn

SEQ ID NO: 25266 - DNA, 4149 bp, Oryza sativa
gtgagcacacttgcaggtccacctgggtatgtgccacttgagtactaccaaagcttcaggtgcacgacaaaaggcgacgtctacagctatggtgttgtgctcttgaagctcctctcaggtaagaagccaattgatccgactgagtttggagacaacaaccttgttggttgggtgaagcagatggttaaagagaacagaagcagtgagatctttgatcctacattgactgatagaaaatcaggggaagcagagctctatcagtacctgaagattgcatgcgagtgcttggatgatcgacccaaccgaaggccaaccatgattcaggtcatggcaatgttcaaagagctgcagcttgactcggacagtgatatcctcgatggcttttcgatcaattcgtcaactatagatgagtcaggagagaaatcaatgtaatgctgtctagttcttgcagattttgattatccgaagtggtaaaatatcagactagctcaaccattttggctccatggtagaaaaaaaggtagtatcctccaattcagtaggaaaagttgtaattttggttcaaatcactgtacataatacatcaaagtatgaaggagaacacggtggtaggatttaatttcagaaaaaaaaggcagttctctttacctggagagactagtatgtaccaatcaaatttcttgcttttgagcatcaatattgtcaagaatgtaatacatattagctttccttacacttgcatgtgttttgactttgtgaaaattgagcttcttgtatctgtcagtttctggttgatatcttgcagaaaagaactggacaaaagagaatttctgatgtttaatcttctggcaagtccctttcccctttttgtattgcacagttgactaaaactgcaattgtatttattatttcccagcatggctatgtttgtttgaccaaactgtaaaagatgttgccgatgttgccagttaccacatcatatttgcttaggggtgttagacaatggcttaggggtgtaagacaatgtgtgaaaaaaaatccagccactggattttgtgggcagtcagtacctgaatcatgttgatagtacaggggttttccttgtctgcttcttgaatgattgctgtcatgacaaaactgtacagcataaagaagttttcagttctgctgacactgtctgaaatggatcttgtggacatggcagtacactttcccaacaggtagttatggacaaactgagcagcacaaagataatgcatggattatgtactctttttcttttttcttcttttagaaaaatgagaagattacatgaattttgctctcattctgtgtttgtgataatattaccagcttgggagatcagttctgtttttgaaactttagtagatgctacatatatatacttgcaacttgctattcttttaaagtcaggtaagaagatttttttactcttgcctttttatgctgtgagtgtgatggaaatgtagtttatactgtcaacatggtcatacctgctgaagtttggaagcatctgtgtgcccaaaaagaaaaggaaaggtgcatctttcattcattcatacctgaagcactccctctttttccacccaggaacattcgcttttctgctgtcaaaagtggtgcaatttcggttggatttatactctttctgactttgaaaaatactcatgttgctcactgactacctctgattgtagattaggaccaaatggtactactgtcttgataaacttatattatctttgatgtggtcgtgccgttttcgagtgtataactttatccatcagggtttaaatactggcgagcgtaattaaatgcattagaaattattactttcattattaaaattaagctagtatttttttcccagtaatcattatttttctttgcctgactaattaattttccaagagagattagatgagcaagcaaggtaccaacgctatcacatcatcacaaatattttcaaaaggatttggtaattaggtagctgacctgcacagcaggataagaagatgttgcacgcgtgcgtacgcccgcacgtgtgcatgccgctgccgttggattctaaaattagggctccgtttctgctgatttgtacaggattaggcaggaggattacgactttagggacaacgactaccctttagttttcatcttctttgggggtcccctgtatatatatatgggttcagatcctttgtggttatggtcttgtgttgtgtatccgcataatttcgatgaggtaaaattgtctactagacattctagatttattttagataatggacatcatcctggcctctacactccaaccggacactgtggtattgtgagggatgtcacagtgagagtcattacgatccgatgttattttgacggatcatagtattgttggttaaacgccatttttttttagatccgcaatgtctagtagtcaattttttttgtctaccaacgatagcactgttgatatagttgtaggtatatggctctacatggtatctatattcacgcacataattattattctaaaaggaatttagtgaggttcttcgatttattgatgcctcaatctcttaaccatgtgttaataggaacactcacaggtgtgtcagtgcggtttacatgtgtggtgctgtaggtacattttccatgtagttgaattattttgcgtagtgttgggaaaaatatatagaggctatttatgttttgtcggcaaaaatgagcagtaatggtcggcaaaaaatacagcaagatgctaatgcggtgcttactctggcacaaacaattccccttaataatggtcccttggattggcgtcccgtttgcacttttgatgtcatcaactctttgcatctcacaaaggggatctctttgcacactaccccttaattttggtggctgtgtggaaaaggtagagctaatcacctaattagatgacctggttgttgttgttgcaaaaatggtcaaacataatttgcgtgttcctttgggttttggatcttttttagctgagagatcagagatggagaaatttttgtagttaggtagaagtatgatgtatattttttttcagaaacaaagacaacttcagatagtgatataggaatcttatcttattaacatgaagtaaaactgtttagtaaaagtagaggtcatatgtgttcaacaacaacaaaaaaagatcaatgaaaatgaaataataagataaatttgaactccaccctgatgctgaactagcaatgtttatgtgattgtccattcatttcttcataggatgcttgaaaccatcatgatgaacagttgattaaaaaaaaataattatgtgtatttacatggtagacaaagaggagtgccatggaaggggaatgaattattgctacacaaggagtggctcaactggtgccaatgactgctgctctgcagcctggcaatcccatctgtagacagctacaggtgccagtataatcatcttgcaggccaggagtatatatacatatactactacaggtatatatacaaatgtcacagcctttttcccctacatagtggctacaggtataccaaataaaggactcaacattgtttatttataaacaaaggggagagaggaagaaagagtttagccttcaaagctccatcgtttgcttgtggactccacaattaaaattcgaattttcaaacttgactttcatgttttttatcgtagtttatttttcaggctttaaatctctaggaatacgcatatataaaagttttactcataaattatttttagttgcttcatttattattccagcaaacaatgggacacaattcaccttaaatccttaaattgtatattgtgaagtcttaactgatctctagtctaatcttcttttcctcttgtgctatcacattcgtacttgctgacaagctatgtgtatcaggtattgatgtactgaagaactgataagaccaaacaggctggtaggtcatcactgcaaaaattgtctgttcctcacaaagaaaggaagtgcaggcagtggctttctacttcttctgcagaagaaagctaagagaggcttgacaccaaaaagcagctctgtacaagagtcaagaagcatgggcacacacatctttaga

SEQ ID NO: 25267 - DNA, 5334 bp, Oryza sativa
ttctacttcttctgcagaagagagctaagagaggcttgacaccaaaaagcagctctgtacaagagtcaagaagcatgggcacacacatctttagatctcactaccaccatggcaggcactgtcacctatcaatgaggtttgccaaatatcagcaaggctgcagactgacaagcatagtcagcaataaatcagtgccaattggctaattgtcataccttctcatgatctcatctaagcagtggttgcaatatgcatttttagataatgagaatgtattacatctccggcctctgccataaggcacacagccaacgaggttgcaaatacggatggactgaagaaagttcaatatacatgccagatgatgacaaaggaacacattatatttgttaatggagttcagctgaaacatacgtcttcggccttgattatattatgtgcacagttcaattactgtcttacttgagccaagagcaagagatggcttgatttggatccaatggtgcttgataatacacatataacatacttcctctgttttacaatgtaagtcattctagcatttcctatattcatattgatgttaatgaatctagacatatgaatgtgagaataatatatatctagattcattaacatcaatatgaatgtgagaaatgctaaaatgacttacattgtgaaacagagggagtacaagcctgttgattctgaaaataacagtaaaggcatcagatagaaatggaccaaaccaccacaaaattatgaaaaatatgtgttgatgcatacaagtctgactggcttcttgacaaggttacaataatcacaaatgacatgatcacgcacgctcttcagggtataaaccaaagtgtgaatcaacatgggatttacagatgatgcaattttgacagtactgtacagaaacgggcaattagttcagagagacataaccatcttggatcttaacatgacagtcaaccaactagactcgatttcttgcaaggtgcaacgttgtcaagaatgatagctgctaacccattgcgtatttctgggtccaggccctcgccgtctcctcataacgtggcctctggctcttgtagacgtgggcgatctctgggacaaggggatcatctgggttggggtcagtgagaagagagctgatggataggaggacctttgatatggtcaatgctgggctccactgctccttgaggatgtcaaggcaaatgcttccattggagttgatgtttgggtgatacacctgcatcgtcagtgaaacgattcatcatttatggcattagtggagaaaaatgacaaatatcactaacttcagaataatttatcaaatcatctaggcttttacgccagcgtcataacaatctagtaactagctaggtgaattaatacaatgtgtcttgcttgaatctttcctgatatttagaataggatagcaatacaactgttcttttctgatatatcggaaagattactgcaaactgttagcacatattgttatcaattctttgttcaactcattccttgaagagattatgatagtggggccacactctagggaaccaacatgatttcagttacatctgggaatggcagtgaatcattgctgagcgcagacagattggaactatcaaatataaactccatattgtccattccaatttgtgaagaagctatatagccttactggttacaatttttgatgattttaatttgggactcacctggagaaacatcgctacatggcatttccgaagcatgtaacaaagcatgcaattgaatgagaatttcagtctgcaacagcctttgcccaagtaatttgtcagaagtgcaatactaccagctcaagcttagagtcgcattatagttaggcagagcatttttcttatgtttttcccctgcttttcccctgttttctgttttgtcaaccttatacttattttcctaaccccattatcttaatgaaattatgcaagggatctcctgctatctgggacacaaagtgataatcacagtagcaatgtgacagtaagaactgcaaataatgattataaacagtcagtatgattttaactatgaaaacaatgatgctacggagaggcataaattttagccaatttgtggtgaactgtgctttagaatttacaccagtacataactttttactgatattgactgatttataaattctcctattcatcttgaatttccaaagaccgcactctaccttatctagtacatatcaataataaggttaagagtaacaatttaatataatcaagaagttaaaaaaacaagaaagagagacaggtaaaacaaacaactcacctttgtttggaagttcacttttggaggcttaaaagggtagtcaggggggaaatggatgttaacaaagaacaccccaccagcgtaggggctgtcgctagggcccatgattgtggcctgccaatggaataaatcctctcctgcaggcccagcactgcatgatgttggtggatccttccgcaaatccatgagttccttctgaatccttttgcttgccatatctgggtaagtggaacacagaatataatgattaaggcaataatgcacaccaatatgaatatattgcaccttctttcagcttgaatttgataagatggatctcctcatacaaaattttcagaagtactgaattatagtttcagaatctggatatgactactaagtaattactacagtctatgtactcaagagaaattccttgttgtctgcatagcatgggtctcaactctcactaaaagtttgtaggagttcactcaatttttgtatgccactttattctttttgtcgcttaatattaataaacagatcacaatgccatattatataagatgacacaaacaacagactacaaccagatggaatagtcaagtgaagcacaagctgattacttcagtatccaagtaggttgcatccatagtgctatcatcatacagcttagcaaaacaatttcttgattaaggttatcaaaacacagagttataattaacttactcagattacaaactacactgatataggttaagtaaaattttcaaatcattgacatatttgtgttgattgacattcttcagtaaaacgcccaccggcgtcccacaacctgtctgtttcaccaagaaaccaaaaccaccaacttgcctaaaattaaaatcaccttccctcctttccccaagtagcaaatccaatttcacatttcctgtttaagaatctactcgattgtgacagatcactggtcagagcaaggccctacagctcaaacaccaaactcatctgaaatttcagcagaaggaatgcgcaattaattctttctcctcgttcatccccaagtcaaccccgaccccaagatgaccaaatctttctaatcttgcgatggctacacaaccccaagtaatcttaagcaaacaagctacttctattcaatcatggcgtgcgtcgccaagaactcaaccaacgttcaaaacgaagaaaaaaaaagagaactaaacagaacaagaactagtacactttgaatggaccaggaaagatttggaaagaaactgaagattacctgcagactagagagctcagattagatgtatcctcaatcgggtgaagagatttggaaggaatcggctgcggcgacgatcgatggagcgtgggggattacgggatgggggcttaatcgtgggcttgtaggcctgagagaccctggatcgagtcttcgcttgtgtgcagttggccaactggtaattcttttttccttttttttctagtggaattgcactttgcgccccttttctcaccttaattgcatattggaccagggtctgctaaactttgcacttaatttctgttgttagatcaaatcaatcaagagaaatttgttgccattgcccattttacatttttcccctccaaatcgatattactgtagtaacatatactcaggccttgtttagttcgcggaaagaaaatttttatgttacatcggatgtttgaccggatattggaaggggttttcgaatacgaatgaacaaactaatttcataacttgcatggaaaccgtgagacgaatttattaagcgtaattaatccatcattagcacatgtgtgttactgtagcacttatggctaatgatgaacttattagtttttcattttatttatatttaatactatatagatatgtctaagatgtttgatgtgacgtttttggaaaaaaaaatttaggacctaaacaagggcctcaatgttggttcaaaaccagcagcaaggaccagttatgaatctttgacatcctctcagggtcgatgctatcttcgtaacattgtatatttaactttttatctttaaaacattgtcatcgcagtgatgggtactcatcgctggttcaaaacccagtattaaaaccagttataaatcgtcagcaattgttggttcaataccggccgataactcatcttccatagatttggactgaaatgtctgaaatccagagaatttcatccattttagtgaggtccgagacaaaatttaaatcccattttgtaaattttggtcaaatttcatttggaatttccaatttttgtccatttcagcggagccgaaatttttacgcaatcccatcacagaactttgccaacggcaacgcattgcgcatgacgcaaactggcagagtaggtgtagtcatgaggacgaatagaaattaacgcagcagcagctaatccgattttaaataccatatttagccattttgtgatttttaacatacaagagtcgaatgaggaacgaagcaaaactgatcaaatattaatatgcatattcaataggaaactcacaagataatttttattactgacaataagtaccataatatagagtgatatggctatgtataaatgaagctattttctactacttaaaaaaacaagacttacaaagatttaaatgacttaaatgcactacatgtcttcagtggcagagcttagtggaggccatcctaggtggtccccaccatagccatgaactgtatatagggagcatgcatatgctctcaatctctcatcttggatagttgtagtgtgttggcttagttgttattgcttttttttatagtgtcgcgggttcgataccagcatcacagttatttttctatttttcttattttttctgtttctcagcacatttctatttttcttgctttttcagttcctcagctcattccagcataattgttttcttttttttcccaggtctcaagtcttatacttcctctgtttcacaatgtaagtcattctagca

SEQ ID NO: 25268 - DNA, 661 bp, Oryza sativa
  unsure (1)..(661): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattatctaattccgatgctactaatctttggcatatgcgttttgggcatatgagcgaaaatggtttggcagaattgagcaagcgaggattgctagatggacaaagcatcgggaannnnnnnnnnnnnnnnnnnnnnnnnnnnnnnnnnnnnnnnnnnnnnnnnnnnnnn

SEQ ID NO: 25269 - DNA, 6162 bp, Oryza sativa
tcaagcttgcatgcctgtagtttgttttcttaggggagtttttcttcctttgtaatcacccaaaaagatgaccggtgggcatccatagaaacaactgtacaactgatcagtaatcctatgagggtatcacgaaaataagtgatctcgaccattaatttattagttctattatcaagataaaaattgatcaaactataccaaataatctgtttcctatatctcgcaagtcagaatcaactgtttctgtcgagaaatggaaaaccaacgattgtatttaattccgggtgggctgccatcgttacttgctttttttttttctatctgaacttgctttttggttaaaaaataatttaaccgaagactagaacagatcacattgcaggcgtggttatagatggccaaagggcccgcccggcacggcccggccctggcccggctaggtacggcccagcagccatcgggccggcacggctcgataggcacttcgtgccgggccgtgccggcccatgggctgcacctcccgcccaggcacggcccaccagctgtcgggccgtgccgtgccggcctgaaggcatgggtggtccatcgggccttttttaaaataagtatatttttcgttcctcctctttgggctatttcatatgtatagctaaaataagtctattttccgtccctcctctttgggctgacatatgtatagctaaaataagtctattttatgtccctcctctttggctgacatatgtagagataaaaaaagtctattttagatccctattctttcgtccatggcatataatatgtctatttttactcccctattttttttgtgtatcgggcctagctgccggcccatcgtgccgggccggcccaacatgccggtggaggggcccaggcacggcccggtggtcggcccgggccggcacgggcccgacctctgtcgggccgtgccgtgcttgggccgggccaaaataccgtgccatgggccgagccgtcgggcctcgggccttttggccatctataggcgtggtgaagctggacaagcgacctccccactctgctttggccactgcctccaatttaacctgcctacgatgttggcctccatcacctctcgctcaacaccggataggttcctgatgaggactagggtctcgagctttcattaggtattgggataggttgattagaaagacttgacgttgatgatacaaaggctccgatcaggacgatcagacccctcacacacgaatgacctcgtcgataaggctatctcctacaagcgaattgagaacacaagcaagagtgtagaagatgcaatctaaatatattgtgcatataagatgaatctcacaaattagggttcgacaaaccagactagcggtaaaactacattggcagaataaactaagcaaaactcccctctaaacgatgaaggctgctaaataaataggattaggaacattttagggttaaccccaggtcgcacacccccttgcacttagtccatgacataattataaggcccattgtccaaatcagactcaaactagataagatacgaattgttttgcagattgtcgattgctcatgaagaattttaatgtgtgaccaaaaccatatgatagtagactccataagcttttcaaaagtactcacaagcctgagagtccttctatatcagtagttaggtccgtttgatgttgatgttgtcatgaggctcgaatctgattccaaaatatggagaagttattctcttgctttaaatggaccaaaagtgacgtggggacgttggagtagacttggtgaaggatattgattggtctccaatcaacttaattgattatcgaatgtttgttcaaatatatagtaaataaacctaatatatatatagagcatgtgaacgcttgttgatgtgtaatataagaatgattatatccaagccagtaaaatcctcatcagtcgagacccctgccaatgccacgacggcctcccacctgcctagcctttagtcggaggctactacaaaactatatagctttattggatgtttaattagattatgaatgtacgtttccaattatgtattgaacgagttgaaattatttgtattttgtcaataaagaattgttaattaattttcagttattggtctgttaacatcgtgttcttgtgagtgttatcattaattaaaatatagctctaacattagtaaaactagatgaatatcccgccacgttgatgggggaattaagttagataatatgaatacattaggtgaaattaagttatataatttgcacatgggttgcaatatagttcaccatgaataattgatacttaaaaattttgagcctaaaaatagctgattacatgttttttttatgagagaagatagaagagacaatttgtatcatagatccatcatccaaaggataagaataattgggatgatgtgactgtgttctcttggaggggttggaaacccctcccctccgcacgcaaaacagagcgatagattaacacaaaattaattaagtattagctatgattatggtaggaatagaaggatataggaatgaaatgaacactaatatcctgtcgatcagagtatattcaaaaaatccaatttaaccgtgctgccttcacagctagcaatggaaacttataggttagctacccgtaccctttgtcaggactgcacacaaaagttgtatataaaaccaatcacactcctcttcctacatgtaatcacacattgttctttggttttccaatactatcaacagttcacttttctaaactcgagttgataataatactggaacgggcggttccagtaaatatgttagctcgatctcgattacttcttcatgtagcatggggatcaatctaatgtagggagggctaggtgtccaacactttgtttactctgttttatttagtgcccccaaatataagctctacgtttgtctacttaagaataatcatgtattatttacctcttatgatattccacacatcagtacaatcatcgttgtcatgagttatgacattaagtgatacatgccagtttcagtatgttgtacacgtcggttacctctgctgttcaatttccacaagttcagttcgttgaattgatattttttgttcaagtttaaaccctggtctggtttatcaggaatattgattcattgcagctgtgcaggtgtatgtagggtgggcgtcgatttttttttttttttggcttcataagttcggtttctcatgagctcggttgtcatagaatggagaccgaagaaactgcgaaagggcccgtagcccggtagttacaagagtctcagtagcatcttagattctgggttcgattatccatgagagtgaattttccaggatttatcggcgttgtgctttcagtgatttttctaggacttatcggcattgtgctttcagtggtagggggtgagtgcacgtgcgttgtgagtgtcagtgttgttataaatttataaaaaataacttgagaaaaaacaaaaaccgaaatagaaacacctaaatgcgttgtgagtgtctgcgttgttactatgtaatttaaaaaaaaagaaaaaaattgagaaaaaaaagccgaaatagaaacaccgaaaaaaatccgaaataaaaacagcgatgtaatttaaaaaaaagaaaaaacaaacacagaaaaaaatcggttcggtttttcccgaataaatccatcgccgttggctggtcgatctcatgggttgcagcgtggggcccatgcgggacatcagcggcgcatgcatgcgaagattccaggaacactgtgtggggtccacatttaagctagggaaaattggaatcatgccattataatttttcaaatttgagatatatcatcctaacccacatatcattgaatcatgtgggtcctacatgtcattaagataccaatggcatatcttaaactttacaaaattataatggcatggttccaaattacccaggaaggtaaccatgttcccatggcccggcccgtggcccgacagcccggcccgtggcatggcgctttggcacagcacggcccgactagtgttgggcccgtgtcgtcctagcctaaaaattgggtcgtacctaggccgctaccttgacatggtgggctagcccggtacagcaagaaagatagtgaggagaaataaacttattttcaaacatatgtaaggcatggaccaaacaagagggatgaaaaatagacttattttagccagaaagaggagggatgcaaaatatacttatttcaaaaaaaaacacaataggctatcataccttcggaccggccgaacacggcctgagtcttattgggtcgcgcctgggccgtgggtgtagcccatgggcaagcacggcacagcttgacgtttagatcggcctgtgcctgggccgtgccatgccgggtggcctatttgggcatctatagtcacagggagacaaatcaggcaaataatcagctgaacgcatgaattcccggttggtacagtgctatcggttcacagagaataaaaaccgagtaacaaacgagacactgaacttgataaaaataaaaaagagccaccaaccgaataccgtaaaaaccgacacttcggtttggtttggtgcggtttggtttgacttttggtccacagtttctttttgcccacccataggtgtatgagaaacttgattatgtcctttagctcttagttgagacttttcgctatcgacatggaagatgtatgtgtaataacatatcctagttgtagaggttgcgtatgatccatcatgtagttttcgtaggattagtaccacacatgaagagtttatttaaattttttgcataaagcaagagcagaagtgcaagtttggtgctatgaacaggatgatgtggattattgaaagatgaacattacaccatggcctttaagccagactatataatagcaggtacaatagcagactataagccagctatacacacatattgaggagataaaagagaagagatctaaaaaaagtagcggactacatatttatagccagatgcagcacagactccaagacacaatgtgtgtatgacaggtatgacaggtgtagtatatgtttataggtaactatctatctatctatctattatatattaaaagtccattaaccttcctacaaacgctcttaagccgccacttggcgctcctataaatactctttaatcgccacatggcactgtttaatctcaccgtcgattttcacttaaattggtggacctggtattttagaccattagattagatgtactattttaaaagtaatacttttcctcctgtgggccggaataaggaaaaaaaactattctacttacatctaaaggaaaaacgatgaagaatacgttcaagaaaaacctatgtacggacttatacgataaaagcgataaagtaaagaaaaaaaaagcatatatcggttgtcattgaaaaaaaaatcgatgggctttaaaataggattttctactatttaaaaataaaatatagtactctataaatatatgcagttaaactatatcttgtatataaaatctatatattatctattatgtactagaagttaattaaactttctacaaatactattaagccgtcatgtggcactataataaataaaagaaattcctagaaattctaagataaaagcaaaacatgtagtccttaattttcacataaattgatggatccgttattttcaactggcagattagatctatttaaaaaactcccctcttttaatttcccgttctcgtaagtactgctcgtaaaaacaccccccaaaatacaagtactcccaagtcgccacgtggaaccctaataaaataaaaaatcttacattcgatttttatttaaatcggtggatctagatcgttagatatatcttaaaaacaaaaacctcccatgtccgcatatcgtgcaccacgcacgtactgatcaatttgtacgccccttctgttcctttctctttttacatacctatcacaattaaaattaaaattatctttatggaaaaaaatcacaaataggcattaaagtcctttcaacatcttataaatatttctaaactattgtgtgacactcttaaattagagaaacattc

SEQ ID NO: 25270 - DNA, 641 bp, Oryza sativa
  unsure (1)..(641): unsure at all n locations
nnnnnnnnnnnnnnnnnnnnnnnnnnnnnnnnnnnnnnnnnacacgtggtggacaagaatgaccgatttgagaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggggggaggaaaaaggatcccagaacaatcgggggctggctcacactttgtagcttcttcatacacagatccaccaaaacacaggagtagggtattacgcttctcagcggcccgaacctgtatacatcgcccgtgtcttttttgtttccactctcgcgaacttttcacagaccaggagcttagaatctcacccaagggcccccggccgaacccgccaaggggggcctgcgcggtctccccgtgaggagccccaagctccgtcatctggcgcgccaggtagggggctctgcgagtgatcttctgagctct

SEQ ID NO: 25271 - DNA, 913 bp, Oryza sativa
  unsure (1)..(913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatactgatgcgggcatccggccccccacgcagatcttcctgggtcgaaggcgctgacgaaggagtggcggccgaatggcgagcaacagccgccgctcgccgcgccctccgccttgacgacacggagccggtggtagcagcgcgagaggtcttggtggcggaggaccgcccaccagcacctaggcgctgccgtgccgtcatgaccaagttggccacgtcgtccagccaacgttgggctggagactccgggtcagggacaacgggcgggtgacgtaggagcacgcccgcagcttggagcgcgccctggggcgtgctgccgtcgccgtagacgaggaggcgacgctccccatctcgccgcccttccccatcacccgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25272 - DNA, 1022 bp, Oryza sativa
tgttacactctgaaaaataagtttggatactcccaccggttttataataattctcgttgttttggacaataataacacggcatattcactacatgacaagtaaaaatcatgtgattggttgacggacatcgcaaaaatgtagtttattgaatgcgtggtactccctccttccctaaatgtttgacgccgttgatttttgtaaacatgtttgactattcgtcttatttaaaaacttttatgaaatatgtaaaactatatgtatacataaaagtatatttaacaatgaaacaaatggtaggaaaataattaataattgcttaaattttttgaataagacgaacggtcaaacatatttaaaaaagtcaacggtgtctaacatttagggatggagggagtatatgcttagagctaactattgtatgcgtggattattagattggctataaatgatacgccaattttgacagctagaaactggtattaaatcaacacataactatgacctaaattaatcaaattttgggaactactcctacatagagcgtagagctagacaaaataaaccaaacgctcctctagtcctgtccacacccaacgattccaccaccctctccctttttcactacaaccacacccatcctccttatcccgttcagtttcttcactacctaggtttcttcgctaccgtcctggtcaacaggtgatggtgggacatggggcggtgtgaccggccaaggaaaaacagtgtgacaagaagcgggccatgaggcggtggacaccagtgtcaggaggatgtagccctcccgggtggcaatgttgaagatgagagggaggacagtgtgctagttggcgttggcaaccggatcttgcacctctcaatcttgtatccactataaaccgagctctgcccgaactgctagcttgacgaggtggaaggcggcagccagatttggaggatgggatggccttgaagtgttgccctgctatcctcatctgcccgatgcgatagggaaccgaggcgg

SEQ ID NO: 25273 - DNA, 4361 bp, Oryza sativa
ggccattttcaggtgatttattcagcttgtgggtaggggtggaaacgagccgagccgagccaggctcggctcggctcgtggaagctcgcgaaatgccaggctcggcttggctcggctcggctctccaaccgagctgtacattaggctcggctcggctcgtggtctggctcgagccggctcgagctggctcgtaagcttgcaatagcagcagttgtattgccagcagcagttgtgttgcttgcaaatgacttggttattcagataataactctcaagtccctacaaagataattaagtatattgtatgcagccaacatataacaaattgatggctttttttggtttccggccgaaagtctttctattcaaaccgagcctactaagctcgtgatctgctcgcgagctggctcgggctcggctcggttcacaaacgagctaaaacccaggctcgggctcggctcgttcaggattcgagccgaaccgagccaggcgagcccgagccgagcttgagccgagttcacgagcccgagctatttgtccagccctacttgtgggtactccaatgagtgtactcgcgtctgattggtcggatgtgtgtttcttcacatgacaggtggtttttatacaaaattcctgcatacacatattgcaccaatacttgtggaaaatgattagtaataaccactaccactaagtttgatgtattatttcaattgttgttttccaggaattgacgatcatttaaggatggtcaacatgtagatgaaagttacatctatccaggagtcaattgacatgtccactttgacattagttgcgctttacgctaaacttaaaactcatgagatgaatattctttcttgcaaagttgattctaaatatagttctttggattattcttcatcttattttgatgatgcctcttcttcatcggctcttgttgcttgtactgcctttaatgccaagtccgattatcaactcgagctactcgaggttgaggattttgctttgcttattaacaagttgtctcgagctacatattgtttgagattaactattgaaattgcaaaaccaaaatatttgaatcttctcttattcttggagttgccttgcacccacacgcactgtagatgagttaggtcatgttgagtacatggaaaacattgtgaaatctgatgaagtgctttttttccctagatgttgcaaacaagaagatattaagatagattatgaacattgcgctaaattgacttggatgcttttttactaaaaaagttctttggaaaagttttggatggcaagaagaaacttaacatgaatttagatcaatctaaagtgactacttataataggggtataggctgtaaaatcaaggagtttattcaagattttgtgtgattaaacattggtggtttgctatatttcatctgtgataaattggtttcttgtgatgagatttcggagattgataaacggttggtttttgtgaattggatgtgtggttgacctgggcggtcagatcggccgagtgttggcggtcagaccataggtcttgcagtggttagaccggccggcccgacggtctgaccggcaaggttctgcttgatgtcagtttcgggttgttcgttatgaataatttcttcatggattagacttctagatggcttctatacatatggataccgttatgctaatatgatttctttgttgttgcgtgtgcaagtgttgcttaaggcctcgggagagtgttgccggtgatagatcagagtcgacttgggagaagtggatgtctagggatcaagagatcatgcggtatagtaaatgctagagaacaatgcacgtggtgatgaaggatccatatgacatacaagaggaattgtgtgcatatggaaagtggagtcaaatttggaagagtctgaattcaagaaaattgatagagataaggaaagagatgagttggatatttgcaaaagacggtttcccatgtggttgggagtcctaattgttgttagatttgtgggcattgcgtagccacatcgagggtataagtagtagatgtgttgaagcctctagataacgattttttagagagtcgagttgagagaaaagttagggttttgagtctagtcgagtttttggtgagtagtgttgttgatgcactttgtaaaaactagttgatgcaataaagtcgagatattccagtctacatctatgagttttcatctactggtgttttcttgatccctacagttacaccgacagcaaggtacggtctaatcgacgggagggcggcggtctaaccacaggtagcgtggtggtcacaccggcggtaggagggcagttcgaccggcggcttcaggacttcgtcgcctacttcgtttgaggtaaatcttttattccgtaaaatattttggggtttttggtttcccctaccattcacccccttctggtaggtttgtttggccttgttgcatgctacaaaggttttgatactcactatttttttactaaacatcaaactatctttttgagcataactaatcaagataaaattttgacaaaacctaaacctaacttttgcaccgttggccacatcaggcaccaaaaccaaaacctaaacctaacttttccaccaatcgagatgtcctagagaatgttaggcaccctggtccaattggaattgggagaagttgttttctatagaagtgactacggatcgggggtccgattttttagctaaaaatcaggtgcctagctcagatttcgctagcgcatgcaggtgcaccatgcacagtccatagcatgcatcaaaagccatgcatctgtaccagaaaacaatagttaggttggttggtttaagtttctttgaatacactttaaactattttttctcttaaattatttctccaattcatgattcagttgcaccactaaattctttacaattaaacctttaaaacaaaaccacacatggttataatccaatgaaataaatatttagttttattattgaactttttaaaatgttgcacctatttcatttaaatgtttcagctagaattcactatttaatttacaaatattttagcaagtattttataatgttccaataactataattatagtttagtgctcatatgtgatataaaaatatttcaacaataccagcttctgtaaatatactgtatctctgatatgatttttttttcactcattgggactcagtgttaaatataaatggttgttagtgttgcatcccgtatttgtaaatgctgcatttctctgaagcattttatatagtgaactgaaacaaacttctataagggatgaaacaacgttcaattttttatcaaaatataattatgtgatatcttgatgtagagatttaattataagaaatacaatggtgtaatcgtattgtagacccgataattattttagaagaaaaacatttaaagagggagaaaacgtacaaatgagtggaaattcataaatggacatgcaatgacatgtgcaggatacactgtgaatgagaaaagaaaagaagtattggaagaggagctagctgcagagaagtactccttccattccaaatttatcaatgttattttataggtacaccaagacgaagaaaatctaataactttctcgtactatatttactctaccaacaaactcgatgaatgcaccatccccactatttcctagccaatagcaaatcaagatattgtatgtgggttataaatacttgtgtgcatggatgcatgcatcaatgtccatttactctaatgcacaaataacaaatagacttaataaatgaacacaaatatgtagctcatttaggaataagctcaaaaaaaaaactatatgtagatcaatttagaatggagggagtgtatacttcatgcatgctgaaatgatgaaggtcgtccgcagtgtaggtggagcccacatgtcagtgagcggtactacacatgcaatactgctggggatctcaattgacactgaagatgtgaggaagcgccgattgtttgttcgtggattgggcgcccgactttaagtattatctgttttctatataatatttatatttgtgcaatcattgttggcgaacgttggtgcatggagaactagttgtgggatctgtctctctgagtgtaattttatagacagttatgggacgggccagcctacatatgtacaacatactgtttataatttttatgcttgcttcgtgtgatcaggtttcattagcttgaggtgttatggttaagagtcttgattttatctgatattctccacttatggtgttgagattcgtcaccgtgtactacctccgttttttaatagatgacgacgtt

SEQ ID NO: 25274 - DNA, 904 bp, Oryza sativa
cgttgtcatctattaaaaaacggatggagtatgttttttcataaaacgtttatgacgcacatgcactctcaccaaatacatacacactctagtacgttctctaatccaacaaaaaattcttgttgaaatcatactgctatgtaagagaaatctgacatgacatggtgccattgtcaacagtggatttcaccaaaatatcacttcgcagaagatattcgataaaataatgccactctcgatccatgtctacaagctacggagtataatgctaactaggaccaaattgccatgagcggtgactgccgtggccgagcttggatcgacggcaacagcggcggccgtgctcgaggaaggcatgtcctcatgtgggcgggcgcctgtgatcaccgcgccagccgccgacccctgctgcgaatatttgaggagacgaggaaagagcagtacgtacagttgctagccatgaacgacggcaaggaggagccgaagttggaatagaagatagggatagcacaagtcaaatgaaatttagtcatggatagtattatatagcgtgtagctaaggatcgagagtgacattttttgggtctcttctgtaaagtggaaatttttgacagaagcacaatatcagatttctcagtgtgtaaacaacatttatggatactgaaatttaaacctagtgggtggagtcccacatctatgactcattattacagtgccagtgctttcccaacatattagtgtatatgatagtgtcaacctatctacatgatcatacaaataatccaaccaacactggtggagaaaccctttgtagtcctggttcgtaacccccctttagtcccggtttctaaaccgggactatcaatccgggactaaagatcgctatctttagtcccgggtgaaa

SEQ ID NO: 25275 - DNA, 1211 bp, Oryza sativa
  unsure (1)..(1211): unsure at all n locations
nnnnnnnnnnnnnnnnnnnnnnnnnnnnnnnnnnnnnnnnnnnnnnnnnnnnnnnnntatatatatatatatatatatatatgaacaaaatatatttacattatagaaaatgtgtacacatgcatatagaaacatatgtagtcatgtattaattacaatccattatatgtcctagctagttacgatttcgacgtagtagtagtcgttagctcagaagctaaggacctatgaattgtgtttccgtcgtagtagaattcacccttgggatcaaggatttgttcgttgatgaatcccatgagttgttcttaaaccgccgcgataaattccttgtgtgtggtcaggttatccctcatgcaaataaactatatgaatgtatgaaattgattagtaattaaacaagaaatcgatacgtaatgaaattttgaatttatttgtacgtacatcgagctctcttgtggtgatgatttggtctgcaaggcaatggcaatacttgcacacgtaatagccacacaagttagttcccttcttttgctttgcgcactacaaataaataacaaacaacgagagatctaattaatatacacttgtatgtatttgaatcggagaaatataaatatagagcatgtgtactcacaggaaatttgaacttccgcctaagtctttttctccatttgccgcggaccaaatgacggaactgataccaagccctaaatggagtttaaagctatgattagtagcaattaacataataagattttcttaattaacagaggaacttatgacggtacctgtctataagttcgaaaaccttgtcaaacgtagactcttttttatccattgagtcatacacgttgacggtgcaggccgacaggtcaaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccattatcgaaaacccccgccgtcgggccctttgaatctccattctacaacgataaaagggagtatattattttctatagtctactggg

SEQ ID NO: 25276 - DNA, 512 bp, Oryza sativa
  unsure (1)..(512): unsure at all n locations
aacggacacttagcggacgtgaacaaaacgtgaacgaatgtgaatgaaacgtgaatgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattnnnnnnnnnnnnnnnnnnnnnnnnnnnnnnnnnnnnnnnnnnnnnnnnnnnnnnnnnnt

SEQ ID NO: 25277 - DNA, 3097 bp, Oryza sativa
tgttcagtcatgttactcgctaacatatttgtgatcagaatccctcatgttttttaacggagggattagatggcagtagtttacgtttgttagaacatttagatggagctaagcatacattttacatgatctattagggcaaaaaagaacggcactgatatgtgaatacgtgatctttaataatgtgccaatattatttgcttaatctatatgtctagtctatctttggaacttatcccattgaagcctggtttggtttagaggggattgaagaggattgaagggaattaagggggaataattccacaccataataggtgtggaataaatcccctccgatccctccctcatagggattaaccgaacaaggtctgacagcgctcttgttcgagtaacaacactggtttatttattgttgtcttaaaactcttagagctactgcggcctcttaaaatatagcccaagctagggctcttcttcccctctcaaattccttaggcaactggctggcagccggcccctctacaaattccaacttgaaaaattcagtctatatacaagtattgtgataagaatggaaggagttaggaagaaaatcaacacgacaagtgttggtcatcatctccaacgagcacacgacattacatgttcttcccgtcgattatctcccatgcccagatgttttactacttagaccctctgggtgaggtttagcactgtggtctgttggctcatcggaaagcagcggcaaccggctctggcccctgctatctggcaaagaacagaatgcagacatttgaagaacaggacgagcttgagcatgcaagaacggtaagctgtaccgtgcggaggcgacgtgatcggctcatgtagaagttaatttagaaccctagcaaccattatttgtttcatgagctatgggtttaaaacacgaccagccatttgatttttgcaacgactttgtatatgtagaacgtttacgaaaggcagaggacacaagtcctataaaattaagcatattgttatatatatatatatatatatatatatatatatataatttctgtacatatatagcataaatatatattctgaagatgcaaaatatgtgcaaattagacatcgatcaggtcgatgcaaacaaactagagtattgcatagtttcttcagttgccatatagtttgctgcaatttttgttccattaattatattttgaataccagagccggggaaattctttcacctgtttcatcagttttagacaccagggaaaatcaattttcgcaagcttgcatgggaaaacaaattaatgctagaaaaaatgcccatgtctgctggtgtcaagctaaagtgaactgcgagtgaaaacaatttttgaagacaagaaatttgaaaatcatgacgacgatggcaagctccaaccccggccatggcctactcgtcgagctgcgttatcacagcggttgctgtgtctatccttgttagcctcgccgtcgttgtgtccatcctccatgagtgcggattgatctacgccgaagggatggagggcagaggtcagctccccatcaactagagtcgccgccagagtcgacatcccttggagtcaccgccgaacagagttaccaccgccggatccgccgccacccgtggatgtcgctgccaaatagagtggctcaagctctaccttcgccagtggatgtcgcccgaactccaccgccaccagtggatgccgccgcctgtggggaatgaggaggagacgggcgcgcccgtggggaacggagttgcccaagctccgaacggcgccggtgggaacgaggcgagggagactggagggagatggaggaagaatgggtatgggaggagagaggggacttagcttgtggggtttgcccggtctcccctttaatatggcaatttttcccctaagggtcctcttcaacagctatttttcgcagcagtcactaattaagaggtccgcatgcaaaaataactctatttttgcaagcggacctcttaagtggctgtccggaaaaattgattttcgctagctgttcgtgaccagaatctcccaaatgtatttctataagcatatgttttcttaaccctctaataaaaataaaaggcgatgtcatgaaaaatgatttttaagtagtgcctatttagaggtaaacagaatagtaatataatgcttggacaataagccatattatatatatatatatatatatatatatatatatatatatatatatatatatatatatatatatatcccatatggtagtttcgcctcgatcctcccactgacactagtaataagattcaccatacacccctctccagaattattgagttctcagatgaaaatttagtttacataggaactgtggtaggaacgggaggatgaaggaagaaattctgcacagtaagaatccagtgcctaattctgccaaacctagttattcgtcttgatgaaaatcgtcgttagcaaggccggcaagttgtcacaacgcgattctggcccctattgatgagtgatgacaaggtactgctggccccagttcaagcattttgatgttcaaattagccgaaacagatcctggtatttcacgacagagatgttcatcaaaatgtcacttttgatccttgccaacaaaagaaataatgcttcatcttttgttatgggcgataagtgatcggattggatatgtgtggaaggtgggagggcgtggcttcggtggcttggaggaccggcgacctgtgatgggcacgccgatgaaacgagatgagaaacagagatgaggaaatagattaaatctgacttatcccttgaatgatctaaacgtgcctcttataggcttgcaaaccataactaacaatctgctaatcaaaaagaactaactctaacaactccctaaacatctcacgagataactggatactattccccgtccggcacggagaagatcacgacgctaatccttttgctgtgccatcactatcgccaagcgacgccttcttgcgtcttcgttggtgcacaatcccgaccatgacatctttgtgcatttcgactccccacaatggcaatctccttac

SEQ ID NO: 25278 - DNA, 5175 bp, Oryza sativa
agtgatcggattggatatgtgtggaaggtgggagggcgtggcttcggtggcttggaggaccggcgacctgtgatgggcacgccgatgaaacgagatgagaaacagagatgaggaaatagattaaatctgacttatcccttgaatgatctaaacgtgcctcttataggcttgcaaaccataactaacaatctgctaatcaaaaggaactaactctaacaactccctaaacatctcacgagataactggatactattccccgtccggcacggagaagatcacgacgctaatccttttgctgtgccatcactatcgccaagcgacgccttcttgcgtcttcgttggtgcacaatcccgaccatgacatctttgtgcatttcgactcccacaatggcaatctcccttacagtcgtttgaaacgacgagactaattgttttgagttcttttacggtgcacctcttaccatcctagaggtaagagggaaaacaaatcaaaagcgttatctcaatcaacatgtttacgtttccaatgcactacctaaacacgaaatccagcagattatggttttcatgaaatttgacatattttttttacaaacttaatttggaaaccaaaatttgagtatgatcagcacttgaaattttgggagcagcgattgaattttggtcgagatattctaattaaattttgacaaaaatgcatcaaattttattagagagcatgtagtccttcgtgagtctgtgcgatgtcacaactggttatagataatggaagatgagtagtactctctctgtttcacaatgtaagttattctagcatttccgatatttatattgaagttaatgaatctagacatatatatatatctatctatattcattaacatcaatatgaatgtgggaagtgctagaatgatttatattgtgaaacggaggaagcaatacacatttcttttttctgcatttagtgcaccgagccaaaactgtaacaacatgtacggaggactgatgaatcactacatgggaatgtatacgtacttaaattgttgtattttagagaagtgaaaaagataaaattttcggtagtcattaattttgtaaatatagagatattttcttgttttgatggaatcattgcattatgaatttaatgtagattgtacagataccatgcgtgtgtggcttcgatgccttggcacactaacaatttttatttgcttgttttatatatatctgagttcccgaccatgccaattcttccccattcagatactaagacaacctcaaattcttaatacaaccatggactactaaaacgacgtttttctacaaattgggataggaatgggaggattcgaaaaggaaaatagagcttttttcggcggaggaacactgctatcgtgagacaccatgtaatcagatgagccatgcatgtttctaggtgtcaccgtgcgatttttctgtttcgatccagcggaatttaatatcgttcaaaagggaaatatggctaactgctagtgacaatgcgcgattaagagatgcaatgctgcctcttccatttttcctggtggaatgacatttgctgcatgttgccatgtccgttttctaatattcgagtgaataattccatagcgggccatctatttttatccggcctatacccagcctgtaagctgtaagtcgtacccgctaacctatctgatatgagcaattctacggtctttaaggaggtaccatgaggtaccaaaaatttagtgtaaaatttggtaccttatggtacctcatagtatctacatatcaagaggtaccaaatttacaatagaaaaagtggtacctcatggtaccttctcaaggaccataaaattgctcagctgatatggtgtgcacaccaccatcgacctaggcaggcttggtttatgcattaacgcatgcactgatgcaccgacaccaccattgcgatcaagcagggcaacactttatatgtttaattacacgatcttaagtgaaaggcaaataaatagtaagatgcaactcaagtaattatacatagcccaaagtgcaatttaatatttttttaatatacaacacaactgagtttttttttctcgaaaatattatgtagtgttagtctgttacctcaatttatctctcatcagtttagttacttcaaatgcctacactgacatgtcaacattgtatcaacggcccaccataggtcataaatctaactactaccatatcatataagcaatttgcaatgcatatttatttgtcttcgatgccccctccatttaaattttatatttgaaggcactctttgattgattctattaataggagtttcgatagtagaaaaatgatggtatagaaatggaaaggatcaaacgtacacagttaaaccgagacggcagtcagaacatatcttcaatccaactatgtatttttcactaaattgcggagaaacacattgggaatgggaagatttaggaaaatagtgttgccaagtcagagttgatctagttagagtcttcgactgtatagctgctacaagtggaagctaaactgatcgaccacgagagtgctcgcaataatatgacaattgctggcgacaatagacaacaagaataacaacactgagatattgtgccttttgggtttactctactttttggctaataatgcacatttgagaatttgtggtttatagatagcaattcaaatgtgtgcgcagattcttgttggatgcaagggaagagaaatagtatgaacaacattaggtgataagcaacatcatgaaagaagtgattgcttgagtttgagagtttcgaggaactatacttttcttgaaagagcagtcaccttactgtacttttaggaattcaaatttttctaccagcaacagataacatgacaaacaattggagaggaacatcgagagcatttttcatgttaagtcatgtcacttgcctagtaaagttataacatactagccaagagcccgtgcgttgcaacgtagacagttgagtttctagcttattaagtcaattaagcacacatttaatcaaaaatagtatttttatgattttccttattgaacaagtaggtctttttgaaatttgggagagccgaccgtgaaaccgaggactcgttgaagggtgatgtaacagtagagattgtgagacccaaatatcaataggggtggtatggcagacttggacaccgccaccattttaaagtagtatagatatagatgtcagtttcaaaatagatatccccttgccttcattagtcgttgtctctctccatccaaaaacataaggaactccagaaattgaggtgaaaagtaaaagatgcttgttaaatgagggatgagagggtggttgggtgtatgattatgtgaaaataaaatcataagtggttagtggaaattgtattctaatagttctttatttatatggacgaatttcaaatgccagaatctattatattttcaaatggaaggattcaatggcatttggtagagtatttagatcgagtatacctattagagtagagtacctgtcacgcccagaaattcactagtaattttcgaactaatttgtgcataaaaccctcgtccaggaatcagccgaggtacacaaactgacaatttaatatacagaatcatcaataatacagcgttacatacttacaaaagaaaagaaaaacagcagcggaattacaatctagcgaagctccggctccactcccacaggcagctcaactggggtataagccaaacgtcttctccttcgcaacttgtctttaactgaggtttgattgattattgcaaggtgagtacatggaatactccgcaagccacacaacaaatatgcaagtgcacaaggataccaaagaatggcataatatagggctcatttgcaaaagcagaatttacaaacatttgagaattgtaaaacagtagagtacttaatcatcaatattaatcaacactgaacagcacacccatgctgctcaggcccaaccatcctgaacaaccatacccggctgcacagatctatctccaaaccaggaaatgtaccattgcaaaccaggagctaatcaaattattaccagttataatatcatttattatggtgagaagtgtgagactaatcacaacagacattgttagacctgcgcataaccgcgggcatggctattcgaatagttttactctggccagaggtgtaccactgtacccacaagacacagccccacaacatgtcaccatgcgcctcaataccaccacggtacctcagaaaggagctgtgacagtacccctcgcacaacataatccaccacagcgcaccgttcctggatcataatcacccccttataaacaaggcatggactccccagcgaaccccgtgggcttatctccgccacttctcagtctggtgccccgcaatgaaccatgctatacaaaaggtaaagccgttgcccacgctggcttgtggttggcacggttaatgtttcataaccgaaactcatgaaccggtccttaaatgtcatgagcacgaccatcaaaaccatgtgctcacaacccaccattatcaagttttagttggcacattaattaattaaccaatcacgattagccatcgtgagctatcattaaatatccatcattaagtaatagtgaaacatttgttatcccaatcgtgtgctaatgtttctaagcatgactaagcaattatatctaatatatctagctaaaccaatatatcaatccaactagtcaaattataacccgaggtaatcaagaaatagggtaatcaatgcaaattggccataacaaaggaacaggttcacaccacccaatgacattcgaaaataaatacacagttgaaataaatagagaatttaaatataggatcaacatgctcaaaggaattgtgtttgggatctatgtgacttgacttgcaataaagggtcttcaattaatcttctgaaccacttccgacgctctcacgaaccttcacaacgacggaaacgacaagctaacacgcaaaacaaagaaaaagactaatacaaaccaaataaacagtacatataaagtaaacaaacatgtagatcatgattttagatgaatttagagacttgaacggcctcattctgatttcatatgaattagt

SEQ ID NO: 25279 - DNA, 2124 bp, Oryza sativa
ggaacaggttcacaccacccaatgacattcgaaaataaatacacagttgaaataaatagagaatttaaatataggatcaacatgctcaaaggaattgtgtttgggatctatgtgacttgacttgcaataaagggtcttcaattaatcttctgaaccacttccgacgctctcacgaaccttcacaacgacggaaacgacaagctaacacgcaaaacaaagaaaaagactaatacaaaccaaataaacagtacatataaagtaaacaaacatgtagatcatgattttagatgaatttagagacttgaacggcctcattctgatttcatatgaattagttatgaattttacaagatttaattccaattaaacctattaaagaaaagactattccaaattaattaaataatttacaaatgatttataactgagataaaagattaaaacaacctctagaaaatattagattatatttagtagatgacatataataatataccactaaaaagagagaacggatttatatggctgagattaatctcgacagagtcgaccaagatcggatggcttggtttgatctggcaagcgagcctcacgagataccgactaaatgagtcaattctacgtgacacgggattacccaaatgatcaaccgaaaccggcgaacggaaccggcggctctgaacggctctaaactataggacgactccacaaggatgaacgaaacacggggaacacctcgtttgaacgaacgagcgaacgactcaacaacagctgcggctaaaccggtgggctagacacgattcacggtaaagccccggtatggcaaacgataggcctgtaggaatttagggatgcacctacggctagacaacttggctaccgagcaacggctaaagcggcggctaggttaaagcggcacacagctacgagacggcggcactaaggcgacttggctaagctaggcggcggcttggcggaaacacacagctagggttagggtgacggcacagccggtagcgatgcatgatagcggcgcggcggctgcagtacgtgcactagggcagcggctacgcggcggctagcagcggacaacagcgggtgcggtgcatggcaatgaccggctcgacgctagggcggcgacgcggtggtagcaagcggctgcggcacgcggtatagcagctgcttggcagagccagcgcagcgagcagcggcatgatggcagcaagcgacggcgcaaggcggtggcttggacagcagcggcgatgcaactagggcagcgacggcgcatgggtcggctgcggtggctaggcacacacggctacgcacgggctaaggctgcacaacagcgactacacgaagacacgattgcagctacacaaaagattaaacctagggaacggaaaggaggcctcactggggaagaccgaagaggaagaggcaacggcaacgccggcgacaacgcacggagacgacgacgacgacgctagggccaaacaagattagattaaattggattaagtccctagggataaactacaccggtaaacgacatgggagcggcggttgccggcgaaccacggcacaatatgcacacggagggcaccgggaggaagagcgcgagacgacggtccttaccaacacttacgcgacgacggacggcgacggaagatggccggcgacgagcttcgaagggcggtgaggtactgtccacggcggcgacgactttccggcgatgtgcggcgacaacggaggggtggccaggcttcgtcttggtgctgcgatgccgaaggagggagcagctctgaccagggacagccggaacgacggcgaacggcggctgtagatcaaaagacggcggcaacccactggttcacgacgaggacggcttccggcgagatttcggtgcaagggaaccggctgccgggcttctcctcctccttgcgaatccaacggcggcggcggcgcgaccgaaggagacgatggacgacgacgaacggcgtggctggagcggcggccggcgcttggagagagaaagcgagctcggggaggggcggctagggcacttcgaaggacgggacttgaggggataggtagaggacgactagggggtcctttatataggca

SEQ ID NO: 25280 - DNA, 2563 bp, Oryza sativa
atataatagatagaagatagatagatgtaaatcagagattatgccatctcataaaaatatagcccgggctagggctcttcttcccccattgaaattcattgagcacccagtggccggtctctccacaagttcaatccagcttgaaaattcagtttatatacaagtgctgtgatgggaatggaaggagttaggaagaaaataagcacagaaattcagttttacagcgccttgctgtgcccttttccttcttgattatgtcctccgactgtgccacatacacctcctcgaggtcacccttgaggaacactgactttgaggccgaggtgatgtacctgctatccgatctgctgcgagagcgagcacgacgcgcatggtgtcaagcctcaccaccagcatgaacacttcatcgaagtccactccttgccgctccactcctcgcttgaccacctcgtctgccgtgttcttctccggtttgaacacccacttgagcccgattgctctatggccagctggcaacgtggtgagcgaccacatcgcgttctacatgagggttctgcttcaacaatgattgatcaaaaaaattctatagtgcgcttaggcaaactctactacgacaaactactagtatagattaaattgaagtgcatccttacactttgtttcatgccgatgagcccaggcgagtgacttgggtggccagacactggctccactgctgtgtgttggcttattgttgggagaggtcttaggctcttagctacaatgaatacccaaaagctccgaaaaatcttatgtaatctttagtagtcctctttgtatgccaaaggagtatcttggaatttgtttcgctcttggttccattgcgtaaattatatactgttttccactaaaggaaagtactattacatttatattactcatcaatttagttacttcagatgcctatactaacatcaacattgtatcagtggcccaacataggccacaacaaagtaagagacattgcatgaccagctcacaacataggctacaacaaagtaagagattgcatgaccagctcatctatttaacttggtcaccatttatataagcaatttgtgatgcatatttgtttgtcttagatgcgctttccatttaagttttatatttgaaggcactcttggttttggataagttgaaaatatgatgatcgtgaaatataaacggtaaaacattgttaaacagagacgccaaccagagcatatcttgctcgaaactatgtatttttctcttacaaaattgagatagaaacacaatgggaacgagaggacttaggaaaataacgtctctgacacagatttgttccacttggagtcttggactgcaaagctgttacaacttcagataatgctggtagttccacccggagagcgagcataatataatgtgatgcctgctaagggaaaaatagaaaacgatagtaacatgcagtgagatattgtctgtggtttttctctattttttgggttaataatacacatttcagaatttgtggattgcagataacaatttgagtgtgtgcaaagactctagttggatgcgagggatgagaaatagtataaagaacattaggtcataaataacatcatgaaagaagtgattagtagagtatgagagttgcaaggaacagtttttgtcctaaaagagcagccacctcattatcattttatgaaaccggccagttacgttctttgtaccagcaacagatagcatggcaaataattagagaggaacatcgacattaattggaagccatcgtttggcttattttaagcataagcgaaacggcatatttacaaacaaaaaataatttgtgaataaaacttttatatacgtgttcctagcaatttaaaagcaaaagctgaaaaataaacttcgatgaaaaaaacctcaaaaacaacttcaaatttaaggttgaatatttaaattttggctgataagcataagtataaacgaaaagatgaggctgatttttcatgtttacgtcgtatcacccgcctcgtgaattaagtcactaagttatactatcagtttcagaactgatatccttgtacgcctctctccatctacaattaaatataagcggttttactttgtttattggaaattaaggtgggaaacaaaacgatgcatgcactcctgactaaatgagggatgaaagggtggttgggagtaaatattatatgagaattaaaagagaagtggttggtgaggaaagtagtactctttattcccatttgtagacaaaattgaaatatcagaatcacttttatttttttacggaggaacaaaatatcatcagtagatagaatcccttgttatattttagaacggcgtgactagataaaactaaagcatgggttttacaagaacaggacaaaaaagagcaacccaaacggtttgtgatctgtagtaatgtgtgattatttcctttttagatgatcagcactatccctttgaccagatgggactgttcttggttaacgacacttctgggttaataaatgatggttttaaacacttg

SEQ ID NO: 25281 - DNA, 7428 bp, Oryza sativa
tttagcgtatttggaagaaaaagaagcaggggtttcaaaagatccaagaattttttttaaaaagaataatatcaacgtcatctttagtattgtgctatttgctttgatcgtatatcttcctatatcatttattaatcgtctattcacctccctttgctccacctcatactcacacgtagcattgttacctattttgcatataacattatgtttttcccttccaagtcttgagagataatgctaactttttttccaaatacaactcaaaatactgtttaagatgtgagttttgttatattatgcatgactatatagcatataattattaggtatcattacctgaactcattttcaaaactaagctggagtaaagtagagaggttatctaactgcaacgattcccatattgcggatgaaaataatattcatataatataacagtacacaacgatgctttgaaaaataaaagtattgtaaaaacatagcatgtatataaagctacattatcagttgcacctaaccaaatcctcgatttagtttgacgataaaactacaaaacccgtggtaagacgcggggtgccaactagcttatataaatgcagtactccctctacgtcagtttttgtaagatcgtgggatgtgctggtttgaacataactcctggattgttgattgttgtttcaaaaattcttttttcttctttaatgcaagagagtggtcttgttttctcttaagaaaaacagaatattattcatcgacaatactatactccctgcatcccagtttgattcacctaagatttttggggggtttttcaagatgatcatcctataacgaagtgtctcttcgtttatgttgcaaatatagtaaatgcgcatcatggaatgccttgcatgaagccaaccagaatgattttttattggttcaacccatgcaatgaggatcaataaagtgttccttgatcgatgaggatcaattttagaatgatgggtgttttggtatccttggtcttgatgccctttatctagagaatgaccaaactaggatgggggagtattacatatcctctcttgctataaagttagagccccctaaatcttaaagcttaacatacaaagatgtcacatcattatccactaacaattattacatttaaatataatgcaagcatgttatattatctattatttcataatttattaaattttatagtttttcaaatgcaagcatgttaaatcatcatctcacataattcacgtaatatttgaatatgtctcttcatttttttataacatcttatatccctatatatatagttcatcctaacttcaaacttagttagtgggttatctcttctctcattaagctgtatcacatcaattgttttgtccttagatgattatctatggtccaaattatctcccttcttttcttctctaattaagtcatatcaactccattatttttagcccatagatgattaatctttgatccgaactatcttcctcattttattctctcataaattcatatcaacttacttttatatttaaattattctatataccatttaaatttaaattatcataaaccacatcaacttacgtaagtttatattgtctagctagcttacaaattacttttacttagtgtatcatactaaaatcctacagcaacgcacggggtttcacctagtaaactgtgatagttcacctcttcgcccacatgccactcgaattctccacgcacccctctgcacaactgttgagttcatacatgaaaatttaatttacaaaggaattgtggtaggaatggaagaaacaatatggtggttactttagccaaaccatattgttaggacaaaattttgtaagcatctcttttccaaaatgcaggcacaactacttttttatgatgtgtcataatataaggtgtgtatgcatgcaacaccaccttctttcccctaaattccaccccacgcactattcccatccgacgtggcatcgcccagcggccgcctcaggagcgccttttatttatcgaattatcttttaaaaaacatcctccaccctcaagatttctaattctattgggtgcatggattatatttattgggtgattcaaataaggaggtgacaatagttgtttcattgtctttaggttaagggtggttgtgccttatattttagaatggtgggagtaataggcatctacatacaaagccgtgcaccctaatctggaactttttgaattttacaaacaaaaatatgcacaagtggaacatgaaggattcaaacccgagagtccacactctccatccataccattcttaccatcgcacctacacaatccttcttgtagaagtcatatgctattcttgtaactctttttgttcaaaacatgtattacatccaggacattcttgatgaattaaaatgagaaaaaacatcaacaacaaatttgtcgatcttgtggagcttcaaaattttcatattgagtttgtctccatcaagtcattggaaaatttaggcatgcaagcttctgacgcatatttgggtatgtaaatgaatttaactgaaatggttgttacataggatattgtagatctcgtcaagatctataatattgatatagagcttgtattcatcagaagtcatttgaaaattaaaagtatcggcgaatttataacatatattcggggtatgtaaacgatctaacgtggaaacattgtcaatggcatggttttagatctcattgagctctataattttgatataaagtttgttttcatgttactttgtataaacatattatttttttattaaactattatttgagtatcgctactggttcaacactcaatagatacgctagtccggaccatagtttgtgttaccgattcatggagaaactgtactgtaggttcatgtcatgaacctacaatgatacttccccctctcattgcagattcatggcttgaaccggcagtgatacatggctctgcccattcaagccatgaactgcctagtaatacactgccggttcagtatgatttagtagggaaattgaagtgaactggcgtagtgatgagctgacagccttttctgctagtgaaaactcaggctctacaattatattcaaagaaccaactttccatgggaaaatgttcaaaaacatcaaaagtatattactatatacattttccatgagaaatgtgcagaattgtaatttgtaaagagaaattttcctgtccttaaggagggaccaagagtattaaatcactccatacaaagcattctattttcaatgatctactcattgcccaacttaccaagtatcatttgcatgtaccataacttattactctctccgagttgttaatacttctcggacaaggctatggtcaaactttaaaaactttagctataaataatatctaaaatctttatcttagaagtatggtggagatttcttaaaaaatagttcaataaaatcatatttttattgatataattatatatattgtaataaaaagaatggtcaaagttactttatggataacatgtccttgtccaaaacgataactattatcaacccgaaaagagtatatcgtataactgattggggcatatgcacagttgcagaatattgcacagcaaaattatgctctctaatgaagaagatgctaatgaagtttgatatttagaaggctttttgtatttttaaggatttgaatagcaaatattgttatacctgattgaacataggcatcaagtcatctatctcgggccttctttttatgctaatgatacgatgttgttactagattgtttatgatgcctttgccattagaactttgtatcaagaaaaaaacggtttttcagtaatttggattctggaaatgcatctagcctgcatagaaacctacataaatatttgaatgcgccaaattatatgtatcttgcagaataatgcatgtgaaggtacagccatttgagtttgagttcttattttctaactgatgttttctttgtctaacagaaaatcaactttgccccccaatggatcatatgactggggttcagggttctaggcttgtttggctatggctggagcccgaccatgcagaccatggatattctggttacacttgaattgaaaaatgtattgtcaccaagtatttaggaagattgctattctgggaggacaacagtgctcaaaggtgacaagctcattcaagggcgcattatgcttgcaaggagcacaagtgacacaaatcttgcagaatatgatattttttacttcaatttgcagaaccaaaatgcgaaaagaagggccattgcaatccacccgtcaacataatacatatggcacaaagctatagttaagtattacagaaatagaggcgaatgatatcaggaagctataccgtacctaaggtatcacaaaggcatggcacatagacgtatatgttgcggatatgcatatcattgcttaacaagcaggtgcggtaaagattttaatgaatgcactacctaaatattcatgatatctttgataaatgtagtctctaacaataatcttgtggtacagagcttttactctataagtaagaatatatattcaggatctctcacagaagatgtatataaaacgagctatttatgcacttcttccttcacttcacacagtctcaacgttctctagcaactcatgccattatcaattcacttttcaaaatttaaacaaatataaagggaatgggtggctccaggaaatatctcagttcgacacgcttgaccttcttcacgtcatttagggagagctgtatctaatgtgtgaagggccagatgaaccacaccttatttactttgttttagggaccacctatatatttctcgacaatttttctcctaaaaatttgatagatgtaattatagtacaatcgtagtgtaattacactgtaatttgtatgtaactacagtgtaacttatatgtaagtttcacgtaattttgaatcattaaatctattataagatttgttttggtgaggaagaaaaaacaattacagcacacatatatgtgaaagaatttgttcccacaacctccattttaccgaaataacatgttacggagagatttttaaaagttacatacaagttacattatagttacagtgtaattacatgcaagttacagtgtaattacactacgattgtactgtaattacatctctcaaatttttaggggaaaatttgttgacaaatatatagcaaaattgttgttttatttagttccccaatctgctaaaagccaatatgggataattagatgcaccacagctcagcaaaaggtagaatctagtagtgagttctatataatcccatataattatggaccaatttcagaagttaactccttatatttttttatcgagggactagattgaattgagtaattagataatatgctactcgattcgtagtgctttcagcatcagccactcaattcgcagtgtcaatcgatttttgcagacgtgaccagttacgatccgtctataaactatgggggtacttgtatagaaaaatcgtttctatagtagtgcgatttgcttggaatcttcaactgaatagtcactacaagccacgattaggctgtccatcgtcaccagaatatcaaacgaagagtacgcagcagatgctagttgaaactagaaaaccaacactgacatattgtgtctttggtacctttatttcttggtttgtaataaatacagattttagaatttctggtttacaaattcataattcaatgtgttacaaacagactatcagacactgcatgattagctcatcaatctaactaggtcacattgtgcattttgttatgtgtattcatgagtctccaatgcttactgcatgacactgcattgattattttgttatgtcatgtattcatgttttctatttgaaggcactcatggatactgtaagtgggagattggattcgtagggaaaatgttggtagagaaaaaagaggagtaaaacattgaaagagagacatcaagcagatcatatcttgctcgaaactattttccacttgcaaattttatatagaaattttcattgggaatgggatgatttaggaacacggttagaacttgaaccaccaattcttcaactccgagtcaatttgcttggcgtcttgaaccaaatagtcacaacaaaccacgactaggctggccatcatgttcagaagaccgagcgaaagtgtattatgcttgttgaaactagaaaaccaacactgacatattgtgtctttggtttacctgtattttgtggttgataatccagttctgagaatttgcggtttgcaaaattcgtaattcaaatgtgtgagtgtgtgtgtatatatatattgcagttggatgcgaactaaataacaatgaataagggaagaaggattggatggagaacattggtgaaaagtaacatcacggaagaagtgattagcaggtttcttggtgtgtccactagcaaggaacaatatatgtatcattaacacagaagcccctgcatttccatctgaattcattgttttctatccacgttagatattgttcatcacgccagttgctagtattgaagcagtgattgtgtatacttgacaaaaataatttgagggaaaatgtacatgaatattttccttgttaacgatcagttatgtcattgaccaagtgaaattactggcatatatttgatttgcaaaatcagatgcccttatgcccttgttactcaattagcgcatgcttgttataatttttttcgccgggaaggccgaaggaggccaactgagtatattaagaaggagtaaaagttacaagaaaagacatcaaaatgcaccaaggtgcattgccacacaccacacactaccacccaagcacaaaccattgaggatgaagcctagcaccaaacgacccccgctaagcatggccggatgccgctaggcctacggcaacaccacagagaagaggctccaaaaacgatgccaccacggtggtcacgacatccaagaatgccgccatcgcccatctaaaaagatgtgcttttcacctagagaagctcatcaagcaagggagagggtaaccctcgacaacaccccaagaggttacgacacccaaaggcgtagccgctgccagcccggtgaaccaccgaactaggcttttgcctgagaccctacacccttgactgcagatcgccatccaccaactcagaaaccccacacatacatatggcagcacgcagcatccaccacaccacaccgacgcccgtccgtcggccgacttcatcgaaccaccacccctaagagctagcccaggacccctccgttccaccacccgcctgccgcctcgccagatttggccgaagg

SEQ ID NO: 25282 - DNA, 5839 bp, Oryza sativa
  unsure (1)..(5839): unsure at all n locations
ccccgccgcgcgcccgggctggcggccgtccccgccgtctgcccgggccgactatcgtgccgacactgagccgccgccgacgccccccaggtgccgccggccaaatccgggcgcgggatcgccagatccggccttcgaggtgccggatccgcctgtcacacctctggccgcggtgagggactttgtcggcttcaccccgtcgatgtcgcgccggggtgggagacgccaagaatagggagagcctcacctttgccttccctgctcgccgccggctttgccgccggcaagctccggcgatagcgaggcagcggaagagggagtggaggtgcgggcggctagggtttttttgccccccgagccgcccgcgcgaaagcgacacggggagagagcctaatcattcgcttgttagaatttttatacggaggtaaagcaggtgtttcacaagatcccacgagcacagaaaagaataacatatatatatatatatatatatatatttgatcataacagatcatatatatatatatatatatatatatgatctgttatgatcaatatgtcagttttgctgtatcaacttttgcctgagaggcgtccacaaaccacactatccctgtgctgttcatcatcttcacattctccagagaaccatatttatcctggcctggtttgttcccatacatatcaacgctccatggtcatgtggctgtgagcacgactctagtgttatttatgacaaaatggagcagcattaagtccactggaactcaacaaaatatttacatgttgtctcacctataagcttgatgggcatctaatacatctgcaaaattagtacgtcatgcttctgtgatgtagtatgcggcagagcccagacactggctcaacatggttgtcgaactttagctccgccgttgtatctaccaaaaaattaagcatatctccgctgctgtgctctaccaaacaaaattgacaaaattattagtaacaaaacttatctaagatttagtactacaaaaattttggtatggtttcaaattcaaatagagcattgataatatatactttgtgcatgcttgcgcacaagttgtaatgtatcatggtggacgcacggcatagataattcagctactggttaaaacagttctccggtatattatagtgcgggtgcgtataattaaatgtataggaaaaatagcacgagtgatgatgtttttaggtcctgttgttcctatcatgtaaaatctacaacattaatattaatcggtaccaaaaacattatggtcaccataaacatctatctagtaaaagtccatgaaacttcctacaaacgctcataacccgccacttggcactcctacaaacgctcctaaaccgctacgtggcacttttaatctaaccgtcgattttcatttaaattggtggacctactattttagacctttagattagatctatttagagaagtcccagcttcatcgaaattatttaccagaaaaattaatgtacataccgaatataaacctctcctattgttctcttaaaaaaccaaacagacgtacgtacgtacaaagattaaaaaaaaaccaaaaaaccatatgtatgccgtaagaacaatacggtctttcgaatatagtgtagtacgtattgtgtatgcctttctctgttttttatttatcaacgaacagcaagtacatacttaagacttatctatctatccacggtctttaaaataggatttcctatattataaaataaaatttattactccacaaatatgcacggttaaactaaattaatataaagtaccaaatcaactgtctttaaatgttcatcttttaaattatttctcaaatatatatctaacttataatcctttgtcattctttaattaaataaaatactaatcacttataatagttatatggaactgctaaattcattacgaaacatggtgccgacatataatacgtaatgtgataattatttttcaaataatttagctaacatataataactaatgtcatttttaaaataatttcacatgaaaaaaatgatcaacttggtgtcaaattcacttggcaaatatataacactaattcaaatctacatgcagaaaaagtgaaacaacgttgtggtttacaatcagatttgattttattttaatgtatgtgatattaagattctctttttttttaaaaaaatagaactatttgatgggaatttccaggcaatgaccttgctatattacgaccccttaatccatcaggagaattacggtcatgtatggtttttctttgcgaaattggtttggtaacaaatgaaaaatcatttgcatcaaactattcatcatatattttttatagtttagaaattctaatatatcaaacataattgatgatgtatgtcatacaccccactgaagtaagtataaatgcactccaacaaattagttactttaaataattttggaaaatatattcttagaattagtaaagatgtcgcatgtaattatgaacaatacatgaatgaaaacaaaccgaagctaaactatatatcttagtcaaaatataaagaacaatatggtactcctagatgtcatggtcgtatgtctgtttagttatatttttttatcaaccttgctcatctgaaaagagaatattgtatctacgcaataaaaaaaaataagcattactgattaataccatgcacaattttgtctacacaaaactttaaaaaattcactagggaaatattttcatcacctacattccctctttttttcccataaagggcatcaagcatgttgtgctaccacaagtgtagcaagggtcatacattcggttgagttgaagccaccccgacaaaggctactattgacaatagtgcataactttgtacttactgatgcaattatctatgagggtgctgatagtgaactagacattaaaattacgcttcatgctggcattgtggggcacgactatgtcgactcaggacctatgtttaaaggcagtggagaaataaagtctcgatggatacggtcagcttcacccattaaaggggacattcatatttgattttaacggtcatcaaaattaaaaaaatcttataaattataagaaaaaaatatgatcatcggtttacttaaattatttagaaaaaaaatagaaaaataaagtacccaaaacctcgtcctccccggcacatgcacaaaacattgccggtccccttcaaccttggctcatgctctccgctctccattcctcccccttcctatgaataatactgaaaagaccatatttttaatatatatacataacatttctaatctaattgttactctgttaaataattaaaccaacaattattgatccgtaatgcctatatttttaatctaaaataagacttgtataaaataaagtagaaaagtagaaaaaaagtcaatagggattgaatcaaatcaattagagagaatatagtaataaatttctaaaaaatagaaaattggaacaaccattgtatgttccattgccataaccatccatctgtcgtggtattatgagtttctcatatattattgcatatataagacatactaaggtagccagacgtagtagtacttagttggttaaaaagttatatatgtgctactatcaactttaaatttaggactcatattgcctaggtattttttttaaaagaacaccataaatcacatatataaaagggaaaggacgcatacaatatatatatctcctatgtatttattgtctcattctttcaagaaaataaagaagatcattgataattgcttatagtaatgaattaaatattatatagttcaaaccttacaaatgtcttgtaaaacaatatctaagcaatagcgatgaagaaaatttataaagaaatactccctccgtcccaaattataccaactataatcaaactcggtagcttttaactaataagcatagtagctatatctaagtattatgcatgttacatcactagatttatattttgaagtactttcatgtgatgctaatttcatatttgttgggatagaatggaataaagtactggtcaaaatatgttattaaaacctgtgtaaaaaaaataggtcttataatttgagacagagggagtagtatttttcaagcatagcaggtatcatccgattgatattcccagtgtaacctactttacatgcccgggcgaatgcgcgggctaccttcctaattatgctaaaacgagtccttttttggtttctattgttttcaaggataggaagatgttgtttgctatgtattaatagacacagagtaaaaaagtacaaaatattggggggggggggcgaataaaaatatgatactctcccccagtcccaacattggaagatttctgggttctcacgctagctgtatataaatacacctaggacaatactcatattcctcgcttactaacaatgtcaaattctcaaacctcgagtctattacaaacacaaagggtacacttttagtagatatcggtagaaaaggaaatatattgtgaataggaggacacgggatgaagtctgtcagcaatgatgaaggcgctctagttccttggtcactagcacgaacaacaacgcaaaatcccattagggtattcccaaccctccacctcagatggttgtctatagaatctattaggctgccacataagcaaaattctgatgtggcaaggtaattaaagaagtgagggaagaaaaaagagagaaacggtgtctcatgcacaaaaccggatcggcgcaggcaccaagactcaggaaacgagagaaatcagcgttggggcaactcattgtttcttctgtccggatttttctcaagctcctgatcttctatgcctgttcggtactactactctgtagattgatgttgatctttgggtatatgtattgatgagtgccacaattgatccttctctattcatatgacatgcaaagagtcattaaattttcttgtctataaaaactgctatagacactatgcattggagaggtagtgtctacatacatttattattgtttctgttgtctagacactatctatagacaccatgggttaggattgcccttacagtcagcacgcaacatagaacatgccgccatccatcacatatgtactgcattttggggctgctcttgattatgtatgatatgcttagtgatgagctgccttggagatgttacgagctcctgtactcataccaatggcccccaagagatcaatgtccatgaaataacccaaggttgtagacagcgaccacaactcgaattctctatttatgccgcataattccatcagattgtttcatactggctaaattatttttttagcatttttacgttatttgattgcacaaccatttattgtacaagaccatgcaccgggaatcgctgcgggaggaagattggaagcgagcgtggcacctttgtagagcgaggactccggagaagggaattgggatttcggttttcctacttagggctactgttggatcttttttttacataaaacttaaaagaaaacttgattgggaacaaagacgggattctgttgtgcattctcttagatgcgagaggttataagtgtataaaaataagcacttggattgtctatgccacgtgattccgtcaggttttttcatacatgcattttgggttgcacttagttttttttcccatttttcagatattagattgcacttattgtcgcctggaaagaagttggctaatgatctannnnnnnnnnnnnnnnnnnnnnnnnnnnnnnnnnnnnnnnnnnnnnnnnnn

SEQ ID NO: 25283 - DNA, 1545 bp, Oryza sativa
ttttttacataaaacttaaaagaaaacttgattgggaacaaagacgggattctgttgtgcattcttttagatgcgagaggttataagtgtataaaaataagcacttggattgtctatgccacgtgattccgtcaggttttttcatacatgcattttgggttgcacttagttttttttcccatttttcagatattagattgcacttattgtcgcctggaaagaagttggctaatgatctactacgctgcagagttagctgaacacgatgaaagatgattgaacttactactcatcaacatggtgccttgaacccttttgcccaagaacagctacagtggttacatgaaaagaaataaatctgcaaccttagtttcatgttacaactattgcaaaacatttattgaaatttacacatgaagaatggaaaaaatataatatgcgcatgcttaattacattccatgggcagtttcactcttgtgttctatatataaaagttgaaaaaaatactaataacatcctgacgaagggagggcccaagcatagttatatgaatatttgtgactaaacttgggtatttaaaggacaccgaaatgataaactttgcagtaatcattagtcatatgaacagacagattttcgtgtctcggtggaattgaaatgttgagaacttaatgcccacctaattaccatgtgtttggcttcaatgccttggcactgccacttttattactcatccttgctacagttaagtatactagctagctaggagactagagtgatgatatatagttatagaggggaaaatttgtaaagagtggaaataaaccaacaaccaatttactcgggaaaacacttctggtccaaaaatggttcaattttagttggtatagatatgatataaaagaaaatacgttgtgaatggtaggacacgggaagaagtatgttgttagggatgaaggggcactaatcgattggccattatcaccagtagcaaagcaacttgaagttacagtcagcacacaacaaacaatcagtcacgtatgtaccgcatgttggatctgtctggattatctgtgctgccttggtccttggagatgctacgaaatcatcgtcacatccgattggcagaacagaagatgaaggcccaacccaacaccacatctcaaaagctcagcaggataaacattggaatatcgaaatgttttaccctattacactggttgcttctaaaaaaaagtgtggaacatcagtttgtgttaaaactgttccaaaaacacttcatgaataggaagatgatcttgtgtgcataccttccttaaggcgtcaatgtttagttccatacataaaaaaattaaaaaaaatacacaaaacatccagatgaatggccttactaaagcatattttaaagacacgaaactgacaaactttggagtaatcgataatttcatatatatggacagctgtcagctagagaaatttttgtgtcttcttgaaattgatatgtttagaacttggtgcagaacgaattaataattaccatgtgt

SEQ ID NO: 25284 - DNA, 5658 bp, Oryza sativa
  unsure (1)..(5658): unsure at all n locations
tttcgtaaagcccatttcacggttctgcaacaatcttcattggtggctccttacattgaggagcacttggctctagttcgtgccagaaacatcggtaagtccgatgcatggattacacggcatcacattgatactttctccgcttggctgcgacaacatctcatgggtaacgagacgattaaccaacaaccagccttcctagcgaggggaccatctggctcgatcacgacaatccaaggatatgaaatcaatgggtacacattctacacgagagcctaagacctgaagagcacgaaccagaacagtcctgttcgtattgatgccatgggacacgatggtacaactggcacgtattatagtaccatcgaggacatatgggaacttgactatggacctctcaaggtccctctgttccggtgccaatgggttaggttgcctggtggaggcgtaacgattgatgacagtgggatgacaacggttgaccttaacaaggttggatactcggacgaaccttttgtccttgccaatgatgtaacgcaagttttttacgtcaaggacatgtctagcaaaggaaaaaggggcaaagggcctgacgagccgaagcaccacatggttctcccaagaaaaagaaaaatcgtcggagtagaggacaagactgacgaggattacgatcagtttgatgggcaaccccctttcacggtgacgattgaccctagcatcctcctatcaaatgacgacattccttactcacgtagcgatcacaagaaagaaacaatagtgaggagaaaatatgtgcggtcaaccgtcaccggcgatgtattgccgtaattgttgtgtacacgatgtaaactattttggatgtattgaatatccatacaaatcaattgttgtatggcatatgttaattatgtatgatcattacaatttttatcaaattgaaatcatctatatgctagttatatatgattattagaatttttaaaagttttaaatcatgcatgaggtatttacatatgtaattagaatttttaacaatttaatatcatgcatatgctaattatatatgattattagaatttttattaattttaaatcatgcatgtggtatttacatatgttaattagaatttttaacaatttaatatcatgcatatgctaattatatatgattattagaatttttaacaattttaaatcattcgtgtgcttattacatattatccacttagtttactacatacaacaataatttttcgaaggttttgtcattaatttttcgactttaaataattgtaatgcattatttactattttagaaacacatatgtaatgaaattcgaaattcagtgctattatctttagtcccagttcttaaccctaaccgggtttaaaaagaatttggaaatagcgggaagatatctttgctcccggatgttctcaccaaccgggactaaagatctaggggtataaatattcccggtacgtcctcgtcttctccaccaacacttagaagtttttcctccaatcgatctcggcttctccttcgccgccactgcctagggaaaccccgcaccaacgccgccatcatctctcaccgtcgtctcgcggtcctcgtcgcctccaccgccgacgcatctcttgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgttcacgcaactgccacggcgacgatgcgacacgccctgccacgccgccttgagctcgncacgccgtcgcgccacaccgncgcgacgccacgccgccgccgcggnatgccgccgggtcgcccgacgccgncggaacgcgcgccccgacaccgccggacacgccaccaccgggccgccacgacgccgttccgcttcgcgccactgtcgcgcgccccgacattgccgaacgtgaacgaatgtgaacgaacgtgattgaaaacgtgacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtggagttttaatattacgcttagcaaatatgacaaatgacttaccaaatatttcttgtatgaacagatggctgatcgcgatgaggaacatatactgtacgatacaatcgcagagggaagcagccagtattggaacgaagaagaggggaacgaggatccaaaccagtacttgaacgaggagaggaacatggagagggatgcggaggggaactaggaggggaacgaggaggaggaggctagtggaagtcatccctccgctggacagaagagggcacgcggacaacgaggtgccatgaagaagatagagggtcggcacatcataactgaggtggacgaagacggccgaccaagtgccccggcagaagcagccaagaattttgtatgccacagcggttgggttgtgagggataacgtgcctgtcagcatggtgtactggcgcagaacaagggcacgagggggtaatgacagctttgtctcggaatcagagaaagagatgctgtggaccacaatgctcgagacgttcacgctccctgcgggtacggagaacatagtgaaacagtggactcttaagaaaatggctaaacagttccagagcttcaagggagatctctacaagaaatacatcctgaagggactaataccgaacttcgacgtattcccaaagctaagagattattgggacgagtttgttgcttagaagacagggcaacaagggcaagcgatgatggttagaaacaaagaaaatgccaccaagaagaagtaccatcaccacttggggtgaggcggctatagcatcgcaatgccgaagtgggaggagatggaggcaagattgattgagaggggtatcgaaccggccaccgctaaatggccggatcgatcgaagttctggtactatactcacggtggaacgcttaacccagttgatggctcccttgtcttcagcgatcagatacgagggaaaggcgtgattccctggaagattggattcaaggaggacatccacacgtacaggagtcggatgaggagcaagagagataccgaggtgaagattgcaaatcttcagaacagggtatcgagttacgagctcagcatgcaagaggaggtggcaaggaagatggatgaatgcatggccgcacatcggtcccaggatccccagccgtacattcctcctgcaatggtcagcccattaggcaatcatagtagttgcgcctcaacggggtaggtaggatcacagagcatggacgccatgcaaacccaggacgaaaccacttgccccgttgatgagatcacgcaacggacaccatgtgagctacatattcccttcaagaacttatcaatcaaggtatgctcatagttttatgatttttgacttgtacattccgcaagttgctgcttaggttgattactaatagataacctctcatcacatgaaggtggcgtcgggaatggccatcccaacgaacatttcagggacttaccactgcaggccgattccagcaggatactcgagggtcgaagttgaactggtggaagccgcgtacaaggacctcgagttggactacctaggaggagacggtgagacgcatctatgaaacacaagccatgccattatactatggcgcaagcggtacatcatcctccttgggcgacaagcgacgtctcgtgcaccatctcctctggctccgccatctcctcctgcaccatctcctccggttcctccgccaagtcctcctgcaaaatctcctccggctcatccgccacctcctcctgcaccatctcctccggctcctccgcctcctccacctccaccgtgtcctcctgcacctcccaagacaaggtctcgccaagctccaccgtctacccgcacaagggcaacgaagaaggcgaaagttgacgccaccaaaaacaaggagccgtcgtacgattacagttaagaggagcttgatgcttatgtggcaggagaagtgaagaggcaactcaagcctcggagtcctgaaaagaagatacctattgacccgagcgtgaagaacttcttcaagggaatgcccacaacaaataaggaggcgttaaagatatcggactatgaccgaacacttcagaaagcctatcacaagaagtccaaaccagtcccttagcttggagaacaaccaaaccaagaggtcaagccgttggtgaccggcgaagattttggcataacggtgtaactgtggatcagctgattggaggcacaccaatcccgaaggcggaagtagcatacaagtttgagctcggtaaaccgcttgtcacgcctgagcagcagcagtccctaccgacacagatgtacaaattccatgaatggtacatggaaatgagcgccaagggtagagagatgttcggagcgaggattagaaactccgacttcttgcaaggaggagatgttctctggatccatttcaaggatgtcttcgatctgtaccatctacacgccctcgtcgtctctcttctgagcgcatggatttcgtaagtatctttgagttcgatttgtttcgttcaataactagctccttgcatatatgtaaacaataataatttcattttttcgttgtag

SEQ ID NO: 25285 - DNA, 4095 bp, Oryza sativa
ccagagtgagtttttattgtcgttcgaacaaatttcattcccatacatatagcatgtacattttcatatatatctcatctcacgcatattccagattccactggtcctgttattctttgacttggacgcatgcagagtcactgtgtatgactcaatgaataaagaggagaagatttttgacaaggtcttccaaccgatagacaggtaatataatgccatctattccaaagtcgcggggattctattgctattatgttgatctcgggtaataattaattaatcatagcttgtagctgcatatgtagggcttgggatcgattccgtcaattggtccgcgggacttggaaagaaaaacttggacggaggtttcattttccagtgagtacatgcatgatccaaaattatattgaattgaatctctaattacagttaatataaagagtatattaaatctcccatcatttctcatgtagtgtgcaaagcaggacaagggaactaacttatgcggctactacgtatgcgagtatgccaactgcctatcaaaccaaatatgcaccagacaagagctcgatgtacgtatacataaaccattcaaaatttcattgcgtatcgatttgttaagttgtttattaatttcatatattgatatttcattatttttcgaatgatagcgtattcacatgaggaataatctcccacacaaggattttatcacagctgttcaagaacaactaatgggattgatcaacgaagaagtccttaatcccgatggtgaattctactacgacagatcgacaattcataacgtcggtccttcctcttctgacataacgccggcatcgaagtcatagctatagctagcgagcaaatgaattgtactatatatatgcatatgtacacatttactttagtgttaatatatgtatttatacatatacacatatgcacatatatatatgtattatatatatatatacatatatatatatatatgagttggataatatgaacctaggttcatttgcaccctagtttgttgaatgacacgtgtgctattcaggttagtagatgatggactattgtttctaaacttggtagtaaatgtacctactcaattcaatctcttataggggaaaaatgagggaggtacaccatcggtcatgtcttttcacacatccataaattgtgaccatgtcttttcaccatgtgaccattgtacattagaaagagagagaggtcattctattttaatctattcccttgcagtattcacattaatccacatggaggcctactatttgctatcaggttagacataagtacgttgatttctttaattaatctagttgtttgtgtcaagttttatttgtccattcaccacccaaatatgatgttcacaaaaatgacatttcagaaatatcgttttgcaactgtgatgtccaaaaaatgctattgcaaaatgatatatcatttttagtagaataaaaaaaccacatgattgttacttttacagatatatgccatattctaaaatataattttgttataatcgacatagatatatatcaagatgaatgtccactcagctccccaaacatgatatttgcaaaaaaaaaaagatgacactttgcaaagtaatgtccaaaaaatgatatagctaattggtataccacttagcatttattaaaataaaaaaatcatatgaatgatattctaccgatttatgctatatcgcaaaaatctaattttgttataaactacataataaatagtgtctgggagacataatatcatgtgggccatcaactaaagtatccaaattttggtgacttaatgacggttggtcaattgtagtatgatactagtatccattgccaaatcaatttgagcagtaagtgcatatgtcttgctagccgaacaaccatgtgtatgctaattgtaattaagagaattgataacaactctcgacatgcaaaatcaattagaacagctaactagcagtgttaagtcactcaaatatacaaatatatttgtaaattatgatgttaatttgctctctctggaaggagcagagagttgttgagtctttcagaataaatactacatgcatgtcccaatcagtgctacagcgtattgtgtacctccctattcttttcctctacagtaatcattcatttgatgaatgattggtatatttggtcaacacgaatcttgacacacatgtatggctcagattctaggtacatatgaaccttggttcatatatgatttatatatataatcaatcttgcagcaaacaaggccatgcaaataaaaaaaatggtacaccgatctttagtcccgattggtaacacaaaccgggactaaagatggttcgtccggccacgtggctgaccgatctttagtcccggttggtaacacgaaccgggactaaagattgatctttagtcccggttatttcacccgggaataaagatagctatctttagtctcggaaccggattcgtagtcccggttggacaaccgggactacaaacggtttctcaaccagtgaatgatgattatacctctccgcacatatcttttttttttataattctccttcatgtttctctactacgctaactagcatagtacttagggcgagaaaaaaaatatcatgattaattttatttaaaatagtaagaaatgtttaactttagcacaccgttgagcacaaactactgttaggtgatagttgaatagcaaccaaaatacggtaaaaaaaatcatcgcgtacttacttctctagtttataatatctaatatgtctcctaaaaataaaaaaaaatatatatagtgccttcatcaaccaaaacaattgtgccgtagtcccgtagagatagtaattactatgaacatctcgcaatataagtaataataactcacaaagctgttcactcaatctcctatctcagccaatcaactcttgtagtttagaacaaaaggaaattagcacagttctccgtcttatttatgtttaagatgcgctattaaccatagatggctataggatgagattgattacagaagtttatggtgtttgcataaaaaaatggtaaatatccaacactctatagtgaaaggtaccctacaaaagatatttaagtattgataaaggcatttagatagaaagggtaaaaagataatttgctaatagataaacaatggtaggattgtcttttgttattagttgcacgtacatcggtaccagtaattattccccatcttcattctcagtacacttttatgtcattctcatatttacatggttctttcaaatttatatttttttaaagaaaacatgaagtgttaaaatatatgaatgaatttttgtatggtcattctaaaatttacatcgtttaaaatatgaccgaatcctacttggccgggccttgccttgctgccgccggttgcctgctagatgccgccgcgcccaacccagctgcatcgatcttgccgtcgccatgcccaacccagatgcttgctgccgctgcgcctagctgtttgctgccgtcgaggcaccgacgctccggtcgcgcagcctagtttcctgccagctgccgtcgcccgcccatgcctccttggagcttgctgccgctggccgtcgcacgccgccacaccgagattgtcccgattgttgccctcgacatgagtcctgaccatagatggggaaaggggaattggggagctagggttttcagcctaaaaccagtcaacattttgatccaaatcaacatgactaaatcactgatttaaatatttgcgtatatagagcaggtacttttttatgatgagtttactagttaattatttcattcccattggatacaataattttctttggtatcttgcctctatcttaatcaatagtctatattgttcatctctcgctacctccacgtaccatataagcaccgtaaaatgttaaatatatgatccgaattttgggcccataatatattcggattagtttcctagtacgacttcttttctatcctattaggtgtctttcttttatcgatcctatagagtcgacctgtaagcatgcacggg

SEQ ID NO: 25286 - DNA, 779 bp, Oryza sativa
accatacttctaagataaagattttagatattatttatagctaaagtttttaaagtttgaccatagccttgtccgagaagtattaacaactcggagagagtaataagttatggtacatgcaaatgatacttggtaagttgggcaatgagtagatcattgaaaatagaatgctttgtatggagtgatttaatactcttggtccctccttaaggacaggaaaatttctctttacaaattacaattctgcacatttctcatggaaaatgtatatagtaatatacttttgatgtttttgaacattttcccatggaaagttggttctttgaatataattgtagagcctgagttttcactagcagaaaaggctgtcagctcatcactacgccagttcacttcaatttccctactaaatcatactgaaccggcagtgtattactaggcagttcatggcttgaatgggcagagccatgtatcactgccggttcaagccatgaatctgcaatgagagggggaagtatcattgtaggttcatgacatgaacctacagtacagtttctccatgaatcggtaacacaaactatggtccggactagcgtatctattgagtgttgaaccagtagcgatactcaaataatagtttaataaaaaaataatatgtttatacaaagtaacatgaaaacaaactttatatcaaaattatagagctcaatgagatctaaaaccatgccattgacaatgtttcacgttagatcgttacataccccgatatatggtataaa

SEQ ID NO: 25287 - DNA, 4052 bp, Oryza sativa
tttttattcatgtggaaattgctacggccaccaaagcttgtgtaccaggaagattacagatctacgctacgtgcacacagaaagtacacctaggttttgcgtttttgcttggtttaccctaatttcttactagcaaattcatgattaattcccatggcaagtttgaagtatgatctaccgcttctggaccgagacacaagattctcactttggcaagtgaagatgcgagctgttcttgcacaacaagaccttgatgatgcgctttctagatttgacaagaggacacaggattggtccgtcaatgagaagaaaagggatcgtaaggctatgtcatatattcatcttcaactatctaacaatgttttgcaggagatgcttaaggaggagacagccgttgggctgtggttgaagctggaacagatatgcatgaccaaggatctgaccagtgagatgcacctgaagcaaaagttatttttgcacaacttgcaagatgatgagtccgtgatggatcatctctccactttcaaggaaagtgttgctgaccttgagtctatggaggtaaagtatgatgaagaggatttaggccttattttattgtgttcattgcctagctcatatgcaaacttcagggatactattcttaattgccgtgatactctaactttgaaaaaagtttatgatgctttgcatgccaaagaaaagatgaagatggtaccctctaaaggttcaaattcacaagcagaaagcttggatgttcggggcaggcaacaggagaagaacagaaagaaccaatcaagagataaaagctcaagtagctaccatgggagatcaaagtccagaggcaggtataagtcatgcaaatactgcaagagagatggacatgatatctctgagtgttggaagctacaggacaaagacaaaagaaccggaaagtatataccaaaaggtaaagccgcagttgttactgatgagaagtctgatgtagaattgcttgttgcttatgctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattatctaattccgatgctactaatctttggcatatgcgttttgggcatatgagcgaaaatggtttggcagaattgagcaagcgaggattgctagatggacaaagcatcgggaagctcaaattttgtgagctttgcatctttggcaagcataaaagggtgaagttcaacacatctacacatactgctgaaggtattcttgattatgtgcattctaatttatgggggcatgctcgtaagacatctttcgaggtgctcgttacatgatgactatcgttgatgattattagcgaaaagtttggccttatttcttgaagcacaaatatcaagcttttgatgtgtttaaagagtggaaaacaatggttggaaagacaaactgaaaggaaggtgaaaatccttcgtactgacaatgggatggagttatgttctaagatatttaaatcatattgcaagtctgaaggcattgtgcgtcattacaccgttcctcacacacctcacaaaacagcgtagctgagcgtatgaacaggataattatatcaaaggcccgttgtatgttgtctaatgcaggtttgcctaaacagttttgggcggaagccgtttccactgcttgttatcttatcaatcgatcacccagttatgccattgataagaagactccaattgaggtatggtctggttcccccgcaaattattcagacctaagagtatttggttgtactgcttatgctcatgttaataatggtaaattggagcctagagctattaagtgcatttttcttggttatccatctggtgtgaaaggctataagttatggtgtcttgaaactaaaaaggttgtgattagaagaaatgttgtcttccatgaatcagttatgttacatgacaaaccttctactaatgttcctgttgagagtcaggagaaagcaagtgtgcaggtggagcacttgattagttcagggcatgcaccagaaaaagaagatgttgctattaaccaagatgcacctgtttttgaagattcagattcttctactgttcagtagtctccaaaacgttctattgcaaaagattagcccaaaagaaatactaaacctcctcaaagatatattgaagaagcgaatatagttgcttatgctttgagtgtggcggaagaaattgaaggtaataccgaaccttctacatattctgaggctattgtttctgatgattgcaatagatggataactactatgcatgatgagatggagtcacttgaaatgaatcatacttgggaattgatgaagttaccaaaggagaagaaacctatccgttgcaagtggatcttcaaaagaaaggaaggtatatctccaagtgatgaggcaaggtacaaagcaaggttagttgctaaaggttatagccagattccaggtattgattttaatgatgtcttttcccctgttgtgaagcatagttcaattcgcactttactcagtattgttgcaatgcatgattatgaactagagtaaatggatgttaaaactgcatttttacatagggagttagaagaggacatttttatggagcaacctgaaggttttgttgttcctagaaaagagaacctagtctgtaggttgaagaaatctctttataggttaaagcagtcacctagacaatggtataagagatttgactctttcatgctttctcagaagtttagaagatccaattataatagctgtgtttatctcaaagttgttgatggttcagctatatatttgcttcgttatgtcgatgatatgttgattgctgcaaaagacaaatcagagatagcaaagttgaaggcacaattgagtagtgaatttgagatgaaggatttgggtgcagcgaagaaaattctcggtatggaaattactagagaaagacattctgtcaagttatatcttagttagaaaggttatatcgaaaaaagtttttcgtcatttcaatatgcatgatgcaaaaccagtgagtactcctttagctgcacatttcagattatcttcagatttatgaccaaagtcagattatgatgttgagtacatgtctagagttccatattcaagtgcagttggttcacttatgtatgccatggtatgttctcgtcctggcttatcatatgcattgagtgttgtcagtagatacatggctaatcctggcaaagagcattggaaagttgttcaatggttcagatacctacgtggtacatctagtgcttgtttgcagtttgggatatctacagatggacttgttggttatgtggattcagattttgctggagatttggataggagaagatcgcttacaggttatattttcactattggaggatgtgccgttagttggaaggcaagtttgcaagccactgttgccttatctactactgaagcagagtatatggctatttctgaagcttgtaaagaagctatttggcttagaggtttgtacactgagctttgtggagttacgtcttgtgttgatatattttgtaatagtcaaagtgcaatatgccttacaaaggatcagatgtttcatgagagaacaaagcatattgatgtgagatatcactttattcgaggtgtgattgctgaaggtgatgtcaaggtatgcaagagaagtacgtatgataaccc

SEQ ID NO: 25288 - DNA, 673 bp, Oryza sativa
  unsure (1)..(673): unsure at all n locations
gagataaaagttcaagtaggtaccatggcagatcaaagtccagaggcaggtataagtcatccaatatgcaagagagatggacatgatatttctgagtgttggaagctacaggacaaagacaaaagaaccggaaagtatataccaaaaggtaaagccgcagttgttattgatgagaagtctgatgtagaattgcttgttgcttatgctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattatnnnnnnnnnnnnnnnnnnnnnnnnnnnnnnnnnnnnnnnnnnnnnnnnnnnnnnnnn

SEQ ID NO: 25289 - DNA, 6792 bp, Oryza sativa
gggggttgaatagtaggaaaaactaaaaaccaaaaaacttttagcggaaataaaagttaccctcaaatcaacgaaaatctcgacagtcctgtcgtcgccggtcggaccgtttgcacgccaccgatctaaccgccgccttgtcgccggttgaaccgcctccctgccgcgagtgtgaccgctatactcgatgaaacacaaatcgaaaaactctcaaagtagatgacaactttattgcttctctttgtgtttacaaagtgcaataacagcactccttacaaaaatctcgactaaactcgaaaccctaactaaaccatcaactcaattgctctccaaaacgataccgggaagtcttacgctccctctttatttataccgtaaaaatctcctactcaaagtaggtgtagaactcctattcacaataggactcgatcaatcccttaatttcttttttctccaaaactgcagccgcaccgaagtcgaactcctcctgccgcgatgctgttgcttgctgcatgaagccgactcggcttgcctatgcatggatcaagccttgccatcgaccaggacaccatccatccaaaccaatctcagctccacatgtatatgcatgcatgctagccaaccagctgcacacagtacacatacacactacatactagcatgcatgcacgcatcgatcacacatacatgcatgtactgcatactactactccaaatttcctcaaccaatttcattcacgaacaccgacgcttgtcctcatacctcgtgaagcccgttgcggatatctctcccacacgatatccatccatcgtatgccatctcgtatccaacttcgtcacccggtatccttaaccgtctggacctcaactcctccctgagtctagtcccgatccccaccgttgaccaaagttgatcttcaagaatcctgactctagtcaccttctcacatggtatcccgaccgcactagacctctgttcctccctgaacatattccggtcctcaccattgaccaaggctgacctcaagtcacctgcacacaatcagataaaccaaccgtttctgggcacagatatcacaacctgacccacattagtcacacgcactcacaccaacatccacacaaaccaattcattgaataaatcatttgtaaagccaattgttcatcacaaatattaatcttgacaatgatttcagtatatacttaatttgtctaccggtcaatacaattctttctactgtagtgtgggagcgtataagcgtatagaaaaagcacgagtgatatttgtatgtccagttgctcctctcatgaaaatctaccggactagtgtcgtcaatcagttaccaaaataaccaaaattgtttgcctctacaacgagtttttttctgttttctattgttttgaaatataggaaggtacagtttgtatgtattgattgagatacagagagtaaaaaattagaagagaaagtgggcagagcctgtaggccagttgaaaagaaaaatatgttaccctacattaaaagaagtatcgattcacgcagtgtacataaatacatctcaaccaatgcccctctttatgctcccctaccaagaatgcccaattctgagcttgtttgtgcttgttgcctatgctgcaactagttttttgttgttgttgttttcttttgttttgaatgttaggaaggtacagtttgtatatgtattgatagagagatcacacagaaaaaaattacaagagagagtgggcagagcctgatggcctagttgaaaagaaaaatatgttactcttccctagtccctacattacatctcagtcaatccccaatttatcttcccctactaagaatacccaattctgaaacctctaatccattacaaacatgaaaggttcgtttttagtatatatagatagtagtacctccgttttaggttataagactttctagcattacccacattcatatatatgtgttagaaagtcttataacctgaaacggaggaagtagaaaagaaaatggattgtgaatgggaggacatgggaagaagtctgtcactatggattctttagctctagttccttcgccattagaaccatcaaccaaacagtctctagctacagtccgcaggtacacaacgtacaacgagcctccatttcacaattttttgatacacaacgtgctcttatgtctgtgaaagtatacgtgtataaaatgaagcactcagattgtcaatgccgcatggttccgtcaggttttaattccatacttattggattgcagtcagattgttttctttttttgaattttcctgattcggatttcacaacaagttattgtggattacccagtaagaagctggccaatgtgtacatacttcaaataccaagttttgtttcatgatctactacactgtaaatttatcagagcaagatgaagatgattgaagttagtaccgagaaacattgctgctttcaaacatttttttcctagaccactggttactttttaaaaaaatgtggaacctcagttttatgttacaactgttccaaaaccctgtgtgaaatttagacaaaaagaatgtgaaaatataagagtttagcaagaaaaagttggtatgtataaccttttcctatctgatatgcatatcttctatgaggtgccactgttgcgttccatatgaaaaagctaataaaaatacagaaaagattccaactcaagtagctacctagcgtgggggaaaaaatgttggaatggaaacatgatctagacacgattgatttgcttcaacagacaactgttcttttctatgccctgaccaggactcttcttcttccccatccagggagacagtcgatcagaattacacagcaaccatggattaattactacatttctgaagtgtaggtaggaattatgataggaatgggaggatccaggaaggaaaacgacagccaccggttattttggtgagccatcaagcttcttggttagaaatgatctaaagtttcaggggaaattcaaggaaccttcgcaggtgtgtcatgcggctgaggctatggtaactacttgtttgaaatactcaaatcactatacactgcatgctgatcatcaattggaagatcataacaagagaagggagcgaggaaaaaccaaatggtggcaggtgttacgttgatgcaggctgggagaatgaattaactcgagttggaatcttgcttcatataccttagagcaaggataataatacatttgacctgttagctataagtttttttagttttctcttagcctacacatataatagttagttctttacgattaataaagggctcacttgtctttctcacggagtttcttggttcttgtgtccaagccggctgtaagtttacagcccacttttcttctctctcctctcttttctcctacacctcagcatttagccggcttatagcctactattatacttgctcttatagaaagaagagatatttttggagaacgaaaataactaccatgtgcttgtcttcagtgcatttggcactgccattttttagtactcatcctgcaggcttcaattgaggagctagctaggagcctaggagtgttgatatatagctacgtgttggaaagttgtttggagtgcagataaaaagacagacattccaacttctgatgaaaacacaatccaatttcttcgagagaaagactatcgcatcccaatatgatgatttgcttcaacacacaactgttgtatataaaccctgaccagggcacttcttccacacacagaaaatcgatcacagcgtcaaattcttaacgcaatcacgctagaatcatgaatgaattaagtactattacatttctgaagtttgggtaggaatgggaggatacaggaaggaaaactgcactgcactggatttcagtactactctccaaaactagctatcctaggatgagtcaccaggtaattaaattaaatgagccatcaaacttctaggtgtgaccatgtgaactgttttgggcgtgttcggaggagattgttctggctgcacagcgcagcggctgcaacacgctcagtaaatttagtgctgcttgcactgttggtaactaggtacagacagcttcagccccagatgagcatgtttgtcttcaatgccaaagcacatactagatttttccggaagacccacatcctttgtacaattagtagttcgatgcaagcattttcaacaacttttttcccatcctgtactcaccatatgcgtgtcaaactctcaaggtttccccccagccagaactatgaaatatccgattaacttttattgcatgctgcattagaaatgtgaggatacaggaagagatttatagcacactggtgtatccctaacagtagcaatataattaacatgtcacaagtcacaactccatccttatagctccttttcatcagatgctcccacacagattgtccgatccagactgcagccgcgattgcaacttcgcatttaaaatggcagtaggagatttttaagtagctgtccatatccactgctccatcaatctataacaccccaaaaataaaaagaaatgacatatcggttttcagcttcagcttatagaaaaaaaaaagaagttgggggcagaaattaagggaaaaacaatttacatatggactagtacactaagcaatcgtaggccgaggccctactaaggccctgtttgtttcagcttaagattgttgtaatctagattattaaatcagattactataagctggattatgataagctggcataaaataatctacgagttgtttgtttctctggattattagaggcatctaagggtagtgggtctttagccacttaataatctgaaaaaagctcctctagagaagattattggattatagtaatctcgtttatagattataataatctagcataataatctacttgtttgtttcagcttactcctaataatacagattataataatcctaagctgaatcaaatagggtcttagttgcatctccacctacaactttagaggtcaaccaaatcgtgcctcctcccctagatctcctacaccacagcgttactcaagagagaaggcggtagaaaggaaacaaggaggaagaggattgttgctcttgttataccagttgtttgagagcattttgatggtttaattcgtggttaaggatgcatacatataataagcggtttggtcgttctgattcggattgagttctgcgcacaagcagacttatatagttcctctgttattttttttatgattaggtggtcaaaacgattttcattttcaaaaaaaaaacatataactagaaaccttgttgatatcatcgaggccgagccattagtaaagtcatagttgttttagtttttttttcttaatatacagatagaccctagcgtttgtaaaaacctagctatttcaagtactgcgaattagggaatctaaatggcataataataatgtggtctctacatgaatgttataggtcttgtacggtagatttcaaatatgttaaggtctcttaggttatgtacatttaaaaattttgacaatttgaccctttgcaaaaactatttttacaaataaaccgctgccaaaacttatttcaaatctgacccttttgctcaacgccaaatcatatggcgctgaacttagacacctcaacgccaaatagcatggtggacaaaccatctttcgtcggtcggccgaattccacaatagtcccggatgcaataaaaaccggggctaaagatgatctttagtcccggttaaaaagggtaatgggcatatttgatctttagtcccggtttgtatcatctttagtcccggttcaaatgctgtcagggcctgtcaggccccctaggatctttagggactaaagatcgtaactttagtctaccaaccgggactaaagatctcggggatctttagccccggttggtaacaccaaccgggactaaagtcccacccctatatatatgtcttcttcctcctccagctgcccgagcaagcttcaaaatttcttcaaaaaagaggggaggtcatgccaaaatttctagtgaatttattttggtgaatacatacaaatctgaggtgcctaaaaggtttgcaacttcatcctccaatgttttttttttgtcatattacatttgcagctatgttttgcagacttttttgtctccaaaatttagttgtaagttgatgagggagaaaatttgtgtggggaagaaagaatatatagaaatttagttgatttgctaaagaaggttttataaaatagttgagagggaaaactatagtgaaagttaatcttgaatactagaaaacaaactaaaatgaaaattaaaagaagtaaaacacattaaaattagtttaaaactttagaaatagtaaataataattatttgctgtaatattttatgatttttgtatgaataaagatatgtcattattgtatgactgttgaaacagtttgtaattatcttataattattgtatgactgtcattgttgtaagaataattatttttgtacgattttttttgactcatgtagatggatcagcaatggatgtacgctgaccggtggtccaaagagtttattgacggcgtgcactattttttgagagtggccgaagctaacaggcaaaggggttttatttgttgtccatgtaataagtgtaagaatcagaaggagtattttgcatccagaactattcatttccacttgtttgagtcggggttcatgctaag

SEQ ID NO: 25290 - DNA, 981 bp, Oryza sativa
gtcaagaacattctccgaagggaaacaattgcaaaagacaacgtcgaggttaagaaaatagtttgcccgctagacttagaagttcaaaagattcacgcatgtccgaatgattgtatcttatatcgcggtgaggagtatgagaacctagaagcatgccttgtttgcaaaacactatgataaaagattagccgagcgatccaggagaagttgacggacagctacaaagaagagaattcctgctaaggtgatgtggtatttccctataataccacggataaggcgtttgttcaggaacaagcggaatgctagaatgatgcgatggcacgctgaagagcgtcaacaggacgggatgctgagacaccccgccgatggttcgcagtggcaaaacatagacaaaaaatttaaagaatttggaaaggactcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgatgtgtacctaagaccactggtcgaagatcttaagctgttatggaagaaggaaggtgtccccgtgtgggacgaggacaaacaggaggagtttaacatacgagcgctgctgttcgtaaccatcaacgattggcctgcacttagcaacctatccggacagtccaacaaggggtacaaggcttgcactcactgtatggatgaaacagaaagtacatatcttaagcactgtaggaaggttgtatacatgggtcatcgtcgattcattgcagcaaaccacccggtacggaagaaaggcaagcacttcgaacataagcctaaacatcgcaacgggaaaacagtgtttgctatggttaaagatcttaaagtagtgttcgt

SEQ ID NO: 25291 - DNA, 912 bp, Oryza sativa
aactacgacaagtagcgtatcatattcctcaacaattttctctcgttcccatgatcaaccctgggaactttacgattatgcttcaatccaaaatggcccatttataatactccctccgtttctaaatgtttgacaccattgagtttttagcacatgtttaaccattcgtcttattcaaaaacttttgtgaaatatgtaaaactatatgtatacatataagtatatttaccaatgaatcaaatgatagaaaaataattaataattaattaatttttttgaataagataaacggtcaaacatatttaaaaaattcaacggcgtcaaatatttaaaaacatagggagtatatgtaggatcgtaaagggcctttcccaccccaaaagctagccattgaggtgacaggcttccccagttatatcttagctcatttgccctttcacaaccaaaagctattcaacaatctcccccttcacacattggtgtccctcggcccttcaccaccccttcaccgtgtatagaccccacagaacaggcccacggtccatcaggtatacgagccccgcagacacccacggtccatcagaccttcacactctgtgtccatcgggctagagatgttaacctagccaggctctgaaccacttgtaggatcgaacacaagcaaccaagcctaccagaggggggttgaatagtaggaaaaactaaaaaccaaaaaacttttagcggaaataaaagttaccctcaaatcaacgaaaatctcgacagtcctgtcgtcgccggtcggaccgtttgcacgccaccgatctaaccgccgccttgtcgccggttgaaccgcctccctgccgcgagtgtgaccgctatactcgatgaaacacaaatcgaaaaactctcaaagtagatgacaactttatt

SEQ ID NO: 25292 - DNA, 744 bp, Oryza sativa
ctctcgccattattccccttgtcttcgccgcttgcgccctaactccttgtttcctatgccctaccttcgccacacgcgctcgctctcaaacatctcttcttccggcgtcatggcacggggctccgctccgcttgacggtagcgtgctgccgccttcccgcatcgtgagcgagagacaggccgggctgccgtgccgcttcatgccggaatctgccaccggccgggaaatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggcttcgacgccgtcctcgaccgcctggcgggcctgcgatcccaggggct

SEQ ID NO: 25293 - DNA, 1049 bp, Oryza sativa
  unsure (1)..(1049): unsure at all n locations
annnnnnnnnnnnnnnnnnnnnnnnnnnnnnnnnnnnnnnnnnnnnnnnnnnnnnngatcccctaattattttccattgttaaatatacttttatgtatacatatagttttacatatttcataaaagtttttaaataagacgaatagtcaaacatgtttacaaaaatcaacggcgtcaaacatttagggaaggagggagtaccacgcattcaataaactacatttttgcgatgtccgtcaaccaatcacatgatttttacttgtcatgtagtgaatatgccgtgttattattgtccaaaacaacgagaattattataaaaccggtgggagtatccaaacttatttttcagagtgtaacagccctatatgcttattacaagctcaactggctatcgacaacatgtcacgatagccattattagttcagtgtgcaagccgttcgtccgcaagctcgtgcagccccaccggcgaacacgcgaggatgacgcgtcccaacgcctccgcttcggccaccaccggcgcgcacgcaacccacgcccaccgctccacgccgccgccctccaccccgccccgccggagctcgtagaggacggcgcccgtcgccggcacggccgcattgtacacgtacccaccggcggtgttgccgcacaccccgatcgacggcgacgacgtctcctcctcgccgtcgtcgccgtgcgggaacagcctctcggacatctcgctcggcatcgtgtcgtgcgccgccgccgcgccatgggacagggagaggctgtcgccgtccacctcccatgatcggatgacgactcggctgtctgcatgcttcactccgaacaggatgatcttctcggcgccggcgcggccggcggcgaggccccatgtggagacggtggcgtcagggcggaggcgggaggtgggtccccactgctgcttcgccgggtcgaaccagctcgccgtccccgtggctctgtccgcgacgtacactctctgatccgnnnnnnnnnnnnnnnnnnnnnnnnnnnnnnnnnnnnnnnnnnnnnnnnnnnnnnnnn

SEQ ID NO: 25294 - DNA, 1739 bp, Oryza sativa
  unsure (1)..(1739): unsure at all n locations
agtcagctagacatgcttggttggacgtcttgttttggcgactttgctaccaaaccaagtacactcacctttttatctcaaaaacaaacaagtacactcattttgatgagtcttggcgtacgattcctagatagccctccctttccctttattttctctaaatggttttccttctttttgtgagttctcgtgttctttatcgagaatatttttcttcttttattcagatctttttatatcctttctttttgtgagggtttgtactttctttcctgaatatttgttccgttttctttttcttatttttgtggggacttgtgtggactttcttttaattatttcataatttttacgaggacttgtttggtctttccacctagttctgtcagcgttactttgatcattttttttcttgattttatttgtctggatctaaattttctcccgccacctcataccaccatatcttgctctaattgtttgacttaaggctaataagacgtgacaaaatataaataaaagaataaaaaatattttatgaatggaaattttatactttgttttttaaaatatggcgttccttaacttttcggtatatgtttgaagataaaaattgtaagtcatgctcactttaatgaaaatcaattcacaactgtcggatcgcacaaaaagaactaagctaaccagagggagcttgaatggttggagtagcaaaaattgtaacttttaacggaattaaaagtaacctttgttttgatggagatcggtttgaccggaatagatacgccggtctgaccgatgtagtagcttcgatctaaccgtccgatattgctatcgtcgcctgtcgccgcaaccgttctgaccgccgtggagtcgtcggtttgactgccgatgttccgcgggttagaaaactgcacctaggaaaataaaaatccaggatctctctttattacttttattcatgtttacaaaacacaacaacataaacacctgaaaccttaacttttctctaaactcaactcttacaaaattgatattggaaggtttcaactcctctaattatacccaaggtagatagcctaaagccacgaaccagcggcggattcatcgttggggctccacccccagttccagccggccatatatagcccatatgtaacaagtatctatccgcatccatccagtacgtgctctagtgagtcatcacgtagctggttagctagggaagcactactgcctgcctttggtcatatatatttatctaactggttgctttattgaaagtgcaaccaaataaaaaatgaaaaaaaagaacatggaaccatttttcatatatatatttacagccaactatagctatcatacctagtatatttttattctttattttgagttctttctcgtacaaatcagaaatttgattcacaatagattggttgtgcccctccgtcccataaaaaaccaattctaagtacgaatctgaatacacgcgtgtccagatttgttgtcaggattggtctttttagatggagtagtatagtttactagctttaggccctattgtttgagatttagagttttattttggtattttttgtgggcgtgcttgtcaaaccgctaaactttctgatttttcaaaacagatcttataaagaagtttcatcaaaaatcaaattttaaagttnnnnnnnnnnnnnnnnnnnnnnnnnnnnnnnnnnnnnnnnnnnnnnnnnnnnnnn

SEQ ID NO: 25295 - DNA, 1550 bp, Oryza sativa
acaaatcagaaatttgattcccaatagatttggttgtgcccctccgtcccataaaaaaccaattctaagtacgaatctgaatacacgcgtgtccagatttgttgtcaggattggtctttttagatggagtagtatagtttactagctttaggccctattgtttgagatttagagttttattttggtattttttgtgggcgtgcttgtcaaaccgctaaactttctgatttttcaaaacagatcttataaagaagtttcatcaaaaatcaaattttaaagtttataatagtcagcgcttaagtaatcatacgttaatagcttgtctgataagctagacgactgctctcccgaaactctcatttgaacaaagcaccccctctattttcatcctagattcgccactgccacgaacccaactttccgtacagtaaacaaattttacaaactccaatcacaccaaatttggacttaccaaatttgactccgcatccatacgcacacaatatctccatcgtatgccgtatggaatcttcaccaaccacgaggattgatttgtagtctaagcatcctgcaagatatcctaatcgtcagaatgttatcttctcccaagttgactcacgatccatcacaagcaacggtcccccgaaacatcaagacacacctacacatgaatgatacaagaaaccatattcgagcataaattgtctccaacttgactcagcattatcacaacaatattacatacgtataaaaatcatctagaagtcatagacatgaattaattacgagtatccaaataaacaacttaaacagaaaccaacatagagccgcccgaacaaactgttgggtcggttggtctaatggagtctgacgagcctagcctatccggtttgaccggtcacatatatagtcaacaacccacttcactaattgtctccaaatatcaaaacccaaatatgtcaaatgccaatcgttaatcacaaagtaataatcaatcacactttattttacaacaacaaaaaaaattcatttaaggatctttgagcatgacttataatcttttatgtttgcagaaaaattttgaataacacgtataatcaaacatattttaaaaagtcaatggcatcatatattgaaaaggaggtagtatatgtttaagtatcaatgctacaaaataaattatgatgcaaaaaaaaatcctaaaactaggtttcagtatttaaattttaaacattaagagggaaggaacagtggtatggtggtagagtcaatgacatcatatattgaaaaggaggtagtatatgtttaagtatcaatgctacaaaataaattatgatgcaaaaataatcctaaaactaggtttcagtatttaaattttaagcattaagagggaaggaacagtggtatggtggtagagttctatgtacatgattccacccaccttagtttatattcttgtgtccataaatattatgtatatgtagatgaggaattttactgtcattgagagttatatttcaagcacaacaaaagttttgagtgcaaatttt

SEQ ID NO: 25296 - DNA, 2788 bp, Oryza sativa
aaaaaatgatttacctcagaagttaaggatatgccagtattttcggtctgtttaaacatgtgttagagacacgttcgtaatgacgtgagcgtgatgttaggtgcatgtacaatgctgtttgtgcacacctgccatatttaatcgaaaataacttatgatgacgatgagaggcacacgacctcatgccgctggtgctcctcccaatccccatcgtctccaacgccaccatatcccactcaacacgatcgccccgcctgcaacccaatcacacccacctccgtcttcctcttcccgccatttccaattcgagctcgcttcctcttccagccatttccagttctggggcggccactgcggccaccgttggtggcgcatcgagccgacgtacgcaaaagtccgcgcgcaatggccccgcgctgggcgcctgatgagttcacgacgcgacggcgacggcgacggcgagccccgaacaggagctgtccgcgtttgttgcctgcgatctcttgcgatcttgggaagatgataacgtcgtcttcttcgccataatgcggacaatctaaaagagaggcgagtttggcagatgggacgacacgagagaattgaagagaagggggaaaaattacacagaaggacccgtcgaatcagataaggtgatcgccactgacctgtggccaatagggtgtcgccacacactactacgagctatcaatgtcagataattgatagatactactccgtcccaatatgctttaatgcatcaccaatagcatcttcaaatttcacactctaaatatctatttcacaaacttgctagagaaactagagagcctaatttatctttaatttgcttacaccacacagatggattttcaaccccttgagggtgcgttctgttgtttcgtgcatgctacttgaataatcatatttttttaaaaaaacaaaaataaataatataagatatatcacttcataaatatgcactgttaaattcgacttctatgagtaataacaaaaataatcaattaaaccgaaactagctagttaacatatctccatacactaccactgaaaaggtcattggtgccggttgggaacgctacaaagatgacgatttttcaaaccgacgccaccaaggcggcactgattagaatactaatagatatacgaattgaaaaaaaaaatccaggtcgggtcaatttgagccgagcggatgcatcaaaggaaccaaaaaacatccaaaaatctacaacaatcaacaatcaacaacaacaacacatcagcagcacacaatcaacaatatgtccgcccaatctggcggaggggaacccgatgctgtcgcccatgggagcccgccgccgccgcccgctgctgcccccgcttgagagagagagagagagacgcgtcagaggaggagagggggggggggcgagtggataaagacgccacctcacctcccactcagcgttttatccccgtccaaaaaaaagaaaaaaaaagcccgtttcttggctcggctcgtttgataggttgtcggtttttctaaaaaaactggtacctttaatacactatagatgtcagtttttaattaaataacagctataatatataagatatcggcacctatagtgtaggtggcggttcttctgtaaaaccgacatctatagtgtattaaaggtaccggttttactttttttttcatcttttgaagggggaaaagcactatggatgtcagttttatctgttctggcacctatagcaccgacttatatgtggtagttatatttgttacaacgagtgaaaatcaaatttaatctaaacttgcgaagcagtttgctcgctgcaccgaagatcgctacgaagtttgctttctggtggagtttcatgcttctcagtggaatatttgctgcagtagaaaaggccttgaggtcatctcattgtatgtctaaaaaaacaaattcacactcctaattttcatgtagaaatagcgattgaagccagaggcttcaggaagaaaaaccacactggatcaaacactgggtcaagtatatctattggtggaagaaaatcctgttgaacgacaacacctacacgcactggatgaatagggtactgcaatacgtaccacacccagttgtacaactagagatatgcaatcatagatcaattaaagaaaagaatattcatatgaactatagtcgtttataaccgttgatcaaatttccgtacatgagtcgaacagttggattgtatgcatggtgatttccggatgaataatatctctagtagctcagatgggaacattagcccttgtttcaaacaataggaaggaatgaatatatcgttacttgttctatgaaactagttgacatgcaactgctattagctagttggcctccatttaaatttgacaatccaccgcgctctctcaggaaaatgctcatgcatgttttgtctattgtccaagcttgaaaatgtgtataatttcattttgaaaaactagtagacatccgcattataggcccatttcctgggccatttaggttttggcctatgtggcccatgagagttttgtgtgtatggttaataccacatttctaatttatattggcaaggttgtaaccaatttataagagctaatactttcatacgaagcgaggacaaaagtataagtgtagtgatatgtgtaaatgggtctgtccatcggatgggctgggctgcacagttttggaaggcattttttacataaaatggacaattttcgatacacgccaacctcatcaacctaaac

SEQ ID NO: 25297 - DNA, 3396 bp, Oryza sativa
catcaacctaaaccggatatgatcatatgacgatcctggttggaacacttaatggacaattatgatcatatgacgagaaccggatatagtcatatgatgatcctggctcgaacacttactgggcaattatgatcatatgataatcaagcagataacttaatatgatcatatgacgatcttggttggaacacttagtgggtaattatgattatatgacgatcctggttggaacacttaatggacaatttcgatacatgccattttctttcatagagaaccggatatgatcatttgacaatcctagttggaacacttaatggaaaattctgatacacgccattttctttcattttcttccatccccggacgccattttctttcatagagagaaccatatatgatcatatgatgatcctagttagaacacttagtggacgattttgatacgcgccattttctttcattttcttccatccccaaacgttcatcaacgtcatcaaatagagaaccggatatgatcatatgacgatcttgtttgacgatcctggttggaacacttccagcattgtctgatgaggtctaacgggagtttgtgagtccaactcagatgttttttttcttttcatacttgggtccatgttttttcgagtcctaattaattttgcgagctacgaggacatagaaaaggtttgctattggttgaccggccccttcataagggctgtcacaagttctagccaacagagtcgttctttaacataacatatctactttttaccgtaagttttgcactatctcatccatcttcagtagtttgcacttaagttatctgttctcctttggaagtgcaaatctctttgcaggtctgtcctgaaaacttttcgtttcgctcacacgataagtgtctatctccaatttatatatggtagccggtttttatctctttttcatcttgatcaggagttttttaacttcaagatggattatgactccatacacaccacaaggctcgtgaagaggatcctcgtgttggaggtaaaatacgaacactatgtgtcaagtcatgggagtgggtcaaagggcctagatcatatgttgtttgctttgagattattactacacatgccagaaagatgggtgagctaatttggccgaagaaatgacagatgtgtagtgtgtaattctcttccatggtattcctagttaatatttctatcaaccatagctatcaattaatgttaactagtatcctctccatcccaaattgatcatcatatatgtttatgcaccaagacaaaggagaatttaaatcgcatccatcaatacaccatgcaaacattctcccacaatgcgtgcatcaattaaaacactatgccaattataccctagcatacacacattctcccatgatgcattaattgtattatgataaaacccgtatccatgcggttatatgatgatcaatttaagaaattttggattccattatatgatgatcaatttgggaagaaggaagtacatgcatataacttttttcatcaacaccaagaaagatttaactgccacataaattgtatttaatgtaagtttatgatggggaagaatcagaaacaagcccctaaggccattcccaacccaagacactagacatagtttccataaactccacatcatcaagaaactagtactagacactactcttccaatgtaaacaccactattccatacttaaattgacggagcttggggctcctcaccgggagaccgcgcaggcccccctttgccggttcggccgggggccctgggtgagattctaagctcctggtctgtggaaagttcgcgagagtggaaacacacaagacacgggcgatgtatacaggttcgggccgctgagaagcgtaataccctactcctgtgttttggtggatctgtatatgaagaagctacaaagtgcgagccagcccccgattgttctgggatcctttttcctcccccctctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccggtctcaaatcggtcattcttgtccaccacgtgtcagtttaacaatctgcatgctcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcgggagcggtccgaccccctcggggagataaagaggagggcgaacacatcaccctcgggcccgacgccccccgagggtgccaggccacgtaggcgattgtgtctgcctcaagcctctagtcatgatactcccggtcccatgtcaccgacataaatttaatgctacttatctcacatgatgtcttggatgttgtgtagaacccatctgttaggcaagacatggttttcttctctttcctcatttattcacttgccacatcctttttcattctaggtggcagcttatttaatgctatggacatcatcctaattattgggttaggaatagcctaagtatccctaaatgtctgcatgcatacatgcatacttaattctcatgtatagatgcaataatggtacacgccaaactaagggacaatggttatgtgatgataaatttggattttttttatttttggttatatgcttattaatatgaattggagaaagtactacttaacatcaattatgcgttggtgggagaactgtttcgagacaacctagaagaaacaagtttttgttatagtataaaaatgaaaatgcgcagtacgacaagaaaaaatattaatgtggcagaaccatggtcaacctaatttgatttcattcaactcagaattactctctctctctctctctatgtatcactcaagcacgcggggggggggggggggggg

SEQ ID NO: 25298 - DNA, 4348 bp, Oryza sativa
  unsure (1)..(4348): unsure at all n locations
ggggggggggggttggtgcagcactgtagtagcaaatttttttctcaagctatattatagtaaattataatgttttcatgtattatcaccatcaatggttcaacataagtaacaatggagttaggttaataatatcgagtagaatacttccttttattttagtcatgaatatttagtgtctaggataatacattcagtcaaaattgtatgttttgaccataaaatttctgaaatacttaactaaaaaataaaataaatggtcgatttgtctggaaaattataatcatccttgagctttatcatgcctaatatgcttacttttttttgcatttctagtattaaccagagttttttttaaagaaattctccataaatgcacatctcatttttagtcatgcaacaatatttagataaaataaaagacagtaactatacatactatcctaccatggttacattgcatcacagcatgtatatatttttttctctccaacgacaactattatcacacaattcaaaacttatctttcaccggagttcttccaatgaatcaaattaacttgtaaagaattagaaaaggagaagaaaagatagaggagactgcaaactgcaatgtaactcatggacaaaaagaaaggacaaagacatgcgtgcatacagctgtactcataaataactgcagactgcaacataactcatgctgtgtttatgggccgctcgtgtgtctcctgtggtctggtttctgatgtagggggtacactaagctgggagaaggggggtgcccatacggtaagtaagggtgttaagcactaatttttcttttttagccgggtgcccaggaaccccgcaggctgtacttagcttcgagcctctcaagcactgatgcactcaccatctcaaattatcaatgcatcaaccgtacaacaatgaatccatgctattagaaagtttaggaagaaattgctataggaatgagaggcatcggtaagaaaagtagcactagatcaagaatatctctcagcgcagggataacctattgatgagcaatgattttagcttggaggtctgtgcgaagtatctcaaatgccaatgttagctgttctttcgctcaacagcctacagttgtctcttcaagttgcgctcactgtttccacccattttaaaatgctagaaaagtaaataatgacatcactagctcaaatataatcatggataccttatgtattcatcaaacgaaggtgtatattttccatttgagatttacgcgttatatttgtgaacataaattattgctcttttagattttgttttgttgaattttaggttgcatcatcgtgtcgagtgttggtttagttttagatttaattttttgttttgagtcaggtatttttaggtttgagtttgccgcttagtctgtactttgacggtagtatttcatgttagtgagtttaggtccaattttgtaagaatctgtttttgtcgggaccatggaaaattgaacatgttgttgtcggttttttgtttttatagtttgcataaatttatgtcggttagttttggagttacattgttagagtttgtctgtcttatcgtgcttgtttgtgcacctagattagattagagaagttatcctccatcgcgtcaaggcttaccttgctccacttggttggcccaatttagtgtcgatccgacgtaggttatgatgatagtctttatgttttacagtgaccaaattttggtttacataaacggtacattgtagttgagtcactatataacttttgtcttttacatttgagtctctgtaatattcatatttacttttgagtccctagtcgaagttcattgataagtaataattgaaaaaaagataaaaaagagaaaaggtaaaatggtgctaacaagccgcaccaataaaaggcaaaaaagggaaaagaataaaaaaagaaaaagaaaagaaaacaattatctttttagtatgtttggggagtgcaaagttgttctttgagttgtttctaggatttagtgttgtcgggtgcttacttgagctagagctcaatatagtattttcaactattattcaactttgtatttactgattagcacaaatgcttttccttgctactatatattatgcccccaagctacacatacatattttttgtcatcacagttttaaccttgcaattgttagatcacatcctcaaggtatcattatcaggcatcggttgtaccatccctacctttgctggtaagaacattgttagagcacggtaagacacttctatttgcgagttccatcacccttgttcttatgtattgtttactgttttctactaacaacggcaggttatatcactcatcgacacgagataatgttggatgggagacaaaccacagttggtatgtcaccttctacaattgaagttaatgtaagaattttggtgcaaaaagtgctaaattttcaaatcgagaaagcagagcaaaagcattgccacaatttattttaaataggtttatggttaacgatagagcatatcatgttacaatcgataatgataatggtaatgatagtgatgctacatttactcaaggtatgcatagttatgatgcgctaaatatgtccactacttacgctatattagagtatccaatagtgaaaacaattactaaaatatctttatcacaaaaaaatttgcttgttgttttaggtaacgacgaagaagagatgtgtgatgcttcacttatatccatgccacaactagtaaatgaacatgttaattctatgcttgaaccaccatatattgagtttaaacatgttattcacatttttagagagaatgaagagcttaaatcgttatcttcttcaaatacatggggctatattcaatttgaaaatctttgtcaattgaactgtttagagaagaatttagttgctagatctgaattgccacagccatctaatatgatttttaacgttattggaaattatgatagtaaaggataatataatatacatcgagtatatatttgttcaaatttgaatgtatttcgttttcatgatgagatgtattgtccggaggaccgcatccatataagtaattctctatctagattctctagatatttaaatgagttaagttgaatttcaagaatgggagtactgtggttttcccgagtataaaaatttcagaatccaaccatttgaccatgacgaagactacctcgcctgatgcttttgtagataaaaaaaaacatcaactggcacaaaaaggtgaaactgagaacggtttccaatcttgaaggggatgacgatgatggcatcactagctcagatataaccatgcataccttatgtattcaccaagcaaaggtgcattctttttatgtgagatttactttaacacagattatttcatgtcgtgggctaagctaaagggatggacgccctaaggctaaccctaggacgtcactaatcatatttattcattagcaatcaggttttgctaagattattttggcaatacaatttttccactagtttggtttgtggaaccccaaattagagtgcttaatcattgatttgcaaattaagttgtaatctatcgtgtttttacttgtgtttttcaattcgcaagcaggaattaggcttctcgatgaggtcaattgagtttcgatacgattgataactagagaagtcatggtgcttcgattgtggggtttggatcgtgtgtgtcaactatccgctaaatcaagaattatcaatagctatcgaaagctcgggacctagttccccatcagttacgtaattatttatcatcctggaacagctgccaccacatgcatgccaccacaacatgactacccccaatctgtgtttacccgtcatgatctcatatcatgttacccgtcttgttaggtgtgacatcctagcctaattagaatgaggcctgtgtagcccatgcgagctgtgcgtgcatatttactaccacctttctagtttagcaagtatggaactaacttataaggcctcagtccctccaaccatgccactcccgagttaacccttttacacgaagcgaggacgtaatgtgtagtaagtgggctcgtccgtcggatgggctggctacgcggttctggatggagggctattacattaggttattaagatgaaacaagttgagatgagataaacagtactattattattcttgtggaaacactaaaaagttgcgtgcagaataaaagtgtcatcgtcctgattcgattttcttcagtacagaactgnnnnnnnnnnnnnnnnnnnnnnnnnnnnnnnnnnnnnnnnnnnnnnnnnnnnnnnnnnnnn

SEQ ID NO: 25299 - DNA, 3206 bp, Oryza sativa
gtaattatttatcatcctggaacagctgccaccacatgcatgccaccacaacatgactacccccaatctgtgtttacccgtcatgatctcatatcatgttacccgtcttgttaggtgtgacatcctagcctaattagaatgaggcctgtgtagcccatgcgagctgtgcgtgcatatttactaccacctttctagtttagcaagtatggaactaacttataaggcctcagtccctccaaccatgccactcccgagttaacccttttacacgaagcgaggacgtaatgtgtagtaagtgggctcgtccgtcggatgggctggctacgcggttctggatggagggctattacattaggttattaagatgaaacaagttgagatgagataaacagtactattattattcttgtggaaacactaaaaagttgcgtgcagaataaaagtgtcatcgtcctgattcgattttcttcagtacagaactgaactacatattctgcacctcaaattatcagtgcatcttcaattcctacctactggttttcatctctgtatcatcttggttgatagtagggctggagattagattggtttctttgacatcacctcttttctataaagctaatgtgctaaatcatcattctcaaatcattttcatgatattttcaatccaatcatttcatcatttagttattactacacacgtccaaaaaaggatgagataaaacaaaggaccaatgtgatgtgcaggtttgttccatgcatggcatctttatctatctattatatactaaaagtccattaaatttcctacaaacactctcaagctgtcacgtggcgctcttacaaacgctcctagaccgccatgtgccacaatctaatctcaccgtcgattttcgcttaaattggtggacccgttattaaaaaataataacctcctcatgtttataacatataggcgtactactgctgatctttccatacgtacaaacttacattatctttcctaatcttgctggaaaaaaaacgtacacatgaatataaaaaaagatagaaaaaacatatatccataaaaatcaatggtttttaaaatatgattttagataaaatatattagttcacaaatataaacatatttagttaaatatatataaatatccaatcaatgttctttaaaccatattctaaatctatctaataaatattaaaagtacattaaatttctacaaatgcttttacaccactacgtggatctcaaataaattagagaaatcctagaaatctattatatactaaaactctattaaacttcctgaacgctcctacgttatcacgtgacgctctaatttagagttgttgtagaaatttagagtaaaaaaaagaaaagcatccaaccttcaattttcacttagatttgtggaaaattattttaaacattagattagagttcttaaaagtcccatgttgctaatctctatcccggaaaaaacataacgtgcttacgtcagtaccattgtctccctaccgggaaaaaaaactttaataccgacaccatatatgataaaaaaataaagccaaaaaataaaaaagaaaacatgcacacatacatagtagaatcgaaaagaaatactaacaagaaaaaatcatcgatgttggcacatatttgttgtcaacagcctttaatctatgattttaagatcttcctccccaatctaatattatagtcccggtgtagatagaaatttctttatggtctaattccgagtggtagtaaataccatgagttagcaatattttcattgataataatttggtatattccatttattataaaggttgctaaggaattcctatcaattatagggatgcttccaatagaaatggtttgcttatgcacatcgaaaccaaaaattaatcgtgcggatatgtagaattttaaagaataggtgagtgattcatacacagcatccctttcttttatcgaaggttctagcaattgatatcgggattttttacttaaatctaagatccattcttatcacattagtagtatattaaaatccaccatctattttacggtaaatatatttctttttttattgtaggataatctaaatttccttagtcatgtatgattcttttagcattttttaatatcaaataagatgcttgtgcatcggtgcgaaattcctttctaatttatattccggaaatgttctccagtttatattatattgttatagtgtttgaaacacaaactatacatgcccacgcattttacttcctagttcctaattaatacttctatctatcgtaactatcaattaactacaaatcgctaggacaagcatatgagtgatgacgggtaggttggagtgtaccgtttcgtgatgtaaaaatgagaaacagttttctttgttcaactattctaataaaaaactacagttacttggacaaaaatgttcacagcctaatttcttttccatcaattcataataactactctatatatacctcgccgttcttttgtacagcccaaacgttaaccatcacaaattctcaatgcatccaacctacaaagattaattcacttgtaattttgaggaagaaattgccataggaaccagaggcttcaggaagaaaaacaggactggatcgacaatatcccgtaatgggtagaaaacctcttgaacagcaatgattttagcctggagattcaaaacaacaaatcgaggctgactctgccatatgccaagtttccttctgttcacaagttgattacctggagttgtggtagaacagttctaagtgcagcacttcatttacaactaggaaataagagacttcgtttaataaacaatttgaagattgatcgagcttgcaacaccaacaggaggaatactctgtctgggagagctagggtccagtcttgctgtgaaactgcttggtgaactccacgaaatgtttgtcttccatccatgaaacacaatttagtttcgtattatcgcgaggagaacaaaaaccatgattctcaatttttaataatggaaaattgttgaccttttctccattctctgcagtgtgtgcatactgtctgattattttgactagaaaataaagtggaatgaaatctataacagggcaaaccattgaacattaactaaaggaaaatagtattgatctttctgataggagctatattacctgta

SEQ ID NO: 25300 - DNA, 4941 bp, Oryza sativa
cttactgctaaatcactggtggagaaaccatctttcgtcggtcggccgaattccacaatagtcccggttgcaataaaaaccgggactaaagacgttaaaaagggtaacgagcatatttgatctttagtcccagttggtaaagatcatctttagtcccggtttcgtaactttagtcccggttggtgttaccaaccgggactaaagtctcacccatatatatatatatatatatatatatatgtcttcttcctccttcagcccgagcaagcttcaaaattttttaaaaaaagaggggaggtcatgccaaaatttctagtgaatttattttggtgattatatacaaattggaggtgcctaaaaggttagcaacttcatcctccaatgtttttttgtcatattacatttggagcaatattttgcacattttttgtctccaaaattttgttgtaagttgatgagagagaaaatttgtgtggggaagaaagaacatatagaaatttagtttatttgctaataaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatacgtcattattgtatgactgttgaaagagtttgtaattattttatcattattgtatgactgtcattattgtacgaataattatttgagtatgatttttttttcatttcatgtagatggatcagtaatggatgtacgctgaccggcggtccaaagagtttactgacggcgtgcattattttttgagagtggccgaagctaataggcataagggttttatttgttgtccatgcaataagtgtaagaatcagaaggagtattctgcatccagaactattcatttccacttgtttaagtcggggttcatgctaagctataactgttggacatcccacggagagcaagtggttgaaatggaagaagatgaagtgaaagacgacaatattttggattttgctcagtacgctggatttgaaggaaatcaaacggatgaggaggaaagggatgctgatggtaacgacgttgcagatgatcttggtcagatgttgcaggacgccaaggaggactgtgaaagtgaaaagggggcccataaattggacaagatgttagaggaccacagaacgtcgttgtacccaggttgcgagcaggggcacaaaaaattggataccactctggagttcttgcaatggaagacaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcgcggtgaggagtacgagaacctagaagcatgccttgtttgtaaagcactaagatacaagattagacgagatgatccagaagaagttgacgggcagctaacgaagaagagaattcctgctaaggtgatgtggtatttccctataatactacggctaaggcgtttgttcagtaacaaagggaatgctagaatgatgcgttagcacgctgaagagcgtcaataggatgggatgctgagacaccccgccgatggttcgcagtggcgaaacatcgacagaaaatttaaagactttggaaagaacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattactcaaggccccaagcaacctggtaacgacatcgatgtgtacctaagaccactagtcgaagatcttaaactgctgtggaagaaggaaggagtccctgtgtgggacgaggacaaacaggaggagtttaacccacgagcgctgttgttcgtaaccatcaacgattagcctgcacttaccaatctttccgggcagtccaacaaggggtacaaggcttgcactcactgtatggatgaaacagaaagtacgtatcttaagcactgtaggaaggttgtgtacatgcgtcatcatcgattccttgctgcaaaccacctggtacggaagaaaggcaagcactttgaacataaggcggaccaccgtacgaagcctaaacatcgcagcgggaaaacagtgtttgctatggtgaaagatcttaaagtagtgtttggaaaggggcctggaagccagcctatagagagcgaagatggtcacgcggcgatgtggaaaaagaactctatattttgggacttaccctattgggaattcttggacgtcagccatgccatcgacatgatgcaccttactaagaacctttgcgtaaacctttttggcttcctaggtgtatacagaaagtcgaaagatacactggaagcacgtaatgatctgatgcatatggaacaacgcggcgaccttcaccaggaaccaaaggagaaaggaagccattacttgagtccagccagctacactcttagcaaggtagagaaggaaagtatgtttgaattcttggagagcataaacgtaccgtctggatactccatgaatatcaagcgaataataagcacgaaggagaagaagttcacaaacctaaagactcatgactgtcacgtgttgatgacacagctgctaccagttgtaataaggggtatccttccagacaatgtccgggcaacaataacaaagctatgtgcattcatgaacgcaatttcgcagaagatcatcgatccggatagattagaagcccttcagaatgatgtggtgcaatgtctcatcagttttgagttgatatttctaccttcatttttcaatataatgacgcatctgctttgtcaccttgtgaaagagatcagtattctcgggcctgtgtacctacacaacatgtttcctttcgagaggtacatgagcgttctgaagaagtatgttcgtaaccgtgctcgtccagaggcaagcatcgccaagggttatggaacaaaggaggtcatcgaattttgcgtagaatttattgaagatcttcgcccaatcggggtacctgaatcacgccatgaaggcagactacggggaaagggaactctcggaaggaaagcaataatgacggtagacaacaattattccgtaaggcccatttcacggttctacaacactcttcattggtagctccatacatcgaggagcacttggctttagttcgcgccaggaacatcggtaagtccgaagcatggattatacggcatcacattgatactttccccgcgtggctacgacaacatctcatgggtaacgagtcgatcaaccaacaacttgtcttcttggcgaggggaccgtctgggtcgatcacgacattccagggatatgagatcaatgggtatacattctacacgagagcccaagacatgatgagcacgaaccaaaacagcgttgttcgtgtcgatgccatgggacacgatggaacaactggctcgtattacggtgccatcgaggacatatgggaacttgactatggtcctctcaaggtccctctgttccagtgccaatgggttaggttgactggtggaggagtaatgattgatgacagtgggatgacaacggttgaccttaacaaggttggatactcggacgaaccttttgtccttgccaatgatgtaacgcaagtctttttcgtgaaggatgtgtctagaaaaggaaagaagggcagagggcctgacgagcctaagcgtcacgtggttctcccaggcaaaagaaaaatcgttggagtagaggacaagactgacaaggattatgatcagttggatgggcaaccccctttcacggtgacgattgaccctagcatgctcctatcaaatgaagacaccccttactcacgtagcgatcacaaggagggaacaatagtgaggagaaagtacgtgcggtcaaccgtcaccgccgatgtaaactattttggatgtattgattatccatataaatcaattgatgtatggcatatgttaattacgcacaattattagaggttttaacaagtttaaatcatgtatatgctagttatatgcgatacttacaatttttaaaagttttaaatcacgcaggtggcaatttcatatgttagttagagtttttaacatttaatttactatcattcatatgctaattataattgactagagaatttttaaaagtttcaaatcatgcatgtggcatttacatatgttaattagagtttttcacaatttaatttactatcatttatatgctaattatatatgactattcgaatttttaaaatttttaaatcatgcatgtggcatttacatatgttaattagagtttttaacaattaatttaatataattcctatgctaagtatatatgatgattacaatttttattaattttaaatcatgccgtatgtatatacatatgttaattagagtttttaccaatttaataatatcattcatatgctaagtatatatgattattagaatttttattaattttaaatcatatatttgcttattacgttttatccacttaatttattacagacaacaataagttttcgaagtaattgtcattaatctttgtactttaaataattgtaatgcattatcttctattttagaaacacatatgtaatggaaaataatattcagtgcgcttatcagtagtcccggttcttaaccctaaccgggtttaaaaagaatttggaaatagcgggaaaagatctttagtcccggttgagg

SEQ ID NO: 25301 - DNA, 3179 bp, Oryza sativa
ccgggactaaagatctagggctatatatattcccgatgcgcgccctcgtcttctccaccagcacttagaagtttttacccgatcgatctctctcggcttctccttcgccgccactgcctagggcatccccgcgccgacgccgccgccgtatctcgccgtcgtctcgcgctcgtcgtcgtcgccgccacctccgcctcctccgcccccgccgcatctctggggtgagagccgccgcgcgccgcctccctctcgatctctctctccgatctcgatctctctctctccctctcggttgccgccggccgacgagttttagacgccgacgccgacctcgtcacgacacgacgccgcgccacgacgacgccgcacaccgccgccgcgccacgccgatgccgcgcgcggcgccacgccgccgccgcgccacaccgccgtcctgctgccgccacaccgagaacgtgaacgagcgaacgaacgtgaacgagaacaaggtgaatgaacgttaacgagaacgagcgaacgaacatgaacgagccaacgaacgtgaatgagaacgagcgaacgaacgtgaacgagaacaaggtgaatgaacgtgaacgagaacgagcgaacgaacgtgaacgagccaacgaacgtgaatgagaacgggcaaacgaacatgaacaagaacaaggtgaatgaacgtgaacgagaacgttttcggacgaacgtgaacgagccaacgaacgtgaacatgaaatgcaattataggcaggttaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatcttttcgtatcttgcagaaaagacgttgtcggagtcgtccctcaagccggagtggtagagctagccctcgaaggaattcgcccaggcaagtgacgtaattatatatatatgattgttatatttgtaatgcaattaagattattagatttgtaattagagttaattagcatataagattgtgtagtgttctaatatacgacagttacacttagaatacatgactatttgagttttagtataagattattggagttttaatataagattattatatttgtaattagacttagtatataattattgactagctagggtcctataatatacgtcacctagacttagcatatatcactatttaaggtttagtataagattattagatttgtaattagacttagcatgtaagattgtgtagggttctaatatacgacagttacacttagcatacatggctatttttatcttagcatataagattatttgagttttaatataagattattatatttgtaattagacttagtatataattattgactagctaggttctataatatacgtcacttagtcttagcatatatcatcactatttgagttttagtataagattattatatttgtaattatacttagcatgtaagattgtgtagggttctaatatacgacagttacacttagcatacatggctatttttgttttagcatataagattatttgagttttaatataagattattatatttgtaattagacttagtatataattattgactagctagggtcctataatatacgtcacctagacttagcatatatcactatttgagttttagtataagattattagatttgtaattaaacttagcttctaagattgtgtagggttctaatatacgacagttacacttagcatacatgactgttcgtttagtcttagcatataagattatttgagttttaatataagattgttaaaacataaatgtctcatgacttagcagatgtttcctgtatgaacagagggctgatcgcgatgaggaacagatattgtatgatacaatcgcggagggaagcagccagtactggaacgaagaagaggggaacgaggatccaaaccagtatttgaacaaggaagggaacgtggagagggatgcggaggggaaccaggagaggcacgtggaaaggaatgtgaaggggaaccaggaggaggaggctagtgaaagtcaaccctccgttggacagaagagggcacgcaagcaacgaggtgccgcgaagaagcttgagggtcggcacatcataaccgaagtggaagaagatggacaacctagtgccccggcagaagccgccaagaactatgtacgtcacagcggttgggttgtgcgggataacgtgcctatcagtacggtgtactggcaaagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagagctgtacaagaaatatatcctgaaggggcagacactgaacttcgacacattcccaaagctaagggatcactgagacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctggtactatgctcacggtggaacgctcaacccagctgatggctcactggtcttcggcgatcagatacaagaggctgcgcgtcgactaacagacgcagtggaaacctcttctcagggcacgttccgaccgaacagagagagggacgagctgtcactcgccctgcagactccagagcatccaggacgaccacgagggaaaggggtgattccttggaagattgggttcaaggacatccacacgtacaggagtcggatgaggagcaagagagataccgaggcgaagattgcagatcttgagtttagggtatcgagctacgagcttagcatgcaagaggaggtggcaaggaaggttgatgaacgcatggccgcaatcggtccaatgatccccagccgaccattcctcctgcaatggtgagcctgtcaggaaagggg

SEQ ID NO: 25302 - DNA, 796 bp, Oryza sativa
atgaagcctggcatatatctggccggaaccaacgtgccatctccaggagctaacacgccggctccggctagggacgagtgcttggaggctctcgtcctgacgggatggggcgaggcgtgcgtcagaccgcctgtcgccacctaacccacgatctgaccggtctgtgactggtcacagaccggatagacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcggaaccggtccgatcccctcggggagataaagaggagggcgaacacatcaccctcgggcccgacgccccccgagggtgccaggccacgtaggtgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggtttaaaaatcgggacaagccggttcgtttttcctggagatatggtgatggcgcttcggtcggcgagcgtaattaacgcgcgcacgagatgttccatctcgactgccacagccgcatatccacctcatgcaccgcaaacgggcgaatgggattagtggaagcgtgggcgcgagaaacgagggggcaagatagtgggcgcgagaaacgaggagccgg

SEQ ID NO: 25303 - DNA, 436 bp, Oryza sativa
  unsure (1)..(436): unsure at all n locations
nnnnnnnnnnnnnnnnnnnnnnnnnnnnnnnnnnnnnnnnnnnnnnnnnnnnnnnnntgtctagtagacaattgtaccgcatcgaaattatgcggatacacaacacaagaccataaccacaaaggatctgaacccatatatatatacaggggacccccaaagaagatgaaaactaaagggtagtcgttgtccctaaagtcgtaatcctcctgcctaatcctgtacaaatcagcagaaacggagccctaattttagaatccaacggcagcggcatgcacacgtgcgggcgtacgcacgcgtgcaacatcttcttatcctgctgtgcaggtcagctacctaattaccaaatccttttgaaaatatttgtgatgatgtgatagcgttgggaccttgcttgctcatctaatctctttggaaaattattagtccggcaaag

SEQ ID NO: 25304 - DNA, 217 bp, Oryza sativa
cccccgggcgtcggcagggcggccgctccccgggcccccgtcgcggggcccataggcacgaccccctcccggggtagattgttcccccctgcggctcccgcccgcgccatcgtggcctcgaagagcccgctcctccgacgccccgaccggctgcatgatggtcaggatggaggcgcggtctggatcgctgcacagggggaggactccttgaggaatg

SEQ ID NO: 25305 - DNA, 6637 bp, Oryza sativa
gcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtcttccctacaacgcggtcctagggaggcccgcgttggtgaagttcatggcggcagtccactacgcctacctccagatgaagatgccgggccccggtggccccatctctgtccatggcgaccttaaagtcgcgcttgcttgtatggagcagcgcgcggaccacctcaccgccgcgtcaacccgagggaggcgacgagaggcttggcacctccgcccccgcccccccgaggcagcggatagtcacatgcgacgaggtcccggtcaaggaggttgccctgggcgacggcccgtccaagaccacacggatcggtggtcttctggatggcaaataggaacacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattaattacccccataggaacttattgttatacgacaatgcccttcgggttaaagaatgcaggtcctacttttcaacgtactactcgaatttctttgggtagccaaataggacgtaatgttgaggcttatgtcaatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctgacttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacaccaggagcccccgacccccaggacagccccgaggccactgtgggaaggccgcccctgtcgtcctccgaccccgaggtcgtcggcacagaagacgagtgcaccctgcgaggccgcttggacaaagagcgccccagggatgtggcccctagcgaagaggatcggccgcaccgaaaggtgcagcggcccgtctactttgttagtgaggccctccgagacgccaagacccgataccctcaggcccagaagatgctttacgctattctaatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccaaggccagctcgggcccctcgcagctgcctcacaccgcccactgggtgatgcagttcgacggctccctgtcttttcagggcgccggtgcgggggtcacgttgacctcgccgagcggagacgtcctcagatatttggttcgccttgactttcgggcgaccaataatatggcagagtacgagggactccttgcgggactcagggtgacagctggactgaggatccgccgcctcctggtgttagcagactcccagctggtcgttacccaggtctgtaaggagaaccggtgctctgacccgcagatgaacgcttacgtgcgccaagtacggcgtatggagcgccattttgacgggatagagcttcggcacgtgcccagacgggataacacggttgccgacgaactctcacggctcgcttcctcgtgagcccaaaccccaccgggcgcctttgaagaaaggcttgcccagctgtcggcgcgacccgaccccttaggggagacggacgcacctgacaggccccagatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgttacgtgctggtagaagggaccctctatcggcgcacggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcggttttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttctttctcgtctacggcgcggaagcggttctcccatccgagttcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgatggcacagagctgcctaacccgtggaacatcgaacaccttcgtcgcttctacccctaaagcggatcgggtgtcaggtttcgggctcgggccaaccccgcacccccctcgggcgtgcagggttggccgggggctaccacatatgcatattcttatttctcttatatctgtctcaataaaagcattttcgatttcctaaaggctgtatctgtgctgttgtttccttttgaaggatcttgacttgaaataggtcactcgtgttcaatcctgccctcgggggctcgggtcggctaaaatcgccaaacgaggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccaaccatttgaggactaggacctgggcacgagcccttgttcaagccaagacacaaaaggaccgcggcacaggcatcctcgtctcatacacacaacaaatataattgacacaaaaaatttcctctttatttgattgcagattaaattagtctatacaagaagggggcccgaaggcctcggaagaagaaaagaagaaactatttaaagattggcggaggcctgggggctcactccgatgcacccgggtcgccagcctcgtcgccacagtcgcccacaccaccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggccaggtaactcgccagtacgagctccaccgctcctcgggcaaggtccctcgaggatgacttaatcgtcccctcgagctcctcggggagccgctggagagtcccggccatctccgagaggcgctaggcgaggcccccctggttggcggcgtacttcacagtccgctcgccccagagacccgcctgctgccggcgcggtctaaacgggacacggtgtcgcgaagcatgctgggccctatctcgcctgccaggcgaagggcctcgacctccccggtgtacgaatccagcgcgccctgcagatccgcgatggtgtgttcggcagctgcgaggcgggcagctaagtcgctgtcgcctgtggccgccccgccgctacgcgcccttgcatccagttcccttgcctgcgcctcgagttcagcggcccgctggttcagtgcggtcctctcggcgcgggcactttccagattgcgacgcgcttgttcctcttgtgcagcctcgcggagggacaggctgtccgccagcggttgcgccgcggcctcggcctcctcgagagctcgctcccgctcggtgagcgcgtcctcgcggaggcggagcgcggactcttcttcagcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgctgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagacccccgctcttcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacagaaggcgtggggaagagccgcctcggtgaggatgccgcgcggctcggcccgccgatggacgtgccggactcagggatgtcccccggacctggcttgtcctgagcgtcgctcgagggagtgggcccaagcgatgcgcccgcggcctcgtcgcgagctacctcggaagtcgtcgccgcctcggcctggcgaagtctggcctcctcccgagcggcttcttcagcttggcgagctcggacggccacctgggcggcctcctcggcttcccgtaggcgattcgcggcttctcgccggtcagattcctgcctccgagcctctgtggtcgccgggtccttggcctcagactggccggacttggaatggcgggagggacgcgacgggatct

SEQ ID NO: 25306 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnaagaatatagaaatatcttttcctatacttctatcatacaaacatattatacataaatgctagttatatcattacttagctaataccttctttccgatgccctcctggtgctttgagaagccacccctattgtcgagttctttacgacaatccgtcatgaccatccaaccggggctaaatacggaggagtaccctccccaggaaattaacttaggcctatatacacgcgcggaggaatacccatactgagctgtcaccatcagtggcccacctcgcttccgcagcatataactccaaataatgatatccagtaatctaaacaccacacttaaattaccaaatacaactctaatatcatcatgacatagtcatcgtaaatacgatcattatgcccacatcattgcatctcccagataagctagcatcataataaatataacttggacatataataaaattagtattcatatactcggaaagtagtacaataccaaagtagtataaagaagaatattctacataaagtacaagtcttacaaaagaaggaaaagctactagnnnnnnnnnnnnnnnnnnnnnnnnnnnnnnnnnnnnnnnnn

SEQ ID NO: 25307 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnttgaggggataggtaggggacgactagggggtcctttatataggcacgggagcttgggatcaagcccacatcgacgggaaaaactcgggaaagtctagggttctcgccggaaaaaggaaaaattgaaccggaaattggaaaggatttccataaaaacttttggggatttcttggggaaaaggaagaggagattgataggattccattcccgtaactaatttggaaaaaggagcaacgaggaggccggattggtgggaggaggcggcggcagtagggcacggcacggctcggctctggctctgtctagaggttgaagaaggtactgtagtgatagggaggaaaactagactttggctgggctgagaggaagggagagagaaggggaggcaatgggctggattcggcccaagctgatgaggaggacttttatttacttttccaaataaattaaccaatgagatgatctttcaattgttaaaaatacttccaatgctcaaataattccaagaaaaatcttgaacatacttggacactcaaagtatttaatataataatatacagatcatttaatgattaatttattatttaaataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25308 - DNA, 20182 bp, Oryza sativa
  unsure (1)..(20182): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagttattactaccgactcatgatttaacaaggaaataaatttgagcaaaataaaaatgagatacgcatctccccagatggatattatctactaaaaaaaatctccccaagatggatgaagtgtattatgttgtcttactcctaataatgtctttcttttaaagtttggagatttgtatttatttgttgaggggattataaaacgggagcagtggacgggttgggtttggttgtttgggcaggccaatggatgttttttgttctaattttttgggataaacaagtgcagaaaccgatgtaagcacgggacaagtgtctgtatggtcggtggggcccaaagaacagcgaattattggggcccatgaaacgtggcctccttggagcgtgatgacgaggatactgtgccactacagtgtccgcatgttatacacatctgcagcgttggacctggccatctttccattctgcccatgattatattgctttttgaaagggaaaaaggtaaagaggagaggaaatggactaccgtctcttctttgtttaagctcaattaatcccccttggttttacaaactgtgatcaaacacaaagttcactattttttatttttattttttgcgaaacagtgaacaaatggtagcactgtctcgttgttggctcgtttaattttcagataggatcgttttgatcgcatcgagctcgagcgatccgatggcctcgtcgacgaatatatatggaattaatgccgccattttgttgttttgtggtgcggtgttgtcgtgattacgattaaacagcttatccatatttggtttttatgacgaacgaggagaggatatgtagggattatatatctgcatcttcatgcattccttgtgcgatcgacacctgatctgcatgcgtaatgaaaacctgccacgattggtacccgtctcgttcgttcttatcaactggactagccaacaaggcccacgacgaatgcatgcgtgcctaagcaggatttacgcatgcatgcaggcatgttgtataaatctttttaccgtagagagattgtctcgattaattacctggtctagatatttacgcggaaaaaaaaggcatcgaaatgtgttcagtggtgaaatgggccattggtattttttttttcttttggcacgagggagaaattaatatacggtcgatcgatcgcctgaagtcctgaactgtagcgtactccctccgaaaaaaaaataaattatgggtttccgtgtccaacgtttgaccgtgtgtcttatttaaaaaaaattatgaaaaaaattaaaaagacaagtcacgcataaagtattaatcatgttttatcatttaacaacaatgaaaatactaattataaaaaaattcatataagacggacagtcaaacgttagatacgaaaacacaaggttcgtcttttttttttatttggaacggagggagtacgcagataccagctgcagaaactcgatcgagaacttacgtcgctgcttcggaatcgccgtagaattccacctacggacgcgctcgatctactgtcagtatcaactgcgcatgcgacgtttcatcgttgatcgttcacgacgcaatgtgtacagtggcttaaaccaacgacaagtggatcgcgaacgctgctgctagcgaacagcccccgacagtgaagccgcgagcaagtcccaccaccgatcgatcgtttcatcgttcgttgcgtttccgccgttgaattgaccgcgcgcgcgggcgctgccgccgctgccgctgcttgacaagaatccgcgcgcgtgctgcactgcagccgcgcgcccacttggacgacgcggtgaatccggctgcgacttcttcccaattcccaactcccaagccggcaaaccgcgcgtttcgaacggacggcgacgacgacgaagctaagctagctccacgttttccaaactggacgcgccggcttcgcaaccggcaactcgatcgtatcgcgcttacttttctcgcattcgcagcctagctaccaacctaaaccgtatattctgcttcaattcagacgtcaacgaacacacagttccggaatctcatcgctcgatccatcgatcggctgcgcttgaacgatagtgagttagtgacagaaagctactactatatgataacaaaagcggaaagtgtgtatatatagatgtacatgcatgatgaatcaaacgaatcatgatcaccaacttgataacaaacgattattatcaaatttatcatgttaacaacgaaaaggcaggcaacggaaatggaccagctttttcatcagcagttgaggccaggaagaaaagaaatggaatatgggttggactctgcatttagaattgctctgcaaacctggctgtgggggctgaccaggcaagtggattaattgaaaaatattaattatttctatagttgcatctccatctccaatctcctcctctcgatcaaaggaccaaatacaaatgctcgtggttggttggtcactgactttagcttagatccaatgaccgcagtcttaattagctggcttgatatatcatttgtgctgtttttttttatctgggtgatagacacctcgcacctaattggaattgtttttacaccactaactaagggaggttatatatatctcatctcaacgtttattttatactggccatataggttagctagcgccatatctaatctaaattcattggctttagtttatatcaatgaatgaatgattctgacaaaaacaaatggtcgtgttcagtgtttgcgcatgatgcaagctgactccgatgaaatgtttgtttctgtacgcatgttgccgaagctagcaggctaggatcaaatctatatgtttgtttctgtacaagttgccaactactgtacgcattctacctcttgtaaattaactactttgtgcacataaacaagtgctccatacctccatacatatacgataaaaacatatatcactgtcaatctgtcatctattctgaagaggtaagccacatattttggaagtctagaatcgacgccggctgacactgcatgctgtgtataatattcttggagcatacataatacaatacgtgtacgtggaaagataaacaaaaatacacgtaaatatcgatcacaagttcacaaccaagttgttatccatatttcgacaagtacattatcccatatgtaaaaaaataaataaattaacttgcatgtttaaaatgatttatcacatattaatttaccatgttgattttttaaaatatttttataactatttgaatgacacgtaaacaacgaatgaatatacattccaggtagctgtacatcataaccggctattaaacaccaatcagttctggtcgtgctactcgtggttaatcagtcattcatttttcttgaatcgtaccaccgctcataataatgatatctttctaccacatcaacaattaaccggttattaccaatcagttcttggcgtacgtacgcgtggttaatgggttgactacgacattttgaaggtatggaaatgtggtgaaacattaattttttttacgctaactcttacacggacgacgagtcatcacgcgagatgagatgtggacgtgagaggaattgaaccgggcgcggccaggtgcaatcgcacgcatgcatgcacctgtgccgagtcgattggatgaacggcgcggtcgccatgtcatgggtgacgtacgccaccttcgatggacttcgaatgcaagaaatttacggcatgaatggaatgaaccaagaatgcacgcgcgcgtgcatgcttcttgattatgtcatcgacgacacaccacatactctatccggatctttggttattaattcctgcagctatctatctagcaatatatattttctgctatgtgtaccatataaattaagatcatctctctctcttaaaaaaacagtagtacgtgttcctgggctccttgcaaaaacagaagaagtacttcttccgtttcacaatgtaagtcattctagcatttccgacattcatattaatgttaatgaatctatacatatatatccatctagattcattaacatccatatgaatatgggtaatgctagaatgacttacattgtgaaacggaggaagtatattgttaataccggtcagggtcagcgacatatattgcctggtgaaatagtcgtgcaggtccttgggagaaatgaatcctacgagactaaaagtggataaattgatgtgtgttctgttttcataaatttgtcaattcatctgtaattttatactcccttcattctgaaatgtaaggcataaccacccttaacctaaagactaagaaaataattattatcatcttatagtttggatcatcctaacaaatacaatgcatgcatccaatagaattagagaacatgagagtggaggatttaaaaaagtactccctcctttcctaaatgtttgacgttgttgatttttttaacatgtttgaccgttcgtcttattcaaaaacttttgtgaatattattcaaaaacttgagtagtagtagtatatttaaccatgaatcaaatgatagaaaaagaattaataattacttaaattttttaaataagacaaacggtcaaatatatttaaaaaaatcaacggcgttaaatatttagggacggagggagtaataatttaatagagaaggggccatagttaattgtctatatgcatgtatgccttatagtattatggaacatctgaaaaagtggctgtgcaatggatggagtaagtatgttagttatcctaagacctaagcctatcatctactacgtgcatgcacgagaccactggtctggtctcgtatgattattttccgttcttgacagagcggcggcttcacgcaaccaattggagacggcaaaggccgtttgttgggcctcatcgattcgtccaaaatgggccaacacagataatcgtccgaaatgggctggccttcaagctcactggtgggctgggggagatgcacgtgatgggctggctcctcggctcgctcgctcccaccgaaccagtaaaacgccaaaaaaaaaaaaacagaaacggaaaaggctaatacgccattaaccacccggcgcccgcgccgcttaattccaaaaccctcctgataaaccaaacctggcgcggtacgcaccacaccatcgctacctcatcacgctcacgcgtctccctttctccgcactcctcttcgctctctctcgtgatctcgtctgatcagctccgcctccgcctcagaattcagaaatccccaaaccccaatgctgctgctgcctcgcagtcgcacggcgaatcggggataagcaccggaggagggatcggagatggaggcgccggggctcgtcgtcggatcggcgctgcgagccgcgcaaccgccaccgccacctcctctcccgcgctccccgcgtggcgctgcggatcgcctcctcatcttctcgcgggagcctcgacctcgactcgcccctctcacccggtgctactgttccaggtacttgcttgcttgcgaagttgcggttccactgcgctggcgctcacgcacccgcgcgcactcgtaacatgtggatgtgggtattcgtcaccgtggctttgtttgggcgtttgatcctcaaatcggtgtgtattccagggaggggaagggcaatgctcgcagcaaaccccatcgcgagggctccaattccgttcggtgtgtgctccgccgctcgtattatctctagattctttttttcagttttattttcactatttgacgcagcgagtggttaatttttgtgagtttgtctaggctgaacgtgaaagcaaacaatgaccaggtatgcattaaaacttcgaatctgtaacacgtttccccacatattttacctcatgtacctgcattctcttatggtttaagaggatcatgaatttagagctgatgtcgcaggaaacatatttggctgatgaacgacacgaaggggttgacatctgggagctattcagccaggctcagagaagtaataactacttttttttttttttaaatctgagcttaccattgaaccacaccagagcagtatcatttgatatttggcgtggcatgcttatggcacttttcaattagagtgaaccatttgcatcactttgttgtttgctaaaagaaaagcgttatctgttctgatggcttcaatttcacagatatcctacaccttaacaagcagcggcttgtggccatggaagagctcaagaaactgcaggatgaaaataaatcgcttctgcaggacatagaagtactggaaacagaaaggcaaggtgtggcggtgataccatcctaatgccaagatacttttgtgaattaactgtgaagatagaatgcgagatgtgtaacatcgagcaattcaatcctgtgtttgatgtgatacttctattttctctttatcattgttagcttaagagaataagaggtaaacgacagacctaaaatttgacgctgcattctccttttacatatttcaggtttttccatagaaatagcagaatcatcaaggttctctgagttgcttctgcgtatagatacaatgaccatttctggtatggttggcatgacagaagcgtctgatttaagaaagaaagttattgacaaccgatacatgatacatagcgtcttttctgatattcatcataaacaagatactgaactactttcagaattgagactctttctgcgtaaaccagcagagtatgtaccactacctcattacatctctcctccaggttccagctttactattgccatattatattcaaagatcctactgcattatacatacatctttcaatctgaataagcatgaaaaattgaaaatgcactacaattttttcgtatatatgccttctgcttatattttgtgctgtataattctaaaactgcatgttttctatatgatgcacaaactacctgtttaatctgagtttctgccatcataactgctacttacaaattttgcatagctacgttaatttaaattactgttttgcaggaaacctctacacgttgtgcacatctgcagtgaaatggatccaataacatcacgtggatcattagcaacctatgttactggattatcttccgcacttcaaagaaagggtaacttggtggaggtcatactgcccaagtatgcaatttctttgtgacaagcaagtgatcaccagtgaactaataattttgtccattttcaaatgtttgcaataattccaattatatttataaatggactaggcataaaaaagtgaacaatttcttgtgggttttcagcaacgtagagctataatacatactacaatgatcattattctaaaaggagagatgttttgtttttgataaatttgttggatttgggattgagctttgtatgtagtctgattttggttgtgtcatatttatgcctcaagtattgcaagcaaagctattgtgttaattgcactggtataacccaaaaacaggtatgctggcataaatgaagatgtaattcatttcctgaggaaagctgaagcagactatgaatcttattatggtggttgttggcataaaaacagaatatggacagggtaaatatatactcagtataacagaaatttcttactctgttgattatatcaagatcttaatttttaaaagtaattttatagagaatttcttgctgtgcgtgcttgctttagtcatgtttgctggtttctcctcctaatttaccttctttagtgcagtatatcaagtggtgttagtcttacactcatagaaccggtgcagctgtcatatttaccttctttagtgcagtatatcaagtggtgttagtcttacactcatagaaccggtgcagctgtcatattttgatcgcgatatgttacgtggctaccccgatgactttgagcggtatgtttttatgccatatggtatctgcttttgttttgattctattttgaataccgttgatcattagctctagcattttcagaagctcaacttctgatatatttgtgccatgctgtttatctgttgtatgtgacacacaaatgatatgtgcttactgcatgttttaacacatgatcctccattccccctttaagttgattgtatctattagacccttgctttgataccttgtttggtacataacaattcatgtgttgtattgagctagaaacagctgtatgtaatcgacaaaagggttatttaggcctgaaacaaactgatcggttatatagaccataactagcatatttgactacatttaacatctatgaatacattgttacagattttcctatttttcacgtgcatcattggattatattgtaaaatccggaaagcagccagatgttttgcatgtacataactgggaaactgctatagtggggcctctattctgggatatatttgctcaccaggtcagtcatgctatctcccaaagacattgttgtttcagtgtaaatgtttatacttcatacctcacaaattatttcttctgtcagatctcatgtttcttataatatatttttcactggtctcctagtattgccaagggttgattagtacatctcaaagcaaaacagggaacatatgcacactgttctacagacaggaaatcgatgtgaacattattattttctgcgtacagaaaaatacaccttcattccccctgtttatattgaacattgttgcacaaaagattcttcccagtctttagaacgactataaagtattagaaatgcagttgaattttttatatgctgcagaaaatcatctgagcattttgttattcctcatgtgaagtttttccttataagttgtattcaattttcagggacttgggaacactcggatattactgacatgtcaagacttgacttgcaagtaaatatcatatatgcattatttgagttgctactggttaaccgtatttgatgttcttaattaaacaggctgatcacagttgataaacataatctgttctactatcaaatatctgaagaacaaaaaaacgaatccttatgatgcagtaaatcatattttttaattatctgtcgatcttttttgttggggaaattgtttcattagaccttgaaattgagaaatacaagtacacatcaaatgttcactgtggttaccagttaccatatgggaaaggaacctatgccttctctgctatttcctttccttttctggcaatatctattagggacctatctgttattattagcagtattagctaattcatattttcagtgagtaccctattggaatatgtatgcaccattaccatcataagttcattcactctttcaggcatcgtgttgctcaaatttttaccaacaacacagcgaaatttggattgactagagattttcgtctttcaaatatctttaaacttaatggacatattaacaaaaataatcctatatgcagtgcctagaggttccaaatatgctggaattgtgcggacttgatcctcataaacttcatcgacctgatcgtctgcaggataatagcgaaacaaatcttgttaatgttctaaaggtcagccttcttaaaattttaggagttgatgccatgggttgagtactgtgacatatgacaattgaagactatgctattgtttttttctaaatttctttcatctttatatttaatccttcgttcatgacacttccatctttctataagaaactagttcaaagatgtgcttgaagaagatatcaaaatgctaaacagaagtaaattgtttcacacataatcctttgaatgataaatatgtgaagcttaattttgaataaggcaagcaccatggcaactgcaatcacttggcacttgcatatttgcaagctttatttcatgcaaccacatattcagactgtggttcgtgtgttgtgtggaattatcatgaggagaactttgcttggctgacatgaacgactttgtttggcattatcagaactgtgaacaatatcagtattattaatctcaattgacgtgttttaagtcctcgactcttgatatccccaagaaaactttgtatgatcttcaggtcatcctgttttcagggatgtattgtttattcaaatagatatgaaagtgcttgactccttgatatccccgagaaaactttgtatgagcttcaggtcattttgttttcagggaggtattgtatactcaaataaagttttgttaatgtcctcaaccctcccaagagatatggctatccaaggcttaggacatgggttggaagcaacattaactacacacaagtaattatcatcttggtttgctttttatattttcctccctgtagcctgtanggcttatgaaatggccataactgcatttcttttttcacacacaaatattttgttctctctcaagagagaagggtgtggcggctttctatgaatgggatggagaactttgggatccatccaaagacatttatcttcctcagaggtattctccaaatgacattgaaggaaaatcattttgcagaaagacacttaagcgatgtgttggactccacagtggttcttccgttgttgtatgtacttctcattgtcttgcacaaaaaacatatttttgtttagtcattacagtgtttcatgaagtttatatcgtttgtcaggttgggtgtatctgcaatggtgattcgaatactgatggtcttagggaagctgttcgtgttgctctgcatggaggtgctcaggtttgtattactaattattaattgaggaccttcactttggactcaggctctctactagcgcagtttttagagtttatactgtgtaggtcatcttcatggaaaacaaagggcctgtgatgaactcaactgtgcaggcattaaaggaagaactgaaggtatcagtattactgttccatgtctatcatcagtaacctgtgtaaagccttctgtgttcacggagactgtagaatgtagagtaacattacatctcggttcacttgtttcaatttatcaaacagggagacagagtaatgtttgttgagatatacgatgaggccctggaacatttgatatttgcaggctctgatatatttctgtgctcttccttttatgacccatcgctacaaatagcggtacgtaaaaactttttctatttcccgcttctacttagttagctaatgttcacttcgcaatggcatccaaaaacttagaagaagtcagtatcacatgatttaatggaaggaggtattctccagttttcagagtatgatttattggtagatactcaccgagtcaagagtgaatcagctccttgacacataaccggcgcaacttcatttccacagactgtgaaatgaagcaattgacaagctctttgaccaaaactccttgcagttcagatataattttgttctttggtggcatttttattttgcatgtccgctttagctgtgtacttgtgtatgcgttgttgatcttagcaacatcataagttgccggaattatattttgatttttgacacatgaaaatgaaattaattctgcaatgaaagttagcttacaagttgcaagctcactactttgtctcgtagcaagttgactcttatctttgtgggcagattagagcaataaaatatggatctgcaccagtacagataaactttcccagtaatggatccaggtgaaaactgcaaaatattttatagatgtttgatgtgccaattggcaattatgtgttgtcaagtttactaagaagtggcaaatatgtgtttatgtgtacttatggcactgtgtttaaatttacttgtaaccaggcaaactgagtggcatgactaccctagcacagccctctctcagtacatcatctcaacatatggggacatgtccctttctcaagctctcgatggcattgtaagttcacaatctctaggacactacttagttaacacttatcctttggaagctgttgaatcattaggacatgccaaatctgcaagaaagaaggcttataggaagctaaaatagcctccccgaataagctatatcaaattttttgcttcttgaatgtgcagaagaacaacccttcccagtgggattggcgtattaaggatgcgatgtcaaaagttttatcatgggatgctgagtgctacgacctacattgggaggcttattccgttattaggaagctgtgaatgatgcatttctctggggactgcatggtacatcatcagctatctaaatacaaggcacagtttttgcccataaacaatcctgtaagtccagttgtttagcgacatgtaatctagctaagtaaacattccattctagtagtatgtaaagtacatgttaattttaaattttgattttgtctcttgctataaagaccttaatcgaatgttattttgctatagagacaattatgacaacaccacaagaagaattatgacaaaaataaaaccagtgcgattgtgcgatccaccagtttattggggttatttcacaacgttattgtgactgaaagttctattctgataggttgatttcttgcaactgaatggacaacggagagacagcaatattccctgagtgtgttttggagaaagcatagtgatgattagtaccaacgcacattcaaggtaacaatatgtctattttatttctaccccaaaacacaggtcatacccgaatggcacaaatactaggatctgcaagctggattttcaggatcatagtcatggtggtgtctgaacttctgatccacatttctctgttccatgtcaagcaagctctgcttctcctccggattggcatcacctttatcccaggggtgtagctggtatctcctcagcatctccagcttctcagcgacctccttcatcatcggtcgttcctcaccactcatgctcacacatcgcatcacgaggtgtgtaatctcttggagcacctcctctgtcatctcattcctcacctggctgtcaataagttcctcatggcggccatctctcacagccgtcatgaagcaagacacgaggctcctgtcttcctctgatccgccgaagtagagtgccttcttcctggttagaagctccaggaggacaacaccaaaactgtacacatcactcttgttagtcagctgacatgtcatgaggtactcagggtctaggtacccacatgtcccttgcaccagagttgcaatctcgaactcatcattaggcaccagttttgatgtcccaaaatctgaaacttttgcggtgagtttgtcatcaaggaggatatttgccgtcttgacatctccgtggaggatgggtggtgaggctgaagaatgcatgtaggagagtgcctctgctgactctgccgctatccgaagacgagagtccaaggatatgacagtgttgagagtgctgccatggatgtagtggtcgagggtgccgtttgagacaaactcataaactagcatgggaacttcgacttcaagacaacaaccgagcaacttgacgacgttcttgtggttgatctgggagaggatgcacatctccttcgcaaattccttggtctgtgcctcctctatcatctttgacttcttgatggccaccaccatgttgtcctccaggacgcctttgtagacgatgccgtagccaccgcggccaagaacacggtcggcggcaaagctgttggtggccttctcgagctcttccttggagaaaatcttgaacccacccgctccgccgctggtgccaccataggaactcatctgttgctggagaagcacgccaccgttctgctcaaagaatctttgcttcgttctgatgagcttcctcttttggagccccaggtagagccagaacaacatgaacagtaacaggaacacaccacgctgacccctgaacatggtatgccaatgatattcattagttcccgacaagaaaataagtgcattaataatgttgcttgataaccggccgattgaatacctgtaacgactttcagagctaacgtgaacttgtccgttgggaggcatccattctcctgggttgcatttccactagtccccggtcggcattcgcaggtgtagcttccgattgtgtttgtgcattttccgaagcatgggtattcctttgtgcgttggcattcatcgatgtctagcgttggcaaagcaaaacatattcatcacttaatttttttttgtcagaaagattattactccatttgcgttttaggcacccacctttgcatccaccgtcgaggtaggggttgccctcgtagcccttggagcacctgcaccggtacccctggccgtcgctggcgttgaagcactcgctgtgcgcgctccggcacgcgtagtccgtcctgttgcgcacggcgatgtcgcagttgccggcgttccggatggcccagtcgagcacgacggggacggtgaagtcgctggttcggttgatgaaggcgcgatagctgtaggtggtgttgatccacttgtcctccgccacgaacacatactggcattttgttgagtcgagatggcggaagacgggttccgtcggcgggagctcctgttggtcggggacgtttcgcgttggttcctctgtcttattcaacgtgagtatgtaaggcttgtagacgttgagagcgcggggcatggtgttctggcagcaccccgactcgccggtgcactggcccggcaagtcaccctgcgactgcgaccgccggcacgtggatgtgcagccagtgacgtagttatcgtcggcgtcaaccaagtagccaaggacggggcacccgagcacgacaaggcggttcctcgctgtggagaaccggtaggcgatgctgcggccgtagtccggcgtgcggtagtgcccactgattgctttgaagcggtcgtcgtggcagttgcttcccgcgtcgacgaagacccggacctcgccgtcggcgatggaaaggctcaccagctttttctcacgatcatccaggtagttgaagtgcggagtgttgccgtcgcactcgagctggaagtctttgtcccgggcgcagccggcgccaatgccgaaggggtaggagatgctgatgttcccgcacttgtcggggcagcccggccatggctgagccgatgccggtgtcaccggcgccaagcagacgagcatgacggctaataagtaggcaaccgcctgatgcagtgtactagtggtagccatttctaacatgtataatcgccttcgtgttgttcttcttgccgtcttgcttttacatgccggccgggcttgatatccatataaatagatcgcgcacaagcttccttccttcgttttttggagggcaaatatgccaagatcaggaggatgtgtcatggaagctgcgtcgtgtattaggagttgactgaaagaacacgcggcgacgtgttcttttcttagagggcgcgctgtgtttagttcccaaagcaaaaaaaacttacgctgttaaaacaaaaatttttatgctgtcacatcaaatgtttgaatacatgtatagaatattaaatgtagaaaaaaaataattacacagattgcgtttaaattgcgagacgaatcttttaagcctaattgcgtcatgatttaacaatgtggtgctacagtaaacatttgctaataatggattaattaggcttaataaattcgtctcgcagttttctgacgaaatatataatttgttttgttattgaactacgtttaatactttaaatgtgtgtccgtatattcaatgtgagaaccaaacctaacaattttcctcagctaaactaggccttggttgactagaaagtacacgttgctttgccgcgtggaatactagactagaagaaaaagtgaatgtgcacgtagtattagttgaaagtaactaaatgagaaatgacagcatataattaaatattcattcaagaataggcagggatccatcagaccactttaagaatacttcgtcaacttaccctctaataaaaaaggaacagtcaaatcactaattcaattcatagcatcatatgatcactatcttttttgttttctaaacaaatacatggaactggacagctgatccaaatacaatagttgtgcaaaaaatattttgttgaaattttggaattgaggcaccaaagcttgttttgagagaagccatgtcaactctttttgttctctttttttttctcagaaccaactgcatataagctttaccaagcccatggacatgtctaattcataatttacgaagccgctgaaaaaaagaattcaatatgttcgtggttcgggtggacaggaagctcgtggctcgttagctcgcttggctcgtgacaggctcggcttgtttgaatttcctaacgagccgagctggcatttcagctcgttagaccgaagtagtcgtgccggtctgaccgcctggataccaccggtctgaccgagatttaatcttcggtcgaaccgctgagatcagctcctgacgcctgtagccatcgccggtctaaccgccgccttgccgccggtttgaccgccagtgagttgccggttaaaacacaaatcgaataactctcgaagtagatgacaactttattgcttctatctgtgtttacaaagtgcaacaacagcactccttaaaaaaaatctcgactaaactcaaaaccctaactaaactcacaactcaatactctcaaaagcgataccgggaggccacgccctccctctctatttatatatgaagtaggcagcccacgccctccctctctatttatatatgaagtaggcagcctaaagacacgaaccaaactcatactagaagtcctaatccacctaggaaaccttcccgtacaagaaacaaactttacaaactccaatcataacaaatttggactccttccaaattcgacttcgcatcccatactcacacaatacctcgtatgccatatagaatcttcaccaaccacgtgcattgaactctagcgtaagtatcccacatgatatctgaccgtcacagacatcgtcttaaccccaagccaactcccgatccatcaccgcaaatactatcttgaggcatcaagtcacctacacatgaatcaaacaaagaaatcatattccgagaccaagctatctccaacttgactcattagtagcaaacaacagtattacatacgcatagtatccatctagaagccataaacatgaaacaatcacggatatccaaacgaacaacccgaaaccgaaaccgacacagagtcgcccggtcagaccgcgggctgaccggtctgaccgctcgcatagcgccagtctgaccggcatcacctgcccggtctaaccggacctgacaaaacagcagtacctgtatatcacctgtaaatccaatcatctcaaaaactcctatccaatcatctccaaatatcaaaaccaataatctcaaataccaattatttatcacagaataagaatcaaaacacactttgatcttacagtatagtcagcggaatacgaaccgaaagagacaccaacaaaaccattctatcgaatggagaactgccaactgataatagaaagcacaagacgctattattgattttctatttggttagtgcctataaaacccataacaaatagctgatcagttcaagcaatttcatccaagaacaaacatctatatactataaaaagtacaagttcatccctaatcctacaatccttcagatccactatcacgtgggacccacctgtcatccctaagaaagaaatcatgcaccatcgtcgcgcacgaagaaaaaaaaagaaacgctgaagggacacacgatcccacgatcagataagaaaaaaggaggaaaaaccgctcgtgaccgagaatggcgtcactatgccgcccggcgccagcgatccatgcattcaccgccgtgtgcgccctcccaccgcccgctctccacgcctgccgtccgtcgccgctacaccacaacaccgtgcgccggcactgcgaaccattaattccgctcgcagccatcgcacttccacgccgcgcgccaccaaccgtccctggatgctgcacacaggtggtgccggcccaaccccagcgccgccgcttcccaaggtgtttcacgcctccggcgccgtccttctcggccggagtcgcgcctgaacctgcatattctcggggaaagctctaccgactgcctcacgatcccctccacccacgtctccttccacgaccatcgctggcccacgaatgcgttggcaaaggtggcgcagcccctgcccaagacggatttcagccgtgccgcccacgtcctgggcgggatccaccttcactcgtggggctcgcctgttccaccaccacccgtgacggttcaaccctcgctgtcggcctgccgctgaccgggaagggagcaatccgcgtcgccggcggtgagtttctctaagactattgaggtagctaacttgctcatggcctttgcagcacccatgtaggcttttttttttttctgatatgctctttgtgattctgatatgttaacgtaaattattcctgacaacagttgcttgaacgcttcaaagacttcaggcaccaacctgaagctcttattctttgaggccaacaagttcagggaacaatgaagaatcgttaaaatactataagcaggaaggtcccttgaaggatttcagcgagaggggaaccatgaatcagctttggttgcttagatcagaatgctccttccgaagtaatttttgttacagcatttccccaacgtattatgcacagctatctaatttgaagctataaattcaatgttgtattatttttgttatatacaagtatattgaaatgaggtatgccttcaccttgtttttttgggtggaattgaggcaaatggaaaagggcaaaagattggccatcaataagtcaaatatcattaatctgattctttttataaggaaagttgttgcttcagttgaaagtttatggttggccgttatggccttcacactagactgcttgttgaatcttttctataggtttttcatagtctgatacggtgtactgcacatgctatgagaaaacccaataagtatagctatctatatgttttttttttgacgaattcagcgaatggtaataactcagtcttaactagataaaactatgttctctcttgcatgacaactatagggctaactgaagaacctggatttttcagggaataatagtatatgttgcataccggcaatcccaaaatgttgcaatgaagaaactcatatgttacatactgcagaccccaaattcatgaatacaactttgggcaactttgagaatttaatcaagaataggtactgttaatgctatcctgtgtttgtcaacgacaattatagttctgaatattttttcacctccgagtatacatataggttatataacccactgctactctattttttagatttgtttgtgacttgtttttcccactgcccacatagatcctgatttcactgttaaaaatccatgttttccagccctacacctgcatgatctgggtagagtggaaaaaacgaaaaaaaaatccaagctgatcgaatttgatttttctattttcatctgtacctgtgaataatggatcatagcattagggttggatgctacagggagacagatctcggatgtgtcatgtattccatgatgcaaggtcgatgttggctattgtctcggcgtttcgaatagagaaggttaatagaagagaatgtaatggtgtagcttttttgggcatgatgtataacatgaacctttaactcaactgatttaagggtaggatgcattttttaacggaattgctaaccttctttcgacagattttgcatccccaaattaatcttgcagattttgggacactggatgggcttcgatattcgtgctccacgccttctcctccaactctagcgacctcctcttcttctttggtgccggcgaggaccctacgggttagggtcctggggtggggtgggggtgggaggggg

SEQ ID NO: 25309 - DNA, 2292 bp, Oryza sativa
gggtctcgccggcgccgttgatgccctcccgccagccgacgaggcgggcggcggcgcggtggtggcgggggatcgggcggagccgctcgccagcgcgatgggaggggaacgggaggaggagaggttgagattttgtcaacagatgtatagatagccccttttttttaatttacttcattcaatgtatgtcgacgtgccttgcacgtgcacgctaactagtgcatggaaaaagtaggccgtttcctgttatcaaatacttcctccattctaaattgatctacatatagttttttttagattattcctaaatgatctacatatttgtgttcattcattaagtctattcgttatttatgcattggagtaaatggacattgatgcatgcatccatgtacataagtatttataacccacatgcaatatcttaaatggacattggctaggaaatagtggggatggtgcatgcatcgagtttgttgctagagtaaatatagtatgagagagttattagctttttttggtcttggtgtacctatgaaatatgtagatcaatttggaatggagggagtatagcacacgtacaggggatcgctaattagcgcatatgcgcgaattgctttcctggcgcacacgtacatgtgacgagcatagatggacggtgtcgtcagaaacggaaaacgggaaaaaaacgtgattagcaccagtaatttaagagggcagctagcccacgggataccgtggaaaagtgaagtcacgggacaatttttacgtgtgattaattagcgtacaacatgttgtaccacaggtaccaggtatcacaagtatcaggtaccaggtgtcacaggtatcaggtaccaggtataacatataccaagtgccaggtatcacaggtaccaggtgccaggtatcaggtatcatgtgtcataggtattaggtaccaaatgtcacaggtatcaggtaccaggtatcacatgtaccaagtgccagatatcacaggtaccaggtgccaggtatcaggtatcatgtgtcacatgtatcaggtaccagctgtcacaagtaccaggtaccatgcaactggtaccatactggtatcagctggtatcagcatagcggcggaaaagcgaacaccagtcaaaaagagaaaaaaaataaaatctatgttacataatatcattgtgtcaattaatttacatgacatactaaatctcaatgtgtctcactcaagaaaagaaacaaagcaagaaaaggagaaaacgaaaaattaaaaatgaccgtggtatatagaagatgtaagtcaagcctacagaggtgcatgcccaaattgattcacatggcccaagtgcccaaccaatatatctagagtccttgtgctgcaggaagaacacatacacgtggatgtgttgtggagtatagacctgccacttagtaggaaattgtgtcgcatgcgtgtacaattgttttgatggaaataacgtagaccttttaagtcatcccgtaggaacgggatgccgttctagattttctggtaatttaatagcgcgtgcgtctggtcccctcccgcgtcctattttttttcttttacgattttttttctttcacaatttttctttccttttgcgcttttttctgattatttttttaatcttcaacacacgtattttcgaatgttttgagttgaaaagtttttaaatcttaacttgaaaatttttaaatcttaacttaaaaaattttcaaatccaagttgaaagttttcaaatcttgagttgaaagttttcaaatctcaaacctaatcgccgtcggcgcccgacgcccggcgatgtcgcagctgccgacgttccggatggcccagtcgagcacgacgggcacggcgaagtcgctggttcggttgaagaaggcgcgatagctgtagttggtgttgatccacctgtcctccgccacgaacacgtactggcattcagtggagtcgagatggcggaagacgggttccgtcggcgggagctcctgttggtcggggacgtttcgcgttggttcctctgtcttattcaacgtgagtatgtaaggcttgtagacgttgagagcgcggggcatggtgttctggcagcaccccgactcgccggtgcactggcccggcaagtcaccctgcgactgcgaccgccggcacgtggatgtgcagccagtgacgtacgtatagttatcgtcggcgtcaatcaagtagccaaggacggggcacccgagcacgacaaggcggttcctcttcgtggagaacccggaggcaatgctgctaccgtagtc

SEQ ID NO: 25310 - DNA, 1274 bp, Oryza sativa
caaaaatcccttatattgtgggacggagggagtatatcacttcacaaacatgcaagttcaaattcgacttctacaaattgtaacaaaaataataaatttgactgtgaatatacgtatactagttagagtttgatttgttatttttgttacaacttgtagaagtcgaatttgaacttacatgtttgtgaagtgatatattacatattaacctatcttgtgtttttttttaaaattttttcataattatttaggtgacatacaaaaaacgggtggacgttcacccgagagattagaatccatcctcgtagtggtagccatttctgacatgtaatcgccttcgttgttctgcttgctgtcttgcttttacatgccgggcttgatatccatataaatataaatagatcgcgcacaagcttccttcgttaattagttggagggctaatatgtcaagatcaggaagatgtgtcatggaagctgcgtcgtgtattaggagttgactgaaagtacacgcggcgacgtgttcttttcttacagggcgcgctgtgtcttgtagtattattagttgactagaaagtacacgctgctttgccgcgtgaggcctgccagtggtttcaaatccaccccgcacctacaccaacccaaaaacaactacactagcccacccaatccaaaccaacccacaaaatacacgcgatccaatccaatccgcaagttgttctccacaggcaacccatggattctacccacagcctgtttggttggggggagtttttagaagggattgggagtttagagggatgaggctattaactgttttatttggttgggagacatgggaattttggtgggatggggatggggatggggaattgaggaatgaactccctccttttcaatactgggtagggggtggtaattgggagggaattcttcctttactttgcctaaacaaatctcagccatccgttttcattaatgacctaatctccaactaaacttcctatcaatttccaccacctctaccaaacaagagactggaatgaaaaatcaaattcccatcttaatctcaccatcaattccctcgtgtaaactcctaatccccttccctcaagttcccaaacaagccgccatggcacacagccggctaaccaaaacacacagccacacatagataccatagtcactctggccgcatacataggtagttcgtaccatagtcaaagcagtatgcgtaccatagtttactttctaatttataaattgtcatcaaattt

SEQ ID NO: 25311 - DNA, 1098 bp, Oryza sativa
ccccccaccccccaaaaaatttaggcccaaataggttgcttggcccaaatagcccataaaggtctaggttggagggattcctaggctcccagccactcaggctcagccgcccaccaccagcgccgatagccgaccgcccccggcgcctcctcctcaactccgcgccgccggcgccaccaccggcgtccccaccccgcaagcccgcgtctctgcgccggtgcggcgcctccacctccgtccgcacaacaaccgtcccctcccctcctccgcgccggcgccgcgcggcctcccctccagcctcccctcctccgtgccggcccgcgcggcctcccctccgacctccccgccgtccgcggctcctcgccgagtcgccgacgacgacgccgcgccgtgctgccgacctgccgactgccgtccgcccgtcccttccccttccgtggctcagcccactagccaggtaacaaatagatgcctaaactaaatggctagatttgtgaatttgtgattagaagatttgtgaatttgtgattagagattagttagtctgtgaataactgagaatgcaatttataaattgttactaattagtgaatgtgtgctaaatggtaattgctattgtttgtaggatctatgttgattgttggactctctatgttgtaatatttgcacatttcgaacttgcttgctaagtaagccgcttatggatgttggaagacattatttctatcgcattttcactaaatttgtatttgtatatcagttttatggtgcaagaaaattttatcatgtgacatgaacttgtgaactaggactacccaaggaaaaattcctgcctacgccactggatgccggtgtcaccggcgccaagcagacgagcatgacggctaataaggcaaccgcctgatgcagtgtactagtggtaggagaaactcttttaaacactcgggtggacgtccactcgtttcttgcatgtcatctaaatagttatgaaaaattttcaaaaaaattgacatgataggttaatatgtaatactccctccgtcccatattataagggatttcgagtttttgcttgcaacctttgaccactcgtcttat

SEQ ID NO: 25312 - DNA, 2038 bp, Oryza sativa
atgttatttttcaattgtatttctatatggactctatactctacttctaatattccttatttttaattccgaatttctattatttcttaattgtatttctatatggactctaatcttctcttccaatattccttattttttaattccgaattttaactatttctaaattgtatttctatatggactctgtttttctttttctccgattaatatgagaatttctaggccgtgagagcgaacgtagaggcttctttttctattcctttaataagttaatagatagatagttgaacatgcataagcatgctacttctgcagctcaaatcagttagcatgcaagctatgatcctctgatgtaattgcttgatgtggttatccccacaaccaaaaaggtggttctactctcttgatgctcatccatctcaggtgctttgatttgtaatagcatcaacacaaactacttcagtatgtaaatggtgggttcaaaactcaaacaaacaagcattgtagattttctggttcagtttactaaactggaagcaagaatcaggtttcagtaaagattcaataatactgataccataaaatttaagtgtaaaatatcaacttagagctaaaatccatcatacaaaaaactactaccttttcggaccatcatactttagaataagttagtgtacaaaaataaatgatatggccacatagacaagcatcagctaccaactgcattacaattttcaagtactttgagaataatcatgcaaactatagagaccaagttttcttacaagctaagaaggaaacaatgttactttggtagtctagctagtagtagatatgcaaaaattatacatttaattaccttgtttcttcggtttaaataaccaatctttagcacaagccagtgcctcaagcatatcaggtgtcaatgaacttcttgtgtctccaagtatccttcctccacaactaaaagctgattccgaaggcacaatgctgaatggaattgctagaaaatcctgagccataattgccagtataggaaaccttttagcatttctcttccaccaagccaaaacatcgaaatccttgctatcatcctcacaaacttcttctaaatatgtctcaatctcagacttatgtaatcgtgttcggtttgacttaaaaatagcaaactcttggtcaagctttcttttgcctagaactggcgagcctacagcagttgcttctccttgctctgaatgtgatagggaggacacaccccttctccttgcaattcctcatatactctgaagtatgacttcatccgctctataacaaaatccactttagtttcagcttcattcatattgggagacaccttggcataaaagaattccaaataatctcgtttccttcttggatctaagacagtgctaatgacaagtgccaaataaaaattgtttggcaatttttcatcccaatacttagcaaacttcgtatgcatagcactagctaattgagtcaaaacactagttgtttgccaatcaaaatcacttaaagcatggcgaatgcaaaaaaccaagtggaaaactagatgagccagctcaattgaacctatgttaacctggaacatcatataatcgatggatatatatgaatggcttcaaatgtttgctactgacaagtaattttagatacattaaaaatgtctcaagatctctaaatagttaaacctaatacacttggatatatatgtaatgtggattacacagacataaaccgtgtaagagcttgaataatgcaagcatttgataaatctccatttcatttctctggtaaaatagaatggctaacggacgagtctatgcactgaatgctactacttttctccacatatatatgccaaaaattattggtctgcattatttgtatagcgaaagatttttacctattggttgaatcaaatgttgatctgtatcttgttcttcatcttgttggttgaatcaaacgtgatcagtatcttgttcttcatcagtttcctgtaattataatgatagag

SEQ ID NO: 25313 - DNA, 22022 bp, Oryza sativa
tctttttaatcctacgtccgccattgaggctaagatcaagatctgaaggatgctaccaaaaggagttggtagaaagattcttgcttatcaatatggcctaaaggagttggtagaaagattcttgctttatcaatatggcctacaatggaggctttaactaggagtaaatttcaaaagactgcaaatattatgccaaaacttatcaattaattcgttgcaactatagcctagattccacaaagctgcaacagtagctaatgattttttattagaactgcaaaatttgttccactagtaggccaggaacacctgttagggcacccgcaatggttatctataggctctctacaagagatccatgtcagcatattttcctacttggaagagattaaatgaagagagagaggaaatctatctactaacctggagatagtttatagagaaaaacgaggcaatggattagagagctatagatacccatgtagacataccattgaagtggtttactattaatctagtctattgctgagatgtacatgttttatagatagcaccttactttaccattgtgggtgctcttaggcacatctaaagtcttcaaaccagcccgagaatgcagcgccctcagcgttttgcgctggcgtggcccctgccgcgtcgcgacgcgtggacaggcgctggagaatggctggatttcgcgagctctcgtgcggccgcgtcgtccttgcaacttttgcaggaaagcccttcggtttctatgtaattctatcgaggtccctcaacaacagtgctcctgatatgatatttttacatttagttccgtaggaaatccaggtatttcacgcgaagaacaaaaaaacaagaacagggaccgcgctctaaaatgtagaagccgaggggttttgtcgaaaaaaccccgcgcaacccacccccaaaccctagccgccgcttccagtgtccccttctcccttcgtccctccctctccctctcccgccgcccccgccaccgagagccgccgtgcaccgccgcctccgcctacccctcgcgccgccaccgccgccgccgccgagcgccatcgccgtcccccatcgcgctgccacctccgcctcccgccgtccccattgccgaccgcctcggcctctgcctccgccaaccctagccgccgctgccagtcccctcctcccttcggtgaggcgagcagccatctccgccttggccaccgccgtcgctgagcgccgccgcttccgcctccgcctcacgccgccgctaccaacagccgccttcggctgccggcgtccggatctgggctccatgtggccgcaggcgtacagatccgccctccgttgccgctgccatcgaagaaacgacggtggtgacgaagccggcatcaatgaaggcggtggctgcggcgagaagaggagaaccgtacatcgctaggctgatctgccgacgagctcggcggcaacatggtcggtcaactggcgctacggtcgatctggatggctcactcacaaggcaagcctgtcatcacactgtcctagagccgggtcgccccagtgagggtctggtgctgcgtccctcctcatcctctccctcacgcagctgcaagattggaatcactccggtgagtttttggctctttctcggtttctcaatcctctgccttccttgattttttccccttttctttgttctttactttgctgatgtgcataggttaacgagaaacgcgtccagccaccacttctcctcggtgactatttttctcttccctccagccctggcagcaatagagcaagctcatgtcaccgtagtcgcatgctcttgggggaggagatactagcagccccgcttaaggaaatcttcaattcttcatccccgtcgcttcctcaaggtttgcattatttttcacgggcgtatttgttgccacaggaaaaaaacatgttagctgatattgtttctctatgttacaacaggtgagagtgtttaggaagaaaacaaatgaattatcatttcttatcagtcataggatagtacagggaaaacatgtactttggggaatctattatggacaatagtaaagggagagttacttttaaaagaataaaccataaaccatttccaatttgccattattattacgcaatatagaacgacagtagcttgagctcactcaatctgatttttttcaccttttatcttatttggcagttcaagaactggtgtaatagttgatagagctatacttgcagaagatagaaaacatggtggcttcaagaggttggtaattaccataggaagtaatttgatacaaagtttaccttaagtagctgagtacattattaatttgtttatttgtctgtaacaatgatatcttggattatctgcaaagagaaaaccattttttgacatccttgttcattaaagtggatgctaatctacatgtaaatataggtgtttgaactgcgaactgcgaactgctaccctttgataggctgatcaatatcatatgccttcttcaagtcaatttttcctctactttaattggacatgtttagacattttattttgcattaattttttctctattttattttgccccaacccacagctccaaggagtgaatctccatggctaaagaagcccatgcatggagtttcaggctcaactgccatggctagcaccccatggagctcgatgccaccaagcagccattccctgggtaagagcccctattcctacctcctccattttctctactgctactactccttttctattaaaatctaaactaaggtgcttctcggaaaagtacccctaggtaatggtttggtttatgcttgatatactgaaggatgctattgtggtagcatgtaagaaatcacttgatcccttctcctgatttgtgcttcccagatccccacgagctcacaagttagtgaactttatttccaactgttggttcagctctccatgaattggcagctgtgcttgctagctcttcctgtccccttcctagcagaacagatggcggtgctgtacgtcaccttcttgaggttgattgactaaaaaccttgaaaatactccctccgtttcacaatataagtcattctagcatttcccatattcatattgatgttaatgaatctatacatatatatatatctagattcattaacatcaatatgaatatgaaaaatgctagaatgacttacattatgaaacggaggaagtagttggcaagggaggtggatgtggggaggggttgagttgctctatgtgctcactggttgaagctgattgttgcgctcctatctacctcacttatttaccaggaggtgttaagctcattcggtgagaattttacctactcctttcactgcattttccttgaccacacttagattaaaattatagcttccttcctggtagtagcaaattgtggcaccaatgtggcacatatttattggttatctaaattattttcttatattgtgtcttgactctatttggtgttgtaaggcaggttagtggctgattaattagctgcattatgctaccccgttattactagcttaaataagttgatctgttcttgatgcaatttatacatctatgagctggtcacttcatcagctttactcaggtaggggtctttcctacatgagtggctattctctccaaactaataaaaattcatgtgagttttgttggtattttagcacaaaaaaaagtactcaaatagctgtttgcctggatgctatacccaccaatgaattttcaattatgggatggttcttattttttttgtacatgtaaacagaacctgaacatcagatttgatgagagattcaaccaagaagctaaaattttttgcgactgatgtgcattgctgaaccagttttctgttgcataaagagtcctgaaacttcttgttgcaaactgaagtggtgttctaaccagttttcttcttgctttctcattagcttctcttgaatctttctgtaggtttctttcctgtagggaaaggaaaggtgatttcagttgcctgactgttgctggaatctgtgaagcatctacaagcgatgccatcggttcaggcagctggcacagcaatgccggttccccttgccccatatccaactcctgtgccatttacacctcccaatggtatggattccaacttggcactgcaagaacacagctacattttgagttttttttccctgatgttggttggtcacctagaaatgttggtacatgccatagtgttcgccctgatgcattcttttggactagaaatcttatgaactgaatttcaatagacagctttttcttgaatcagatgttactgttcctggttcagaggttgcagtttattctgctcatagaaatcctgaaagtttagagagaactccttgttgagaaaatggaagtttttttactgctgagtttcgttgtctgaaatgaaaatgatgcatggaagatgcttttgttgtctgaaaatgaaaatgttagctgctgaaatgcgacattcagtcagtctctgaatttcaggggcccaaagccagctcgtttgctctgggtgccgtaatctgctcatgtatccagccggagcaacgtcgatttgctgcgcagtctgcagtaccgtgaccgtggtgcctgcccccggtatgcacatcattcactcaggtttacatctcaagttttttttttttgcaagtaatgtggcatctcaaaattgagtttctttgcatctaaattttagagtagtttagaaatttatattgtatcctctctgttttatttacaaaaatgagtattttttgttttttagagcagaaatctagctgcaatgttcacgaaaataaagagagattaaaggggaatacaaatggcttcagggctccgcaacagtgcgcgtgtcgcgttgatggtgtgcctgcactcaggtccctaatccgctgaccttagctatgtgattcatttttgtgttgctgtcatcagtgtttcacttgttctgtaggtcgctcgagaagaagtacacactgaagttgctctggtcatatttacattattgtgtgtaactcttccttgtttgcttttcagtctaggatagagatttacatgtcaaagagtcaagtgcacttttgaaagtgtaatgcgatgcaagtaaaaacaattttggacaagatcaaaaggatccatgtcatttgctgtcagaatagtaatgtttgttacttaatgaggtttgttacaaaccttaattacaggaatatcattgtagtagttcttaactttttacactcctatttgtagatgtacatatatttatgtacaattatcagatggactattttatacactactttctccctctctatatactacctccgttttttaatagatgacaccgttgacttttttttacatgtttgaccattcgtcttattcaaaaaatttacgtaattataatttattttgttatgagttgttttatcactcatagtactttaagtgtgatttatatcttatacatttgcataaattttttgaataagacgaatagtcaaacatacgagaatgatgagttgatgacatttaaaaaatgaagggagtagcatttacatttatttatgtataattatcagatggatgatgagttgatgacaataccttctatttatgctgccctttctctacctgtaatgtacctctgaatttatcttagtcatacctatattaagcgctacatactacgtgccttccataacaattcttgccttaagctttcatcggttcccgacgccattttatttcttgcaaccaaaaacataatcatgccacttatatcagataaacaacattttttttctttttgctaatgctatcagcaagtaatcactaacaccctattctacctccaccggtgcagcgcacgaagctcgcgtcccacgctagtatcggttaaattaaaacctgccctggattggcgagcggagagcgattaggggcggcgtgttcgcacgcggagctatccacgtcgctcgcgagtgctgggaggcgggcggattccacaccccctcgagcgtccgcgcgagcggctccggcgccgtccgatccctcacagcaacggccgagatcggtcgtagttcctagcacggtggacattttgcaaaaaaatccataattaatatataatttgttttagatctcgcatggtgcgatcatatgttctgttttcttacatatagatcctccataaccaggaaaatcctatacggagaagaggaaaaaagaaaataggactgcgctctgaaaaacacaaatcaaggggcttttctgaaacaacataaaactctgtctccccatcctccctgaaaccctagcccccgtgtcgctgcgcagcctcaccctcctcgcgccgcctctccccgccccaccgatgccctgcagcgccgctccatcctccgacgcctgtcctggccccgacaccgccgtgcgtcgccgcatgtcctccactgcctttctctctctctctccttgctgccggtgccgctgagctcgagctcgagctcaatggtgagaggctcagtacgtcgacaacgagtcggtcgatccaacattcaatcgggttaggtcttcgtccttctcactacctcgtcgtcgatttacctgtctactcaatacaagctccacgctgccttccgatctggtggtagctgccgtgcagcgatcggatctggcgaagggaggaggagcgcacggcggcgtcgacctgaagtaggttgctggcggcgtccccagcgtggtggtgtaggccgatgggcccaggaggcggacgcctcgagcttgcgagaagatggcgtcggcacggagttctcgaaggcgaggagtcggtctggcggcgcatgacttgattttcgagtgatgtgggggctccatgagcagtggcaagctcctgtttttttctggtcatcagagggaggaggagttgtctccatcgtctagccgttctctggatgcatcaagcttgccctcatcgcatcacgccatcgtccacttgtatttgattttcatttctattccccaccaagatttgaggtgtttgttttgtgtgatgccctgcctacaaggtgttcgttgtttttcctacaagcatggtgatgtggcgatcttaaagctatcagttacgcctgcatgacctgtaatgtaagcccgaatgatttgttaggatctagatttggatcctactttccacttaatttctctaaacatttgaaactaccttaatattagcagttagatcgatattcataatacaagggaagagttaaaattgctaatgaaatgcatcattgaaaatattcatttgtagttagttctatagatgtatgcatttcatatataatgattgctgacaactgcttttttggctagaatatttatgtgactatctacctcaatagctaaagaacttctcgaattgcaatcagtcgtcgcttgtccctgtgattcataaatcagtatggtccatgagattcctgattgagttttcaaggaaaacaccagcattaggtggccaatactgtgcaaataattctataatgtgtgacgcccaatctggttttagaaaattgccctttgtgtgttctgtagatgaagagttcgagaatctacaaccagataaatttaattcctataaccacagcaggcatggtctgccataatgaagaggttttttactgcattcctttagctcatggtcaaaaggacagtcagttgtaatagagcagaagcaatgttcctctgaaaataacagggtacttttattttctagatgctactatgccattattagttttagctatgatcttccagctctagcttaatgataagtaaataaagccatacagccccatattaaatcattgataattaactaatactccacatccaaattgaaagaataatcactaattcaatattcttgtaggtaacctctcatttattgcacgtttggatgcaacatttaggtggcaaggagattatacattggcgatagcatggagcaacaggcagaaatgccattctttgttcattttattttccttttttttttagtttgattagattatggtgcttaaggagctggatttgctgttaaatcttaaatgatttaaacagcgggctatgggttcactattggctagaggtgttcagatcgtttaattcttacatggcatttcttttgggtcctgcatctataatcctggttgtctttctgaattgagataatacaaagcatgagcctatatggctctttctgatcacggaattcgtctttatgcatctattagctttctgatcacgaaatttttcttacaacattgaaaatgcctgtttatctatgcttagaagctttgctggttatttctgtgtatagctgcaatataatgttctctgtatttgcgatactactgtgtaaattgctgattacagaagttgtcttgcaagaattgaaaagaacatgtttctgtgcttagatgttattctggtaattttgtttgcataacttcaacacaatgttcactctatttatcatagaaatctatgtttttttctcccagtgacgatttaaagtatctccacaaaaaaagatttatagtagaatgccatctaatatgtgtttgtgatcttgagagatctgttgattttttatgtatgatatgatgaaaagttttagtgtcaaccaaggtatcaaagattattgtgatctaaatgcagttgtctaccttcatccaatgtttctataaaataaattatggtgtgcactagctatgtagtgctagaagtgaaccatttactctgtaatggcattggttaagaaaaacgttggtaaccaatgctccctgtatttaaacatgctgtcatttaaacagctactccctccgttttatattgtaagtctttttagcactgttcatatttatatagatattaatgaatgtagacacatatatatatgtctagattcattaacttatatatgaatgttgtgtctacattcattaatatctatatgaatgtggataatgctagaaagtctcacattgtgaaacggaggtagtactattttgtcatgccctcactatgagagtaatgattatgtcttatggttaattctgatgctttgttgttcagtgagagtgtggatctttaattttattcgcccacaacatgcttaatggtacccctttgttggacttctgatagggcacgcaacgcgcgcaaaatgtctagtatgtgtaatacttacactgttgcaagttgagcacacatgtcaaacacgtagctaggggataaaagttgcagtttaccgataaaataatttcctatcgctgcagttttgtgaaaattttagctaaagtagtagcaaagtgagttttgactagatagttgcaattttgagaaatttactctttaattaatcatcgaggtacctgccacatctctgcaattaaaactctaaaagctaccccttccatctcattttaaacatagacataagtttctgtgttcaactttaatcatccgttttatttaatttttttttaaaaaaacataagtcacataaagtattattcatgatttatcatctaataacaataaaaatactaattataaaaaattcaaataatacggacaatcaaagttgaacacggaaactcatggttgcgcttaaaatgggacggagggagtacatcaagaaatatttcagaatattcatagtaagttttattttgaataggccgtgacatagtgcataagagatgttcccataatcccatgtaatcctagataacttgaaattctagttaagtctattaatctaattggtaaatctagtattatatagagatgatttgcaaatccctatgttcttatttaaatgttattaatgatcattcgttgtctttataacatgttgttttcacctacccttttaacagaagaatgggcaagaaccatttaatactcacagttacatatcattggtctatatggtctatgcagctttaggcttttcttttgttttattacagcccacatacatttcttggttctttgggtgagcaccatatatgtgtttccatgtcacaagaacaagaattttaaagaattcgtcctcttgaatagttcaaacaagtaggttaatctttacttatctgagaaaaaaataatccagcatatgactagttgtatgtgtgacctatatattagggaaaaaataaagtacttatgagaatcatagccaccctcctgaaggtaatgtgattgcataaattatcaacataatacaaaggttaatttcatgcgcctggaagaaagatgacaaaaatacacattcagatgaacatcaacaaaacacggttgtgcatatagctttggaccgcgtgcctttcataccttgtacattgtgacaacgctttatattttaaaaaaatttccactacctgggataccttgaagagagcaagtactcttcttcaaggctatactgttttgtcgactccatacttgtgccttcatttgccgggtaactcattgagacatgattctccttagaacttttattggccatgctatgtatagcttcttgctgcagaaacaatgatcttatgctttcaagtgtcatttccacctgtctcatagtgggccgctcctctgctttcagcttgacacatgccacagctaacaaagctacttctttaacttcttttcctccctcttccacgacttgaggatcaagtatgtgacccaagttgtcacgtgtgagtagcgtagtgaaatgcgaaacaagaccgtcatcctcaggtgatctgtatgagtatggttttttcctagtaagtaactctattagaacaacaccaaagctaaaaacgtcgctcttctcggtgagacgtcccgtgtaagagtacatggggtctaagtatcctagtgttccttgaataacagttgtgactcctgtctgttcagcaggaatacaccttgaagctccaaagtctgatacttttgctgttagggagccatctaataagatgttatgggacttgatgtccctgtgaattatggggaatgatacagccgagtgaaggtagccgagggctctagctgtttcagttgcaattctgagtctatcttcccatgacaatgataatggcccttcaacatgaagatggtggtaaagggtaccattcgatatgaattcataaatcaacaatgacacttctgtctctaggcaacatccaaaaagtttcaccacattgcgatggttaatctgtgagagaatggctacctcgtttatgaactcatcaatctctctttggattgctacctttgatttcttgatcgcaacaacatgaagatccgatagaatccctttataaacggtgccgtgccctcctcctccaatctcacgagattcatcaaatttgtttgtggctttttccagttctgctaaggggatgatcatcctttcagcaatgtcggtattttgagataccaattgttgcaacaaatgcccacggttctgcttaaagaacatctgtctaagcatgtttgctctacgattcttgatcttacgtgttaaaaagactgcaccgaatgccatggccaaaagccccgcaccactgccaactccaataccaatagttaaacctggagcacaatagaagggaaaaaaagttttcttcattagagaggcgtactgaatttgtttgtaattgagaaccgttagtgccagtacttgccgaacagttggttaataagaaatcagccttatggaaatattagcctgtaaaaacatcgtagtctgcttttgtttgtttatggaacagagtaatttgtgctggtacttggccgaacaatcgactgttctctccaacaaaacaaccccgtcgtttggcttatttacaaacgaaaaagaatttatgaataaaacttttatatacatattcttaactcttaacgatctagaagcaaagactgaaaaataaactacgataaaaaaatcctaaaatcaactcaaaatttaaagttgaaaattcaaattttgcaactttaaattttgactcataagtataagcataagtgaaaatataagggcgaaaattccgttgcacattatagctagcacactctcaagtctcaggtagattagtttagcatcttcaattaatttagatgtctggataaattccaaaatgataagaagattaatttagttacctagatcagttttgacgcagcctttttcaatgagcgggttaccacgagcacctggcgggcacatgcacaagtaccctcctagcgtgttggtgcacttgttgccgaagcatgcgtccttatctcgctcgcactcgtcgatgtcttcgcgaatcgcccaaatcgacgggaattagcttttgaactcactgttaaaatggagtttatttcacgggaggcgtttttaattttgtaccttggcatccaccgtcgaggtaggggttcccctcgtagcccctggagcagttgcagcggtagccttctccctcggtggagtcgacgcagtcgctgttggcgctccggcacgcgtagtccgccttgttgcgcatggcggcttcgcagctgccgacttcccggatggcccaatccagcacgacgggcacggcgaagtcgccggtccggttgaagtcaccgcggtagctggtactgagccactcggcgtccgccaagaacacgtagcggtaatcagtggcggcataatactgaagggtgacgttcttgggcttgtcctggttcacgtagtaggtgtggagaccggagggtatcgagctctggcagcatcccacgccggcgcacgcccctgctgacacggcgagcggcgacgaccggcacagggatatgcaaccggtcacgtaattttctgtggcgtctaatagaaggccgaggttggggcagccgagtgcgacgaaacggttcttggccgacgagaagcggtaagggccttcccgtcccaagaacaagtacacgacgtcgtttgtgcggacgaggtcccccgtgctgtggttgtacaagctccgcgacgcgttgttgtatatccgggcctcaccatcggcgagggacaggctttcgagatggatctccaaattggattgggaatcgatgacggcgatgaggcgcggaggggagtaggtgtggttgcactcgagctggaatttgggcccgcgggcacagacggcgccgatgccgaaggggtaggggatgctgatgttgccgcacttgtcagggcagccaggcaatggctgagccgacgctggtgtcgccggcgccagggccatgcctaacagcaagactacggctgagatggcgacacccggctgcaggtgccttatctctgacatcctaccttagctaactctttgcccgtttctctgcttgcatcgcatgctggtttccgaataaatatagcgcgcttagttggagctggagccttggaggatcggaaaggaagatgcgtgctaggctcccggtcatcgttgaagaggtcgtttgattggtttttggggtcgacgtcactgttgcgtcgtcggtaaagcatggagccgggcatatgggcatgtgttccacttgcactgtcgcgtgggtcacttgcactgacaagaatttgggagccgagcatctgttccactttgcactgttttggtccagtcaactgccttgcctattgccaatttgcccttcttttttccttctgaaaaggatagtccccgcgagattccttttgagtctactgcatgtctgcattgtaatggatgaaggcatgtgttgtatactgtaagttggtggataaacaattgaacgctatgacgacgtctcaacctcacggtggtagaggaagccaaatggtatctgtcggctggttacctaactacgatagttgagtatacaagattcagcttataaggtagacacgagtgagaaatgccagggtcttctggctagctccacaaggtggtgggctagacaacctgggttcaaagtctcacaacttctaattatttgatattaggtccttccctaatattcgagtctcttggtagacatgagtatgggggtagaaaagtgagaaacaactattttatctaatcctattcagaaatgctataccacgggataccgtcccgagtgcgtgggacgatatcgcctcctcccgacggggcgagatggcaagagaatgagtatgttcacggcgagtaggtggcaagacgacatgatgatggcttcatggtcgcggtcgccgcctgctcatcgctactgcctatgaccgctccgatgcgaacactcggttatgtggggtgtggacggtggaggatgcggccccggtgacgagctccggcgtggggcatggacggcggaggatgcgaccgccggcgatgagctctggcgtggatgttgacgaaaaaaatcgaacacactagcctaggagatctgcttagctcctgtgcaggtccaaaggttgatgagatgcgggcgtgccagtcagtttgatcctgcaactgacaagatatgcaaatagtagatcaaaacagtcgatcggctgacaagccgatggagcaatctcagccgatatcgataatagctaatgccaataccagccgatagcgatagggttttgatagatcggctatatgtccaatgtagatgatgatataaaggcaatcggctgatgataatataatattgcaatataatctagtataaaccaatcggctagcaatgatatgataaataagcatcgatccgaggtttaaagcacacatcggctggaggtccgatgtcatgaaatctacaagattagattaaacagtgaaacctttgttgtcatcggctaaatccaatttatatgtatatgcaatcattatgagccgatgcaacatccagataactcaccggctgaaaccccgatgaaacccttattagcaattaagaagcaggctagagattatggttctaagcacgacttagtagatcaaacttaactgatgcagcactaagtatgaaaagaaacataatacctagacaatcaagccgttgactgagttttcagggtggtagatgtctaagctaatctaatctagcaacgcgatttagctgataccggcagaaaccctaaaatgagaagcagccgatagagctaaattgacatgctaagactagattaacagagacatgataaataggtaggcaaatatatcatccaaaccagagcaatccaagaggtcgaatgtactgatgcagccttgaacaacgtcgacgtagacgatacaattgcctggaccggcggaacattggacttatcccttcgccggagatcgaagacgatgcagccccgcgtcgggtgccaagtcccaccggaacttaaaaacaaaagtagaagtaaaaagggtggcgatgcgccgaattgtattgatcgtgaagatattacatagaccccggtgtgtacatatttatacccatgggttgatacaagtccttatcggacaataaacacactttcctaaagataaaaggaaactaacaaattattcctaattaatagataaactgccatgccgcatcctctttaaactctgtcacttagggataagcttcctttagtagatttatttccttaaccgaatatagcaggaatccgactattggcgacttgataactcctatcggctgattccgagatgctgcagccgataatgattctcagccgatgacgtctttgccgattaccaaatttcactgttaacagtggaacatggatagcggaggatgtcgtggctgcaccggggatgagctccggcgtggaacatggatggcggaggatgtcgtggtcgcgctagcgacgagcccggcgtagggcgaggcagcggaggacgcggccgccggcgatgagctccggcgtggaacatggatggcggaggatgtcgatctccggcatgggacgtgaggccgccgccgccgagctccagcgtggggagtgacggtaaaggacttgctcaaacgcggaggacacggccaccgacgatgatgccttggtgcctggctcctgatacccagtagaatcacctgatatcagtcggtatcgatctggtatcaacgagaataagtcaataccaagtatcacatgatacctcgtaagtataatcacatgatacctgataggaatcgtctaataccttgcaagtatcatttgatacgtggtagaaatcgcatgatatctaataggtatcatgtcctgatacctaaccggtatcatcccgctcgaacgggattccgttgtaaagcatccccctattcagatttagatcttcaatgtgaaaaatgaccctactatatttatatttatatttattgatccgggatgtgtattacaccaagtgaaaagggagtaggtagcttgtctagtccaccagacagtagacttattccatctcgtacagtttcggcccagttcgctcatcgcaaagagcctaaacaaaagggcccaatactaggccttctcctctctaatggccttccaacaaggctcaatgtgtctcgagggccttcagcccttcacgtatcatcctccccacccactctctctctctctctctctctctctctctctgtctcaagcaggtcagcggccggcggctggaacccttcctcccgtgcctccgccggcgtcgtcggaggcgcagactgtcattgtctccgccacagccgccatacatggtgtctaccagaagtcctccgttccttccatcctctgggagctgggagggagctgtccgctacgccatccgcaggctgttcctactccgccgccgactccatctggtctggtgagcgcgtcgcaaaattacgaataactctactaatttggtatggttcttgtcaaatcaggcatgcagagatgacctactctgtgtagaagaaaaaaaaatcctgtcagggacgatcgcctcccttcattggacgaccaactctaggagtgtgatggtcctgacccatacacggcggtatttggggagaaatttccccatgacaatccaatgtaactcgctttacagtatatatatctttgattttgtggcaagtccttatcttcttatttaaatgtttctatttaatgatcatgagttgtctatacatcatgttgttttcaccttttcttttaagagaagaacggacatgaacctttcaatactcatagtgacataccattcttctctatcgtctatgcaatttcttgcttttatattacagaacacataaatttcttggtcgttctttggttgcaccccatggatgtgttttcatattacatagaaaagaatttgtatgtgaattcattgatttataaaagattaacgcaaacaacattatctacaagctaaatgtatatgtacttccttcttccagatcaagaacatcatgctgcctgaattggtaatttggattttgatgttcaatgccaagcaagctttgattctcctcagcattacctttagcttcagcccaagggtgctgctggtatctcctcaacatctccaacctctctgctacctctttcatcgttggtcgttcttcaccgttcatgcttaggcatcgcatgaggaggtctgcaatctctgttgccatttcgtcgttcatctctttcctcacttggctgtccataagctctcgatgacgaccagccttcactgctgtggtgaagcgtgacaccaagctcatgtcttcctctggcccgtctaggtacaatgccttcttcctggttagaagctccagcacgacaacaccaaaactgtagacatcgctcttatcggttaactggcatgtcattaggtactcagggtccaagtacccacaagttccctgcaccaacgtggcaattgcagcctcatcagttggtgctagtttggatgctccaaaatctgcaactttggcgttgagcttgtcatcaagtaggatgttagccgtcttgacatctccatggaggattggtggagaagctgatgaatgcatgtaggcgagcgcctcggcggactttgcggctatccgaagacggttatcaagtgctatgtcagttgtgggttccttgccatggatgtagtggtagagggtgccgtttgagacaaattcatagactaacatgggcacttctacctcgaggcagcaaccgagcagcttgacgacattcctgtgattgatctgggagagaataaacatttctctagcaaattccttggtttgagcctcctccatcatcttggacttcttgatggccaccaccatgttgtcctccaggacacccttgtagacaacaccgtgaccgccgcggccgagaacacggtcagcggcgaagttgttggtggccttcttgagctcttccgtggaaaatattttgaacccaccagtgcctccaccagagtgcatctgctgctggaggatcactccaccgttctgctcgaagaatctttgctttgttctgatgagcttcctcttctggagccccaagtacaaccaaaagcacatgaacaccgacaagaacacaccaacgctgacccctgaagatggcattgcaatgtcactcatcagaaatcggagaatcaatagagagaaaggtgcattagggtgtgtttggttgctggccacactttgccacaactaacattaggtaagttgtagcagccacaaaagtgtggtggacaaattgctagccacaaaatgtgttaaagttggcaaaaaaaattaagtctatgacatgtaggacatggtattgaaaaaatgtggcaagtcacaactgtggcagtgaaacaaacatatacctaacacactgtggcagtcaaaagtgtggtgtggccatgaaccaaacacctccttagtgtctcaaaattacctgtgactattttcagtgctaatgtgaacttgtcgtttggacggcaatcattttttatggcatctccgctgaatccatgagggcaatcacacttatagcctcccagcagatttgtgcagactccgtggcatgggtacttgtctaagtgttggcactcgtcaatatcttggaagaggaaaaacaaactcatcacttcttgtcagaatgattgttatttatttgagggcagagaatataagaatggcgagcaaatgaacaatcctcaatgttaacttgataaccaatatctgcattgtattaaggtgtctagtattgtatacctgtgcatccaccgtcaaggtaggggttgccgtcgtagccattggagcacttgcagcggtatccgacaccattggtggagtcgacgcaatcgctgttggtgctcctgcacccgtagtccgtcctgttgcgcttggcgatgtcgcagttggcgacgttccggatggcccagtcgagcacgacggggacggcgaagtcgtcggtccggttgaagtcggcgctgtcccggtaggtggtgtcgacccacctgtcctccaccacgaacgcgtaccggcaagaagtcgtgttctcgcggaagattctcccctgggcttcctggaagccttgaacggacgcctcgtagtaggtgacattgggtggtatcctgctctggcagcacccaacgccggtgcacgccgccggcgacacggagttccactgcgacggtcggcagacggacgtgcagccggtgatgtagtagcccgcgtcgtcgctgaggtagccgaggttggggcagccgagcgcgacgaagcggttcctcgcggcggatacgcggtaggtgttgctgccaaggagggacaggtacaccgtgtagttacgggagttgtcgctgacgtagctctcgttgctgctgtagcactggcggaacacgttgacgagagctacggcctcgccgtcggcgatggacaggctggccagattcagccggcgcccggccaagatcgatgtaggcgtggggagtggagggaagaaggtgaggcgcggagggaagtagctgtggttgcagaagagctcgtagccgaagtcgcgggcgcagcgggcgccgatgccgaaggggtagggaacgctgatgttgccgcacctgtcggggcagcccggcaatggctgacccgacgctggtctcaccggcgccagggcgacgactaacagtaacagcaacactacgacgcctaagctggaaaacacccccatttctgaactctgcattgcttctcgttactatgacgctggtttcagcatgcataaatagatcgtattgacatgacatgagtatatggcacgtgcacttcgttctttaatttagttggagaattgtaaaggaagatgcatttgcatatgctcgttgacgagctaggttggtcgcttcggcggtcgacgactcgacacgtcctccgaaccggactgttgcgtcgtacgacaaggaaggagctaagctgttccacttgtaatgctgggtgggtcagaaaagcacgaatccgagcatgtgttccacttgcactgttggtccagtcaattgccttgcccatttgccaatccttttcttcagtggaggacagtccccgcgggattcatttgttcagaaatggaaacgtatttttttttttgcgaacgtaaatggaaacggatttgcagtggtctattccttccatcccaaaacaaaacaacatgggatggaatgtaataatctagtacaagtacaatgaatctaacattggtttatctagattctcgttgtgctagattatattatatcttatcttaggttggaatattttgatatgaagggagtagtgatttagtagtggataccatcgtatatacagcgttcagaaagataacctggcaaacaatgattttattctacttcctccgtttcatattataataagactttttagcattacccacgttcatatatatgttaatgaagctaaatatatatgtctaaattcattaaaacacacacatatatatgtaagcaatactagcaagttataatatgaaatggagggagtagaatctaaaatgacgcctaagtgtcgtcttgtaaaatttaagggcaaccaacagtaatgatttttggaggctggattcgcccttgatcactgatcaattgtccctcggctatttctgttgatttcttacttcctgctgtgttgccggttttctctttgctcctcgttacaaagctactctaaactaatgtagtacgaccggcctgtatatatgctacggagtacgtacgtttatgcggttaattatacaagagctgatggccgagtaattaaggccaggtttgatttcatgggctaatgtttagccctcaccttttagcctcaaattagcccacaagaatctaaacaggtaggctaattttgggctaatatgaattagcccccctcaaaacattagtctctccaaatatgttaatggggctaattttgtgtggggaccataaaaaaacagctctctctctccttctctctcctctctttttactctctctccaccttttagccttgcccatagatccaaacatacgattctaggctaatgtttagcctaccaattcatgactaaatattaccttttaacattagctctaggctaatcttacataagtattgtaaagaagcagcctgcactcgacaaagctatttaattgatttactcgaatgatgcggaaaagcagggtgctgactgctgactcctacatgctctgaccagtcaactgcactgctatttgccaatttttttcttcccacaagagaaacgaaaattccagaatttttttcggttttagatttttttttaatatttacagaaataatctatcgaccaaaaaaattacagaaatagcccctgccgcccacctctggggcagcaagctgacgtggcaaacgggggaggaacgggcggtgacggagggagggtttttttgcaggaaaacccttgccgggc

SEQ ID NO: 25314 - DNA, 8060 bp, Oryza sativa
ccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctaatttggaattaatacattaccgttgcattggcttacacaagaagatattacgttgtagatgtttattgcatgaaagagtaatatgatctagttatttcgttgccagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacaaacaagtgacataacaatcaatgttatagtaagtcgggcaactgagggtttttattgggaactaatgccagttcaaaactctcgagtgtggagatggtatttggaaaatgcattgcaatgtgggtggcctctagctttggttccgtttgttcacccgaaggatccaggtgtgcagacgaacatggatgatggtgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacacgtataaggggaaatggaaggattattggacagtgtcagttgttaccaagcatacatgttttctacctggtgttcagaaataccacaggaacattacatgtgcatttgttgcatctgagatgtatgcgcatgtcatcgataatctcacatatgaaccaaggtcaataatctgacacattgaagagacatacaagtatactattagctatgccaaggcctggagggccaaacagaaaataatagagatgagatttggaacttacgaagcttcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcattcgtgaactgtcgtcctgttctctgcattgatgggacattcttgataggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcgtcatatgggagctaattttttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcagaaattttctcagtggattctgcatgaacgaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggtagttcttccctctatgccgaacaacagcattttgtttggagctttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacgtggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgtcggactaaggcgcctaacgtctttaggtatgctgatgtatgtcagacttcgacacgtaatgttatgttatattattgaactctacatatatgttaaattgcacgtcatcattatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacaatgttttactataagttagttgcactgtaatattttttataatgacatattaatttgttattgcaggctacgtgaggccggcctcctaccgatgtgtcggctggtggaggctgcggccggcgacgcggacccggccagacgatggacggtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtacagcgtgcaccgcacctcccgctcgagccgttggcacaccaccgcaacaccagacctacgaagaggtggctgcttcagttcaccgtgagtgtttttgtaccgaaatgacaatcgtattacatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcggtcatgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgcagcggctacccaggctcgtgcgccgttgggtctgtccacactctgcaccagggaccaggcgtactggatgactacggttccgatggtcttcgacatctgcgttgagcctcacgcccctttccgcgtgatgcggcagttcggcttccatcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcactcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgatggttcaatgacgatccaacgtttaggcgcggggattccggtacccgtagaggagcacctgacgacgtacacgcggatggtggagtcgatgcgctcgattctccgagttctcacctgtcgtgcagacgacgttgctcgggcagacgcagctgtacagcggccacccgtaccaactggtccccgtccagctgcgcacgttcctaggccgaccccccctctgcacggaggtaagtatttttattactatttctgtacatgcctcgcacatataagtgagccgtttcacttgccgattgcttcagggtttcgtgcaccgttcagcaccccgccttcctcagctaggccttatgttgtgcccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgtagggtcagcgtctcaggcagctgtgtcgacctcgcactcagcgcagttctggcagtacaccgggacttcgtcacaggcagtcggcacgtcgagtcagggtccaccactggaccatgctgggacctcgtcggaccacttgttgccttccaccttcctcttcgacatcaccgacttcgacttcgcttcaggctcgacagaggacgtcatcggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgtgatacgagtatttgcccgccatttggcgcatacgaccaatgtaactgtcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatctaaactggcgtagcgatccttgtgtatacctactaccaccttggtgtcagcgtcctctctgcctatgcggtgatcgatgccaactaatggcttcgaggaatcctgatattcgaggaaggcgcttttttaggtgccctaactatgaccgtgaggtattttattatctgcgtatgcttattcattccgtatgggcaatcgctttattcttcgtaacactactctattcggcagacccgcactacggcttgcgcatacatcgagtgggtcgatacagaaaatcccgttctcgacctaaccacttgtttacaagaaggtcgctggtatttcgcatccgaaagtactgagcaatacttacagagaaaagcggcttataaacgacaatgtcgtgaacaacagagcgactggcgggtgctaactacggcactccctccatgggaagcccgtccaagatgcaggtgtggtgatcgttgtcaggttcttcattccataaatcctacaacattgggtcgaaggttctttgtttgtccaaatattcttgacgacgatttcatggtaagaatattttgattacatgaatccttattttctcacaacatttactaactttgcttgctttacatctattcattcctcccaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccctgtcccattactacatcgtcgttgtgttcaactattgcactacctccctcctagttcgaatctaatatcatctatgtaaccgcaatgcaaatagttgtatcatgttcaaatttaacataattcttcatgtaacataattctccttgtttaagtccatataatgtttctacgacccagactgcgataggcctatataaattatccgagtactaatacgtcgaataaggtacaaaataatacctcacttaacatatgaaattgcgcaactcaatacatttttataacaatattaacaagttttaccaataaatacttctttatttattattaacataacatagaaaaatcttttggccgtactttttcatctgg

SEQ ID NO: 25315 - DNA, 13861 bp, Oryza sativa
aaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaatttttttggtcgatagattatttctgtaaatattaaaaaaaaatctaaaaacgaaaaaaattcgaaaattccatgtgggacttatgagaaaagacggcccagattcattagagcccaggacaagggaggccaccgtgcacatttgccgtcctagacctattccagcccaacccaccacgcattcgcaggaatctcgtgctcaggcctaattcggctcgcgcgttagcgagagcccagtttaggcccaccatatcaacttagtgcaaattccatttcggcccaactagtttgtcactgtaaaggggcctaaaaatgggctaaacgtgttagccttgaaacctttgtcatctctctcaaccacgacagcagcgagccggcggccggaacccctccctccgccgtcgccgccgccaccgccgtcgtcgggggcgatcagatccgcaccgcacgcggaggatatctataccgccgccggaggtgttgacttcctgggacgccctccgccgggtttcccacgctctgcgcctctgcctccgtcaggcctcagggtgagtgcgttgccaaattatggttagctctactaatctttcttcactctagtctctactggtcgtcttctctactcctgtccgtgtgcttcagtcggtctcacccgcacatcgcagtgtgggctagggctagcatcatgaatcttttcttacttgcttgattagtgaagtgcattggtactgtgccagtcaaatcggagctcacccacacccactctttaattaacaaattttcctctcatggatgattgccttccttcatttcattggacggaccaactcttagagtgtgatggtctcctgaccatacacgacgatagctaggggtaagcctgctaatggactggattggaatgggttaaatggattggttttgtatttgggtttgctttggttggattgaaatgggcacacgctataaatggctcagcacggaaagctgagccatgatgacctgatatgtattcacttagcaggggaagcttgaatttgctattacaaggtagcaaattcttcggatggctcatgatccattgaaaaatccttactgcagacaactttcagattcgggaatgggataacagtgagatttgccccttttatggtatagaaccagagactacccaccacctcctcatagattattcattcacaagacaagtatggagctccatatggaggaaattgggcctccacacgccttcaccatccctcttcactggagacatgctaggttcgtgggaagcttgcaggaaagaaatggtacgcaacttcgatggccttttcatccacacggctcggggtatttggttacaaacgaatggaataatctttaatgggatatacaattccgtgcttcaggtagttgattccatcatagatatgtgcaaggagtttgatgaagcccaaataacttagatgatttttctgcgcgtcttgttattagttgctttgcattaccttaaacttatgtgcctgccctccacgctctccagggatggaggttgtatgttgtaaaactttgtttttccccctacttaattgaaattggcagagctccctccttccccttaaaaaaaaacctctatccaactaaaactccaaaaggtatataaaattacatagagatggtatgcaaatctcttatgttcttacttaaatgcttctatttaatgatcacatgttgtctttacatgatgttgttttcaccctttcttttaacagaagaacaaacaagaaccatttaatactcacagttacaaatcattggtctatatagtctatgcagtttctttttttttattacagccacataaattccttggtggttatttcattgcaatccatatgagtgtttccattcatgttacacggaaaagaattttaaagattttgtatcagaacagattgatttaccaaagattgacacgatcagcatgatctataagctaaatgtatatgcattgccttcttccagacccaggacatcttgttgcctgagttggtaatttgcattattttgttccatgccgagcaagctctgaatctcctcctcattgccttcagctttagcccaagggtgctgctgatatcttctcagcgattccagcctctcagctacctctttcatcgccggtcgttcttccccaatcatgcttaggcatctcattaggaggtatgtaatctcttggagcatttcgtcactcagctcattccttacttggctgtccagaagctcttgatgacgaccaaccttcacagctgtggtgaaacatgacaccaggcacctgtcttcctctggtccgtcaaggtataatgccttctttcttgttagaagctccagcacgacaacaccaaaactatatacgtcactcttatcggtcagctggcatgtcattaggtattcggggtccaagtatccacaagttccttgcaccaatgttgcaatctcagcctcatcagttggtgctagttttgatgctccaaaatctgaaactttggcgttgaacttatcatcaagcaggatgtttgctgtcttgacatcaccatggaggattggtggtgaagccgacgaatgcatgtaggagagcgcctcggcagactctgccgctatccgaagacgggtatcaagtgctatgtcaacttcggggtctttgccatggatgtagtggtagaaggtaccgtttgagacaaattcatagaccaacataggcacttcaacttcaaggcaacatccaagcagcttgacgacgtttcgatggttgatctgggagaggatgaacatttctcttgcaaactccttggtttgggcctcctccatcatctttgacttcttgatggccaccaccgtgttgtcctccaggacgcctttgtaaacaatgccatgccctccatgaccaagaatgcgatcaactgcgaagttgttggtcgcattcttgagttcttccgtggagaaaatcttgaacccacccactccaccgccagcgccaccataggaacgcatctgctgttgcagaaagattccaccgttttgctcaaagaacttttgcctcgttctgatgagtttcctcttctgaagcctaaggcggagccagaatgccatgaacaccgacatgaacacgccgaggccaacccctaatcataacgttgcatatacataggctaattttaggaagaaattgcagactaaaaccattgaaagttaagataattgcatacatgatgggttagttcgatcattaattacctgtaacagccttgagagcaaacgtgaacttgtccttagggcggcaaacattcttctcgtggacatttccaatagtcccccgagggcataagcaagtataccctcctatcgtatttgtgcagtctccgtagcatccgtatttctctttgtcttggcactcgtcgatgtcttccgtttgcccagaaaaatcatcaaactgatcagactgcagcattatatatccaagaaaatatacagtcccatcttttcacttatgtttatgattgttagttaaaatttgaatttataaccttaaatttaaagttgattttgaggttttttcgtcgaagtttatttttcagtctttgcttttaaagtgttaaaaacacggacataaaagttttatttacaaattatttttcgtttacaaatatgccgtttggtttattccgtgaataaccaaacgatgggagccatagagacaagtaacagttgattgggttaaaatgattacctgtgcatccgctgtcgaggtaggggttaccctggtagccattggagcacctgcaccggtatccgacgccgtcgctggcgtcgaagcactcgctccactcgctccggcacgcgtacttggtggcgttgcgcttggcgaccctgcagttgcggacgttccgaatcgcccagtcgagcacgacgggcacgtcgaagtcgtcggttcggttgaagtaggcgcgatagctgtacgtggtgtcgatccacttgtcctccaccaggaacatgtaattgcatgccgtcgagttgaggcgatggtagatgggttccacgcggttctcctctgccgacttattcaagctgaggatgtaaggcttgtagaagttgagaggccgaggtatggtgttctggcagccataccaggtgatcattaccggcttgcgacttgcggcacatggatatgcagccgctgacatagtactcctcggcgtcaaccaggtaaccgaggacggggcaaccgagcacgacgaacctgttcctcgccgcggagaagcggtaggcggtgctacggccgaaagacacatcagacaacggcagctggccctggctgtccctcctcaaagcattgtaactgatgtaggttgtgccgtcgctgcaatagtttctggcgttgatgagggcccgggcctcgccgtcgagggacaggctaaccagctcgacttcagacacgaagaggcgcggaggcgagtaggcgtggttgcaaacgagccggaagttgaagtcgcgggcacagcgggagccaatgccgaatgggtaggggatgctggtgttcccgcacttgtcggggcagcccgccggctgctgagcccacgctggtgccaccggcgccaggcagacgatcaagacgacgagggccgcaccctgcaggcacagggtagtggtagccatttctaacatggtagctaaactctagcctcgttgctctacttgctaatgttgccggctgtcatacccatataaatactccagttaggagtagatgatagtgctgcttatgacgacatactacctcggttgtcctttttaattcatttgacttatataaaaatattgttgcaaatagacaaatgcttaaagtacttttgatggcattatttagctgagtaaataaataaataaataatactgttagttgaagattaagaaaaaaaaattaattgtcatatattaagccagcttcattgacgaggttgacattggtctgaacgcgagcgcgcgcttcgtcgacggtcgacatcaccgaagttcactgattttactgctggctcggttgtttcggaattgggaggccgctctggtgcacgttgtacctcggtcctttaattgacttccttcccacctgaacttgtcctgctaaatactactcactccatcccaaaatataaatatttttaaatcttgacatggtttctgatatgctactttcactaacaatatctataaaagtatgatgttttaaataaaaaatattacatgttatgatagtttatttaatgataaatctagtaaaatcaatttatcttttttatttttttctattaatgattaaagttaaaaatatttgacttgtcactatgctaaaaatgcttatatttttggacggagggagtactgcgcatcatgttgtttaatttgcgcgtacctgtacgtgtaaacaggtttccccaatgcgaacaacctccatcccaaaaaaaggcatataggactggatgtgacacattctaatataataaatctagatagagatatattcagatttatagtagtaggatatgtcatattcagtactaggttgattttttatgggatgtcccaatacgtatgtggtagtgcgtttgtgaactgtcggctctcttcatgtaaagtcaaataagaaagatctttcatctaatgacgagagttgtttttaaactttcaagagaacgttctatcgttatttatatgttaaatagttgcatactattagtaaaatattttttaatcatccacgtcacattaatactccgctaatacaaacattactattttgatatgcttttttaaaactacgcatttctcgcttatatagtgtgtataaatatgtccttttcttctctttcctcatttcatgcttactagcaaaatacccatattttgctattaacagaagaatcataatatgccatagcaaaatattttttttatcaaatatcttaatatcacttgtttgctcatttgattatatgttatccatttgtttgaactaaatagtggatcatttcacaatattaataaatatcaggggacaatttgtaaaaactgcaaaaacaatatgaacagttgggtagcaaatttactgccatcaccattagagtcttttaaaggagtacatatattctcacgtaatcttttattcgttgtggacatattattcaatattagggaaaccattctagttagagaaatgagaattgagattgctctgctacagcttaatctccctgctaggctgctacttgttaattactacaggaacatagtgattttacgaaaaacatctgaaatttcaacgttttaagggagccaagtgactacgtggcatatgcatggtcatcatctctgcgtggacctcgtccgtgagaacgcatggccagcatcgcgcctcaactcgatcgatatcgatcgtgtcgaacatgacgcaaccagaagtgaagtgtagcgcatggattcaagtggggaaggagctaaatgagtgaggtagtgacgctgtgaagcgtctagcttttactgaaatccaacacgcataagcataattaagggaaacaatggtccagcttttactgaaatccaccagggcccgatgggtttgtgtgcaaatccaagggctgcagcgacttggaatgctctgactgtttcgtggttgaaacttgaaggttagcttagatagttttcagctaaatacgtgtcagcgtaaggcctttgtagtcttgctacaagctctatcttatcttacgcagttcctgtgttacacactcttcccctgtggtttctttataggaataaaaacaaaacggattcgaatggatagtgataataccatatcacaacccatatgttttaagtgtaggatcgtaaaaggtctttcccatctcaaaagctagtcattaaggtgaggggctcctccacttatatcttaggtcatttgtccttccacatccccaatctcctctttctcccccttcacacattggtgtccctcaaaagctagccattaaggtgattggtttctccacttatatcgccattaaggtgaggggcttccccacttatatcttaggtcctttgcccttccacatccccaatctcccccttctcccccttcacacattggtgtccctcagccccttcccgtatccgggccccaccggcccacggtccatcaggtatacgggccccgcaggcacgcacagtccatcaggccttcacacactgtgtccatcggaccagagatgttaacctagcctggctctgacaccaattgtaggatcgtaaagggtctttcccatcccaaaagctagccattgaggtgaggggctcccccacttatatcttaggtcctttacccttccataaccaatgtgggactattcaacattaagaggattcgaagtgaatgcagagcagattgttttggacgtcgtaaatgatatggtattggtgtggattcggtttgaaaatatattgaaattgtcagttataacatgtatatgcaatcaatataacatcaagttagcgatacaacggacaacaatataattaaaatgaagcatccatccgaataacttatatgcttaagtgctaaataattgaatatatgtatatctataatataaaaaaacagttaagcatgtgtgagatgagctctaaggagtctatgtgtgccatctcttgcagtatgcaacaaacaaaatggagttgtggattgacaatttcgaattgtccgacaaacggcctatcggataattcgatagaaatgtcggataatctgcgtctgctggattttagagataccatattcacatcaaaatccgcagtgtactatccacatccgccggattatgtaagaccataccatatcctcgtttttgacggatttggagtggatcgggtcagataatttgctcctcatttttatcacccctcttcttttctttctagaatttggtcagaatattaaaatggattattggcttcccattttttaaaaatatttttgtcgcattcttggatcgcttgttttaagttatttgttaagttcatttatccaaaatatttaatctatactataatcaagtagataatttgtagcaacaatccgttcaataatttatttttaattgcgccagttaagatgttgctatctatctctctttgcatcactctcttagttcaagcaatgataaagttgttttcaaacccctaagagagcaatcataaactctgataaaaacctttccttgttgaaaccatgagcatgtgcggctgcactactgcagctgtttgtttttttgaaaattcatcagagcaagtttaatagtatagccaactactagctccaattcatctgtagccaatctaatagctcattcatacaatagttacatactacactattaatacatggtcccacctgtcacacacacactgcgtcttggagtccgtgctacagctgactacaaatctatagcccgttgctcttctctctcctcatttatcttcttaaaatatgtttgtagctggcttatagcctgctattgtacctgctctcaggggggagagcttccccacctgaattcattaaagcagaaaagaggggaaaaatagttcagtttatcttattacatattaagagagtgaagggtggaagagaagaggaccttccaggatgaaattacatggctatcatctaatttaaaccgctcagcccagagagaggcctctgaaacacacatagcatatacataacatagggaagcttccttatgcctaaagaccaccccataacgatgattccatagacaccagaagcatagcaggtattacacccgaaagtgtttgctggggatttgaggaggtagaggaagatgcgccagctcgctcgtcaacgagatgttgatattaatgcgaaggttattccagaaggcatcagcaagggggcagtggaagcacatgtgcgaacccgttttcctcaaccaaattgcagaggtcacagttgggggcagaacacgatgtttttcttatgaaggctctttttcgttggaagccgatctttagcaagaagccaggcaaagactgaaccttgagaggtgctttgttgtcccagataaacttctaattcgggcagagaggtgaaccactgcattgggcaagatagagctgacttgtcttcggaatgtcactggtattcttcgcccaactactgcagctgtggcacaaccacctcgcagcacagtagtttgtgtcatcgcagcagctatgctggctgcgttgcagcagctgcaatatgcagcggaacactgcctatgatagagagcacaacgtcccctcctttacccccagaccctagtagtaaaggtttcccgagaactctgcaaggataatcttctagttcgtaaaagaaaattgactctttttaacgtgctccaacataataaaatcctagccgatgattgttttgtgatttattttccaattaaaaatattttttctccttccacaaatgcatttatctaacaaggaaagtaataattacccttagtaaaatatgcatgtatatatatgcgtgcatgcatggatataaccaatggttgagaccatttaattttaaaaaaaatctgttttttgtttttttaaataatgaaaatggattacatcttcgtcccgtgccagtctcataaatctttttttttgtttttttaatatcccaaataaacataatgtatgccgtatgatttgcactagaaaattttaagttttaaatgactgcaattctgagtcgtgaattgttgctatgtaaaataatattgaaagaacatataatacaaaaggcataaatttcttttgataaatttgtcaaccggggatacccatagaccggacaaatggagtattggagtacgttggtacgagattctacacgatacgtcatcaaaacagaaaagagaccaggattatactggttcaaccccctcgtaaggtaatagccctaatccagtttatataagattgatatagaaaaccatagagtacaaagagaacagatgaacttgttgataacgactagattgtcacgccccgaactagtaccgaccggaactagcccgtgacgctccaaattaacctgttaatcgataccagtcccagaaaacagtgctggtatcacaggaagacggattatcacagcaacacaagtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatataaagcaagggtgagtacgggagtactcagcaagctatgggaaataagtgtttaatacaggcttcaaagaaaggctgttgtttttgcaattgattttatttgaactcttttctaaaaacaactaagtgagtgcttctcaaacgacacgggtgagacagtgcgtctcgtccggtcggagtatgtgcaatgtatcagtctttagaattgaaacaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactacgctaggaatcacttcacatccgcccatgaccgtgggcacggctgttcgaacagtttgttaacctctgcagagggggtacactttacccacacgacattactaacccggatcacccagcccgtggggatcggccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtactcccagtacgttccccggtccgtggttttggaaattcatttagttcgcaagcaccgacccaggtgtcgggttttccaagtcttttgtaaaaccctagttttacccaagttgttaatcagatttttaagtttgaaggcgtccgtcgatacccgcacagggtgcacgaatatcgagacgcaactagatggttacaaggggacatgacataacaattaaccaatgaaagatcaaatgcaacaaattaggtaggtccgccaatctgccttgcagacgggacaacagattaagtgcgatcctatcaatgcataatatttttcaagccacataattaaatttcaaatataggctcaagatgttcaaaggtggcttgccttgctcgagatctggagcttgatcctcgaaatcctcgcactgcgggtcttcgggctccgaaactacacgcgaagcggggcaactcaacaaacggcaaaaaaaaaataaagccctattgatgacctctaagcgtgccattagatagatctcgagatttgaggaattttggaagttgaacggagtcaaacggatttacggttgggaagatattgaatttctaagattattggatttttgtctaaaggaaaaggatttaattaaatcctttttggaaaagaaaagaaaagaaaagaaaagagggagggaaaatagacttttctcgggcggctagggcgcggcccaagggaaatggagcggaccggccgagctaaatgggccgaccggcccaaggcggcccaagacgcgcgcgtgcgcgggagggaggagagagagagccggtggaccgggctcaccgcgcgcggtcccgggtgggacccgcttgtcggtgacacggctcactgtgcggagcgagcacgcggcgtacgcgcgcgggcgggggaggaacgcggtgcatgcgcgcgggcccacgcgcagcctcacggctcgcggtggaacgcgctcacgggaggggctgaccggggtcggcccgtcccgacctcggctgagctggcaccgacgtggcgcctacgtggctgccacgcgggccggcgggaggtagacgacgacaccggccggaacggacgacggacgatagcggcgagcggcggagcgaaccacggcgatacaggcgaaagcgagcacaccgggtggttgcacgagacgaggggaaacgagccaacggctcggattcgccggaggaagcttgacggcggcgaatcgcggcggcggcaaccggcggggagggaagagggaaacggcgacgaggtcacgaagggccgattcccggcggtgagagcatctacgcggccacggaaatccgatgctagcgtcggattgggcggagctacgccgagcgaggccggcgacgagcgggtgctacggagctcgggcggcaacggcggcgagtacacggcgagcgacggcaacggtcggggcggcgccggctagctacggggaggctactcgtgctactacccgtgtctaaggggaggagatggagcgaggaggaagaacggagagaggcactaccgtgcgggtcggggtgctgtgacgagaggccgacggcgcgggagtaatctctccggcctcgggccggggaagaggaaggagagggcgcggccgaagtccccttccacgtccttgctcgtgccggctcctccgacacgcgcaacgacgaacggcgacggcgaaacagaggggcggcaatggcgcggaggtgaatgggagaggaaaggaaaaagggggggagctcgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaagggggcttgtccccttgcctcttcgggaaaaggaggagggagcgggggcgtcgcggcagagggaggagggaggctctgcctccgtcccttggaggctagcgcgggagtggcgggaccgaggcgatgacgacggcgatgacggcggggcggtttggagcggcgcgacgacacgggcgacaggcgcgggctggcgcggcagagggtgacggcggcggcggcgaccaggaggtcggccactcggcacgcatgcgcgggaaacaacgggcggcgcggctgggcacgcgcaatggctcgcggggccgagcggttgcaggcgcggcagagcagcggggccgggtgacgcggacgacgcagacgacgcgactcgggcggggaaccacgcgggcgcgcgcgcgcgaacgactgcgcgcgggggctgtcttcgcaagcggggagctcgccaggga

SEQ ID NO: 25316 - DNA, 602 bp, Oryza sativa
ggaagatgggccgagagaaattcggcccatcgaccccgggggaggcaaaatagacttttgcggaggaatttgatttggaaagatttggattcggatttgaacttgacgatagatcggggatttgagatctgagatggcacggacactagacaacaagcaaagaaacaaatttcacaattagggtttttaagagataatttttcccgctaggcgccatgacggaacgggcgctacatagatccctgtcgagattattcgacgagatctcccagcggcttcggcttgagtccttcggctttgtagactacggtgggtgtgttgacgctatgattcgatgatcctaaacccctctgggggtgtgccttttataccgtgagttgccttagtctccaagtagaactcgtagacaatgaaaccggcacgatatagaacagtcccggtccttttcgagtaggactctggtagtctccagcccgtaaggacattttccataatgtctatatttccttatcatgtacgaaaacatattgtaggatatgaggtatgtcaatccagtataattggtaaatcatacgataagaactactccctccatattttaa

SEQ ID NO: 25317 - DNA, 22537 bp, Oryza sativa
  unsure (1)..(22537): unsure at all n locations
cggcgtcatacattaaaatacggagggagtatgtattatttgtaacctgataaaatttcccatatgatttgattgtaaaaaaacaagaagttattcgttcgtgggctgtgtgagtcggggtggttgattaggcttatgggctttgctttgttaactggggtatatttagttcacgtcaaaattaaaagtttggttgaaattaaaacgatgtgatggaaaagttgaaagtttgtgtgtgtaggaaagttttgatataatggaaaagttgaaagtttaaagaaaaactttggatgtaaactcagcctgaagctcgagaaagcattgaaaatagactatcgaggcttactgagtacttctgactactggagcggcgtacatcctaaatatttcgcatatgttttgggtatgccacagtgcataccaggaacacacatctgtctcttggaataaattcccattaaatcttctaggaaagattaatcgaacgagagctaaagggttaaagaaacattagccatttgattaatgtataatggacggttaaaaatattttggtgtagctgaaaaaatccaagggtgcatagcaattgactgggccagactgatcacgtgcaagtggaacgcatgcacatctccctgcttttctgagaaatccttgcaaccacactggtcgtattcgtatcaatcaggcaggcagcttcgccaacgaagaagcacgtgtgcctaagcatacatcttcttttccactccaatcttccaactcatagattaattgctttagccagtactccctccgtattttaatgtatgacgccgttgactttttaattaatgtcttaccatttgttctatttaaattttttatacaaatacaaaaatacctatgtcatgcttaaagaatatttgatgataaatcaagtcacaattaaataaatgataattatatattttttttatagacgaaaggtcaaacatttgttacaaaatcaacggcgtcatacattaaaatacggagggagtaaaatctataatctatttatatggaaatcaggcggccatttaagcaaacagagcaacgagacaatagttttagctatcatgacagaaatgactaccagtgccctgcatctgcaggtgcttgccttaaccgtcttcctcgtctgcgcggcggcagtgacaccagcggcgtcggctcagcagcagcagctgccgggctgccccgacaagtgcggcgacatcagcatcccctaccctttcgggatcggcgcccgctgcgcccgcgaccaatacttcgagctcgagtgcaaccgcgcctactcccctccgcgcctcatcgtgtctacccaccggcaacatctggtcaacctgtccctcgccgacggggaggctactgccctcatcaacgccagacgccagtgctacaacagcacggagggtttgatcggtgatgccaataattatgtcaacaaggatatcactcttgtcggcagcaatgcctaccgcttctctgcggcgaggaaccgcttcgtcgcgctcggctgcccaaacatgggctacttcgtcgacacctacggctactacgtcagcggttgcacgtccatctgccggccatcgcaggggaatggtgcgagtggtgcctcgaccgggggatgcaccggcgagggatgctgccagagcaggataccgaccaataccgactactacgagctgtacgttcaaactttcaaaccaggggaaggggaccccatattacgtggcggtacgactgcttgccggtacgtgtttctggcggaggacaagtggatcgacaccacctaccgcggccacccggacttcgaccgaaacgacgacttcgcggtgcccgtcgtgctcaactgggccatccggaacgtcggtaactgcagcgccgctactcgtaacatgacggactacgcgtgccggagcgtcaacagccactgcatcgactccattgatggccccggataccgatgcaactgctcccagggctacgagggaaacccctaccttgacggtggatgccaaggtaaaaaaaataaccacacctcccattaaataaagggagaatttgaaccatgccacacaaattttgcaaaatttatgatataccaccctgacctacatgtcattgactcatgtgggtcctacatgtcattgagatacgagtggtatatcttaaattttgcaaatatagggtggcatggttccaacaaacccttaaataaaactagcatggtgacccgcagattgcgcggctagcatcattgtattttctctcatataatagcatatatgttttctcattatattattcaaatatattaaaatgacaacataattttaaattttgcaataactttataaacctactaatgtgtaatattcatattatattttatatacgtgttagttattaattatttttaatatcaaattttagttatttgtaaattatatatattcctatatggactctagactcgtcttttaatatttgtttttttaattccgaattttctgtaaattgtatttctatatagactctatgctcttcttcccatattatttatttttatttcagaatttttgttatttctaattgtatttctatgtggactctaaactcatctttcaatattctttaatttttaatttcgaatttcagttacttctaaattgtattcctatattgactttaaattcttcttctcatgtttttcttaatttcgaattttagttatttgtaaattatattttatacggactcaaaactctaattttaattttattatgtttattccaaattttagttagttttaaattcctatatggactctatactctacttctaatattccttactttttaattccgaatttctattttttttcttaattgtatttctatatggactctatactctacttctaatattccttatttttaattccaaatttctattattttctaattgtatttctatatggactctatactctacttctaatattccttatttttaattccgaatttcagttatttcctaattgtatttctatatggactctagtctcctcttctaatattccttattttttaattccgaatttcacctatttctaaattgtatttctatatggactctagtctcctcttctaatatttcttattttctaattccgaatttcagctatttctaaattgtatttgtatatatggactctgctttttctttttcttcgattaatgtgagaatttttaggccatgagagcgaacgtggaggctcatttttctattcctttaataatataactagcatggtggcccgcacagattgcgcggctagcatcattatattatctctcatataatagcatatatgttttctcattatattattcaaatatattaaaatgacaacataatttgaaattttgcaataactttacaaaactattaatgtgtaatatccatattgtattttatatacttgttagttattaattatttttaatatcaaattttagttatttgtaaattatatatatacctatatgattgaaaactattttttaaaatttctttttttaaattccatttttcgtaaatggattttaaataagatacaaggtttctttcaaaattatttatttttatttcagacctttgttatctataattgtatttgtatgtggaatataaacttatctttcaatattctttaatttttaatttcgaatttcatttacttataaattgtattcctatattgactttaaattcttcttctcatgtttttgttaatttcgaattttagttatttgtaaattgtatttttatacggactctaaactctacttttaatttgattatgtttattccaaattttagttagttttaaaaatcctatttggactctacactctacttctaatattccttattttttaattccgaatttctattttttcttaattgtatttaatatggactctatactctacttctaatattccttatttttaattccaaatttcagttatttcctaattgtatttctatatggactctatactctacttctaatattacttatttttaattccgaatttcagttattttctaattgtatttctatatggactctatactctacttctaatattccttatttttaattccgaatttcagttatttcctaattgtatttttatatggactctagtctcctcttctaatattccttattttttaattctgaatttcaactatttctaaattgtattcctatatggactctagtcccctattctaatattccttattttttaattccgaatttcagctatttctaaattgtatttctatatggactctactttttctttttctctgattaatgtgagaatttctaggccatgagaacgaacgtggaggctcctttttctatttctttaataatataatagatagattatatttctcatgtgagtttaaaagctaattcctgttgatttgggtgatttgcgaagatatcaacgagtgcgagcggccagataagtacgcatgcttcggcgagtgcaccaacacgctaggatcgtactcgtgcatgtgcccgcgaggtgctcgtggtgacccgtccattccacaaggctgcctcgaaaaggacaagttcactttagctctgaaagtagttacaggtgaaaaattataactgtcgtccatcatggcaacaccaatgcacctttttttctctctctctctctcgctctaatgattcttcgatttctgatgagtgacatcttcaggggtcagtgttggtgtcttcctgccactgctcatgtacttttgcctatacctagttctccagaagaggaagctcatcagaacaaagcaaagattctttgagcaaaatgggggagtgatcctccagcagcagatgcactctggcggaggtgctggtggattcaagatattctccacggaagagcttgagaaggccaccaacaactttgctgatgaccgtgttctcggtcgcggtggtcacggtgttgtctataagggtgtcctggaggacaacatggtggtggccatcaagaagtcgaagatgatggaggaagcccagactaaggaattcgcgagagagatgttcatcctctcccagataaaccacaagaatatcatcaaattgctcggttgttgcctcgaagtcgaagtgcccatgctgatctatgagtttgtctcaaatggaacactctaccactacatacatggcaaggaacccatagctcacatatcacttgatacccgtcttcggatagtagcagagtcagccaaggcactcttctacatgcactcgtctgcttcaccgccaatcctccatggagatatcaagacagcaaacatcctacttgatgacaagctcaacgccaaagtttcagattttggggcatcaaaactagcaccagctgatgaggccgagattgcaacgttggtgcagggaacttgtgggtacctagatcctgaatacctaatgacttgccaactgaccgataagagtgacgtttacagttttggtgtcgtcgtgctagagcttctaaccaggaagaaggcattgtacttggatggaccagaggaagacaggagtctggtgtcatgcttcatcacagcagtgaaagctggtcgtcatcaagagcttctggacaaccaggtaaggaatgagatgaatgaagaaatgctcacagagattgcacacctcctgatgcgatgcctaagtatgaacggggaagaaacgaccgacgatgaaggaggtagcggagaggctggagatgctgaggagataccagcaacatccttgggttgaagctgaaggtaatgccgaagagaatcagagtttgcttggcattgaacaacggaattcaaattaccaactcaagcaacatgatgttcttgatctagaagaaggaagtacatatacatttagcttgtagatcatgtttgtttgtgttaaccttttataatcaatcaataaattcaggtacaaattctttaaaattcttttatgtgtaacatgagaacacatctatggagtgcaatgaaagaaccgccaagaaatttatgtgggcagtaatttttttttaagggaagacggcaggagctctgccaatttcataaaaggaggagcagacaatagaggtcgttttacaagccagccacgcaagctgagggcaagcacatagcttgcgagattaaaaacagatgggaaaccccaatcttgagaaagtgaactgcaacaagaagaagaaagcgtagaaaactcatctaggaactaagggcttcatcaaactctttgcacaaagcaatgatgaaatcaacgacctgagctaccgagttgtaaatgtcattgaaaatccttccatttctttgcagccaaatgccccaggtagtgtagatgaaaaggccgtcaaaattacgtctttgttccttaactagctccttcctgcaagcctcccaccaatctagcaaacgtcccggaaaaagagagggtgaaggcatgtgtaggccgagcttgttccacatggagctccaaacttgtcttgcgaaggcacaatccatgagtaggtgattagccgtttctggttcaatgccacagaggggacagatctcactgttatcccagcccccttagttgaagtttatcagcggtgaggttttttctgtgaatcatcagctagccaaagaatttgcatttattttccattttggccttccagacgaaagttgatctgttgtcctgtatacttcttagaaactggatcctgtaagccgagctagccgaatagcagccattcggggtccatctccatgatatggaatcctcaatgccatcctgcaaatgaatttgctgcagagagtgccaaagaatgatgaactccctgacttggactgtgcttttcattctctgcatctgacgaagcaggcgatatcgccnaagttcntgggcacccgtcctgtttttcctgaatgcgatctgaaataaggatgtggcaatatctttagaagcttaccctcccagccatcggtcatgccagaatttgactttgttcccatttcctaagagaatgacggtgaaggccctgaagagttgctantctgtttcatcacagggaaggtttgagccctgccacggtttgtcctgagctgtccaatcataccataaccacctcagtctgagtgcacgaccaaagagttccaaatttagtaatgccgagtcccccttaaatctttttggtctgcaaacccctctttccagtttgactagacagtgggccctccaatagccctgctcaagaccctggccaataagaaaagcccttgcgaattcttgtccatctttttctctgcccatttcttgagggggaacaccgtgaggtgataggttggcaaagctgagagggtagacttgattagaaccgctctacctgttttgttgagaagttttcctttccaggtaggaaggcgagcagcaaatctatcaattaggggttgaacatcaagcctccgaagctttctgatgtgcagaggtaggccgaggtaggagcacgcgaattctttcaactgggctgggaagggggaaagaatatcctggaggtccagatcttcacatctgatggcgtaaacctcgctttttgttaggttagtgatcattcccgttgttcgtccaaagtgaaggaggatagcttgcactgcctgtatctcatccttgatcggcttggtgaaaatgacagcgtcatctgcatatagagccatgttaaagcgggcagttctcctatgaaggggctgcagcaagccttcatcctgtgcagccgcaagaaggttttgaagtgggtctatagctagaataaagagcatcggagataacgggtcaccctgccatagacccctgccatgcatgaaactgttaccagctcttccatttaggaggacattagaagaagaagaaccaagaatggagcagatccaacctagccatcttctaccgaaccccagcgtcctaagcctgtcaagaaggtaaggctagctgactgagtcgaaggctttggcaatgtctaatttgaggagaattgccggggtcttggaagaatggagctctttgaccaagttgttgacgaagaggaagttgtcctgtatgtttcttccttttatgaaagcgctttggttgtgggacacaagctgttgaagtttcggagctaatctgtttgcaaggagcttagaaaagagttttccaaatgcatggatgaggcttatgggtctgaattcactgacacgaagagcattctctttttttggaagcaaagcaatgtaggctgaattcaaaagccatagcctgcgtgatatcttcctgaatgatgtcccaacattttttaaaaaagcacctgtgaagccatctggacctggggagttgtctgaacgggattgaaaaattgcacttttgatttcttcaactgagaaaggtgcttctagatcagcgaggtcaaggttgtgttcctgtaagaaggagggattgatcacagaggttcgagacctatgttctcccaagtgctgcttgtaaaagttgaaaagttcttgtcctttttcttcatgagagtgaaccatcccggagtctgtcaggaggtgttgtatgaagtttttccttcttctcacgctagctttgatttggaagaaccgagtgtttgcgtcacctgctttgatccacaattgtctggatctttaacgaagtcgcaccctgtctagggctgccagacctaagagcttctgcttaagggatcttctgaaaaggatctcctgagctgagaggttcctctcttcctgtgctaagtctagtctgaagatcagctcagtagctatctccattctcaactttagactcctaactctgcatctgctccagtttcttagtgctttcactgttcgggctaacttgataagaattcttttcagggcatcaggcgagtggaccggttttgaccaggcagactgcacagtttcaaggaatcctgggagccttatccagtatttttcaaacctgaaaaggttgcatttaggcctagaagggtttgcagttagcagcagaggacaatgatctgagaccatcgtagagatagctgaaagcaagcaattttggaacctttcttcccactcatgtgagcaaaacaccctgtcaatttttgttaaggttggtatttctgtttcgctggatcaggtgtatcgacggccatttagttttatttcaataacttccaacatgtttaaagccgccctaaaagactgcatcatgcccctgttaagattgctgttatttttgtcggagtcctggacaatgaggttgaaatcatctaagatcatccacttttgatttactgtgttctttgtttgctttagttcctcaagaaattctcttttctcattgtctggttgtggtccatacacccctgttatgctccaagccaagacatcttctttttcttttaagtttgccgtgatcgagtaaacacctgtttgcacactttcaatcgagtattttgagtcagacaccgccagcaggatacctcctcttgtacctgtagccggcaggaaacagaaattatctgcaaacgatggacctagaacctgttgactattgcttgatcaaagaactctaatttagtttcctgaagacatacacaggagcagtttatgtccatgacaaggtttctgacaacctgctgacgggccgtggagtttaagcctctaacattccaactcaaaatggcacagtcatttgtagacatttaacgggaggggcacctgcagtatcccaagcggatggaagagcacaacctatagaaatggtgaggcttgaaacatagtagagaagcaaaacacagtcgcagggagagatgaggtagagcttggccggtagaggcaactgagcacttcattttctgcagagacataacctggatacataactgaaggaccatccttactagatcgaggtctaactgggtacagggggagcatgaggcacagcatagaagaacaaagccaactactcgagctacaagagctccaaaagaaactaaactgctctaaacccctcaggagaagcaaacaacccatttcagtactacaaagactcatgatagcaaaaaggaacagcacatcaacaagcggcgaagccaactaagtcttcttcttgctgtcaccaatggcgcagccggccaccagagcagagaaggcatctatgacctcctgagagagaggctgcttgaaaagcttgacgtatttggccattgcgtcctcagtcttcttgccgtcctcagggagcaggccagccttcttcatcagcagctcatgagcgaggtcaccttgcttggccggagaggaacgagcggctgccttcttggccaaccgagcactcttgcggccgcctggctaagacgggtcgggatcttcttcaagagctttcccttggagacctggcgcgtgggagttttgagcagaggaggctgcaccgccgcgaaggcctgggtcaggaaatctgcaagcttgtctggggagatcatcagaggcgactgggaaggctgagattgggcagcctgagagacctacaccagcacggcggactgggacgcctggtcagctaccagctcctccagcatagggtcagcctccatcacgaactggttggcctgaagaggggtggcctgggtgatcgggtcctgtggggatgtagaaggggggcgagacagctggaagccgccatccttcatcactgcaggaaccgacagcgacggcgggggggatgaccttccacgcggagacctcgagcgagcggccctcaccggagaacaagctgccctgcggtgaccacccccgtaggacccacctctgttctccgaagacctggaagaggagcgcctggggaaagctgagctgcgagcaggagggacatcccaccccaaggggcggcggcgctccctcgctggcggagagcgggaacgtgagcgtgagcgatctctgcctgggcccgggctagggaaagccggaggctgagggggaagagtgccatccttgacgccaaggctccaaataaaatcatgatgctttgggatttcttctgtcatcgagacaggggagatgattccactggcctgactccctagactattcatccaagttggctcagttggcggcgggttgaagtcgagcacctgatcgagatgcacgagcaccgggtaggccagcagcttgggaggggaagtcctctgccgagcctctccgtccaggtcccagcgtgagtctggggagcgcggggacagcggttcttcaagctcgaagtgcacctccttcgggatggagtccggatcgtccgcccacagccaggcgcagaggcaagccgtctcgttctccgttcttggctcatcaaggtcctggatcaagcatccttcatcaagcagtcctgtaactgtctctgccgaccaagcgtggctggggatgccttcaaagcagacacgaatgctgaagcaccatttgaccagctctgcctggacgcgtctcgaccacgggagcaccgagaggtcaatgtcctccacagcaaaagggctcgccgcaaccatcatgtccctgagcgaccgagaggtgcaggtgaccaggtagcctcctttggagaagacgacaacattgaggtcctcacgaggaacctgaaacctggacgccagtaacctgttgatctgtctcatgttcgtcactgggagattgcctgtaacctgtaccaccgctgcggtgcgagaaaggaaactttcatcctcacggatggccgacgtcctgggcaggacgcgctggatgctgtccggcctgttggctgggtcccctgggcgcgacattgccgggagcggagggaaaactagccgactggctagcggaggagcaggagtggggcgaggaggctggaccccccctatcccgtcgtctgtctcccgggcaccagcgggctttgtggccagaactgccacagagaatgcacctcagggggtctctacaggaagcaactcggtggtcctgagctagatagcggaagcagtgacccaccgccttctttttaaagagctcgaggaagctgatccttgcttgaagaggcttggactgcgagaggaaaggttggtggcgaccagtgaatgcggagggaagctgaggaggagcagcggattgaaggtgcatgaatgccgaaggccgttgggcatgtctcttcctccaccaatgctttggcttcactgtctgccaaacttgaagacgggtggcagcctcagacggaagattttttgggattgctttgggaagctgcgagggcgaagccattcatcttgctgcctgaatgaagctatcctgaggagtaactccctgtaccttcaagccggagggcacaggaggagtaaatccttcacccaccctgcgcagtaaaaccggggctgcttgaaaacttaaagaacctgtagaggggggaacctgctggatcttggctggcaccagggggacgcgcatccgctgcctcactgaccagatttgccaggaggaattgagggcgaagcagatctggcagatccccatccgagtagctgccagagagggagccgaggctgactctctctagaaagggaggatagccgaggatgaaacctgtgctagcgggggaggacactagggccggactggtcggtggaggagggggtgggcgcctgggccagagtggcacccggcgatagggcgagaggaggaggaggagacgcgtcgaccattcggtcgtgaagttgccaggaagatgactgtccatgtgggcagtaatgaaaagcaggaaactgcataggctatagagaacaatgatatgcaactatgagtattgaatggttcatcaaatccaccaaacacagagcttaagttgtgcaactaacaaacaccttggataggcaaaagaaaaatcaaaagaattgttgttaatgctcacaatgccgacccattaccatcgtgtgccgtggtgacagatagagacagttataattttggtcctttttccactaacacgagaaatatggcctggatttcggccctaaaacaaaaactcatgccatgtttgcgccttttttcttggttttagtaccacctcggtaacggaaggcggaggagggcgcttcgctatgtatataagcaggtgggcttgttcaaaacaactctcggccttttggctaaaatcaagggtttgtttggtagagctaaaacttctaaatttaggtacaggagttgagtctggggtagagctgtttaaatccagctccacttttttagtttattttgtgagataactctgctcccatttttggtagagcttaaaattgtttagtttatttctagtttattttgtgatacagctcctctagttcattttgtgatacagctctactccactccctttttggtggagctgaaattgtttggctttatcttgtgagacagctccacctagctccgctcccatttttggtgaagctgaaattgtttggctgagattcagctttagaagaggtgggactagagttagagctgtgccatctgtggaccatatatccactgtgatattgaatttattttttataggggagggtccatcacagtgtattgctactgggggccctcacgtgtcgcctaggcgttgcactgatgccagggcctggcacacccccaaccaaaacagcttttaaaagtttgatgatttctcatgctgaacgctgatcctctacgtctgtttaagttgtttactgcaggaagagttgagttgagtactgatgttgagtgccattaatttgctacgaaattggtgatccatgaaactcaaaatttcggatagctttcgtcgtaaatttgctaaaaaattggtcactgacctgttgacccatgaacaaaaactctgcaagagtctgcccaaaatctagacatcgtcagagttcagacttcagatgtgtccaactcttataagggcgtttacaatatgcggacgtggcattcagcctccaccccaaaaaccgaatattccttgccacatcatccaaatgcacaacttccttagctcctagtagccaacattggctacccgttcttcgtctccggtgggacccacaggcgggctagaggagagaggggagatgggcaaggcagcagacagggatttggatcgtctgccttcgcagagtgaaggcacgagcatgcagtcagccccttatccaccattgaagtaatccaacggctcacgtcgcatgtgcgcttaaatagacgaatgaatttgtctgtgaaagaccacgatggttctatcgcaaaaaaaaaaatcccacgatggttgttttggtctgggaagtgtacgcgagctaaagaaacttacaaactatattagtgctaatacacatgaaaaaaaatggatgatatcaccaaattaaaaatacaagaaaactgaaagtttcaaataacaacactaattcattacaaagtagttctccatctttttcatattataagtcatttgactttttttctagtcaaaaatcgttaagtttgactaatttatataaaaaatagtaatatataaaatatcaaattaactttattaaatctaacgttgaatatatttttataatatatttgttttgtgttaaaaagtaaaaaaaaagaagtttgactagaaaaaaaagtcaagcgacttaggccttgtttagttggagaaaatttttgggtttggttgtcacatcggatatacggacacatatttgaaatactaaacgtagtctaataacaaaacaaattacagatttcgctaggaaactgcgagacaaatttattaagcctaattaatccgtcattagtaaacgtttactgtagcaccacattgttaaattatggtgtaattaggtttaaaagattcatctcacaatttacacgcacactgtgtaattagtttttttttccacatgaaaagtttttattttgggaactaatagagggagcatgacgcaatgtcaagtcacatcataaaaagcaaaagaaaaattatgattagagcataggattgataagaaaaattacaaaatttataatgcaaacatcattggtattcggactgaaatatagcagtagtgcttcgtggactttgacagacagatatccattcagacgtgcacaggcgacgtgagccattggattatttgaacggtggatgaggtgccgactgcacgctcgtgccttcaagccgtgaaggtagaggatccaaatccagcagacagggagagaggagcggcagcgccgcccggcatcgtcgtcgctgcttagcccgcctggcggcgcctccttgctgacgagccgcctagcccgccgtcgccgtgcacagccgacgagcccgccgtcgccgtccgcggccagatccggcgagcatggcggccggaggaggaggggacgcgcgacggccggaggagggaggcgtggcggctggaaaaggaggggaggaagtgcggcggccggaagacgaggacggcgacggggctccggtcggcagcgacctccgcgaggacgaccacgccgccgctcgtcgtccgcgaggaagacgccgtgaggaagacgccgacgccagatccggctggatctggccgtcccatcgccgctccgcccggcgccatcactggatacgccggcgctccgtccggcgctgggatcgccccgccgcctctccgtcaaccgcctgggccgccgcgtcgtccgccgcgccccccgtgtccgccgctccattcgccgccgcctgtgtccgccgctccatccgccgccgccggctgggagagaaagaggggcgccggcggcggagtagaggaggggacgcgccggctgggttcggcagagagagaggagagaaaaagttaggagagataacgggtgggacccagtgtaggaaaaagtagccacatgcattgtggagcttgtgcttataaagttttcagtctagtgggggccagttttggttcttccaaattaggtaacgtaaggcatggggattgccttaagattaacaaaatttgctggtttaaaattcaaataacttcaattttaccgaaacatttaggccctgtttagattccagcttttttcttcaaacttctaacttttccgtcacatcgaactttcctacaaacacaaaccttcaactttttcgtcacatcgttccaatttcttcaaacttctaattttggcgtggaactaaacacagccttaggccctgtttagattataatttttttcttcaaacttacaacttttccgtcacatcgaactttcctacacacataaacttccaacttttccatcacatcgttccaatttcttcaaacttctaattttgacgtggaactaaacacagccttaggttcgatatgctccgcggtaacattactacactgaatactaggaaatcgcctcacaaaataggaaaaattacaatgatattcaaatttacatccagaaacccagaatacaaatcaaatccatatttgcatttaccattccctccatctccatgggactttattgttcttttcagaaagattaatactaatcaaatcaaatccatatttgccgttcaatgctagcctcgatgtgcctggctgaaagttcaactatggtcgacattccgtcttctgttggaactcacaacggcacgttcggatttaaatccccgccaaaaaaaaaaacctggcaatctggtactccctccgtttcaggttataagactttctagcattgcctatattcatatagatgttaatgaatctaggcacacgtatatgtctaagttcattaacatatatatgaatgcgaataatactataaagtcttatataatatgaaacggaggaagtagcatctattaccatggtctctactacggggatttatggggaaatattccaaatcttgcacggcagaagctattgtcatggtcattggtcgtgccatcatgtttgacttaacaccaccggtggtaccaaaaaacgcaaagaaccacttgtcatacttgcgacagcgatggcatgtgaacgaattccgccgaaaagaacctccaatctaaacattcagcgttcaaatagttttgaacgacaaattctcgacgtcttcaattcgtcctcgcgttcaatagtgggccgtgacgtatagagacaggccttctccactagtaacaggccaacagaaataaatacggcccatatttcggccccgcaaaaaaaatacggcccagatttcggcctcaaaaggaaaactccggcccatgtatgcgtttaaacgatagcacctgacgggatctggagatggatggatggttcttcggtttagtaccacctcggagacgaaggacgtacgagggcgttgcgctctgtatataagcaggcaggattagacgaagcaactcatacctttctcggcccttttggctaagatcaagtgtagtatctgttcttatcagtttaatatctgatacgtgggccatgtgtccactttgatattaaatttattttttgtgggggagagcccaccacagtggcttgccactggggccctcacgcgtcgcccaggcgttgcactgctgcccgggcctggcgcaccccaaccaaaccaacacaatgtttgatcgaaatttttagtttttgtactttgttagtttcaatcgtgtagctggtgaatgcggtagagcattgaaaaatccatcagcaaggaaaacaattgtctctagatctgcaaacggatatctgagttcagatgcccctccaattctgaataatcgatataccttcatcagatatctttttatctatgatgggtgttgcctgcttgatgtccagcacgcacagtctttcaaagggaacggtgccgacatgatgcccaccaagtgctcgacgccggtaccaagctgtggcatcaccaagtctgatgccgagagcacacctaccacactggaacatgtgttcctggccaccatgaatccgtctacaccctcagccgcatcagcagcagcggtgccaccggtttccctcaccgcgaccaaggaggatgaggttgacatgggcaaggttgaggacaaatcagataagaccttgcatgatttgtgtgtagagataaaggagatgatcaatcaaatgcttgagacatgccgcaacagtaaagtggaaccaattgtgggcgatgattccaccggagtggcagtagtgccatgctctgttactaattcagttcccattgcattggaggccagtcaagaaattgttgccgatgagagtgatggcaacaacttggccagggaagaggattgtgtggagaagaccacagagggaccaggctttggagaacacttaactttttgtctgagcccaaaggttgatgttcccattcttgacttgattgctaatcagggcatgtcaagatttattcacaaggtggatttggaaccttggccaaatccagggccttgtcaaggtaacggaggcatggtggtgaagatctcacgatatgggccacctcatcctcgagctaattacaaagatgtttgtgctaagcagcaacttgaaccctgggctgatctatggttgaatcatggcaacgaaggtgtggtggtgaaactcttacagccctggccaccacctattcaagcagaagctaaagttgaggttggagtactactattattcggtgagtcccacaaaatctccttggactacagattcaccaagttcatgagtagaacgattattgtcagtgctggcttgttgcaaattctggttcctggatggtgtattggctatgcgctgcatctttctagcacattttggaattcctaccagcatatgcagcttttagcctatggttggtcatttgatgatcatgttttgttcctcccactaatgctagttttctggccaattcatgacacctggagtgaatgcttgcttggttatactaatgaagatcacgatgtccaaaaggttttgatctgtgacaagaatttgcggggagtgctaattcctacagagctcaaaattccatggccaccaccaaacttgactgttcaaaaatatggagtgttggctaaaatactgttaccaacaggattgatcaagttgaaggttttggataacatattgcgtgcacaacaatggtattgcagctccttgggagaatcactagaagatagcaccaatggtttcaccaagttgcagagtgttgaattggttcagtacaaggttgattttgctagtagctccttgcttgatattgtagtattgcaaggggatgattctctgccatttctacttcctggaagagcggttttagaatatcaagaatttgtgactcatgttaagatgacagaacaatcagtttcgaaaggtgaaacggatgtgccgaagctttgtgttctcaagttcagtttggacaaattttcaaattattcagttggagatacaatgattgctgtgttgcttacgcaaacttgtgtacaattagttccaagctacaatcagtctttatctgggagcaaaaatcactacaaactcttgatgacacaacatatgtcagtcattgcaaactatgaaatgatttggtggaagtcagagcttggtgggggcaagattagcttgtgtgcatcatggaatttctgggatctgtgtttttgttgcaagcaaatgtctacagaaattatggctgttggattatctggtgtgaaggtatggctgttgtttgctatatcagagctgtggttacaaagaaaacagctaaaacttgcattattagaggaacatatcaaggtgctctgcaattctactatgttattcttcctgcaagcgacaatacaagcatgactacaggactatcttcgttccatcttgcacaatgccctacatatacttctgaccaagaaaaatatgatgcacagaacagaaaatatgatgcacatatgctccgtggtaacagttcactgaatactcggaaattccctgcaacatagaaaataaatacaatgatattcaaatttacatcctgaagcccagaatacaaatgaaggccatatttgcatttgccgttccctccatgggaccttattgttcattacagaagggttttacatgtgtaagaacaaaatataaatgcctactacacttgcacaaataaacaatctcagagcccttgtgtttccttttttttcctttgttttttccctgttgctctctgtttcccatcgcaacagacgaattcgtatttttatcttgattttataggtaagcacgttttggaacgggataaatcagaggcaggtgacccttctgctgcatgcataggaccgcctcattcaaactcttcctcagtggagtgaactccaaacccaaatccttgagcctctggttcgagaacttatacggcttcgccatcggcttcccatcatcctcacacctgaaaaaaaaatccaagaaacacacgcatgagaatttgagatcgatcgattgcatctcacaagagcaatgaagcaatgcacataagcaaatcaatggctaatatctgcatactttgcagtggcagggtaccgtgggaagagctccctgagcatccggaggagctcggcgcggtggagcacggtgccgatgcagaggtagcggccgcgtgcctcggggcgctcgtagacgaggacgtgtgcgcgggcgacgtcgcggacgtcgacgtaggccgcgacggcgttggggtaggacttcttggtgcccatgaggtagcgggcgacgtggttggtgctgaagttgagcgtctgctgaagcatgggacccatcgtcatcgacggcaccaccaccgccagctccagccccctcttcgccgcctcctccgtcgccgtcatctccgccatcatcttggcgcagcagtacaggttctgcatgtacgacgagaaaatttgccgagatgaatttattgttcatgtaagcaacgctgttggagttggtagaaccgtagaacggagcagagtaatgtgcttacgtctgtttgcttgcagaattcgtagtcgctccagcaggtctcgtcgaggacggcgtcggggctccggttggggttcatgtgcacggcgccgtacgacgacgtgaacaccacgcggcgcacgcccatgtccgccgctgcgttgatcacgttcctcgtcccctccactgcaaccggaacaaggtcctgcatcacggagcagcattagtaaaagttggaggaggttaaaggtgccattgtcgtctcttttgggctcaggaaccaggctagtgaacttacagggtcgttagacaccggggaggcgacatggaagacgccgtggcacccgctgaagccggcgcgaaggctggcggcgtcgaggacgtcggcgcggcagagggagagcctctcgtcggctccctccagctcaagcaggtgagcattcttgctgtcagctacagatacgcgcatgcaagaaccgatcaataaatcaagcacaacacgcaccaaatttatgcaaacaccgtgaactaatagtactagtacttaccaggatccctggctgttcccctgacgtggtagccacggatgaggagctccttcaccacccacgacccaatgaagccacctgctccggtcacacagaccagctgcttctcgccattgttgttgttgttggcctcaaaattggacgacatggtgagagacgctgaccagttactgtcactaaccaaatgctactctgaacttgtgagagaactttcgatcgagcttgtgttggctgctgctcgtatgtcactcgaactccgtatgttggtgtgagactagcgtgtctggacacggccgctatttatacctgcagaaaccgcgcgccgccatgcgacggaggaggaggacgacaagaggaagatagctagcgtaggttggtcagcaggtgaggggtgggggaggcgcagctgcgaccgcgcgaaacggagtgccgtcgccttgtcgactcactgttcgtccattcttcaggattcagtatttcagctgcgcgctcgcccgcaatactgggcatcacatcgcaaggccgaattcgccgatgggttggggcgtgcgcgtaggagcagtagagtatattccattgcctttctggacgaggggatcacgaagccaaccctggcacgtaaaccgtctcaggttttcgctcaacctggcgaatcttctctccaagtctacaacttgtacttttttaaaaaaaatatctgctgtcagaacgaccgacgattcgagtcagactggcacgattgactactgtccttttaaacctgacgttaatagtgctaccactaatactcctcctttttataatgtaagtcattttagtatttcccacatttatattgatgttaatgaatctagatagat

SEQ ID NO: 25318 - DNA, 2121 bp, Oryza sativa
atctagattcatgtaacatcaatataaatgtgggaaatgctagaatgatttatattgtgaaacggatgaagtactattttaatgtataacgtcgttgattttttatgcaacgtttgaccattcgtcttatttaaaaaaattatgtaattatcatttattttattgtgacttgattcatcatcaaatgttctttaagcatgacataaatgttttcatatttgcacaaaatttttgaataaaacgaatggtcaaacgttggccaaaaagtcaacggcgtcatacattaaaatacgataaaaactataggacggtataccgtctcaacggtatagtttataatttatacttaccaatcactcaccgattctttttctctctaaaagcgtgtcatgtactgtcctttcacatgacggctgctgactagtgacgactgacgagaggtctcttttctcctacattacaaaatagctatgaaatactctagtacagcactacttctacacctctttaggtccatatggatctgacacctgcttcaactagcaaagttagaattaagcactagagctagtagcatgagcctaaacaaagcatgtcagcagcacatgagcaagtttggctgtactttctggcctagctatgcatggtccatctttttatttgattgttgaataggagtatataacccataaatatcagaattagtggtatcacatctgaagtctcgtgacatcacaccctatatttggtatcagatccgctactaagatgtatcaacccggtatctaggtattggatccgatattcataggtattaaacctaacctaggtatcgaatccggtacttataggtatcagacccaatacctagatattagacttggtattcataggtatcatactcggtacctgggtatgcgacccagtacgtacaggtatcggaactgatactcataggtaccagatcagatacccgatacccgggtatctaatccgatactcataggtatcatacgcgataccggattcggtactcataggtatcaaacctgacctaggtatcgaatccggtactcataggtatcagacccgatacttaggtatcagacttggtattcataagtatcatactcggtacctgggtatccgacccgttacgcataggtattggaacaaatactcataggtatcagatcagatacccgatacccgggtatccaatctggtactcacaggtatcagacgcgatacctagttatcggatccggtatttataggtatcagacccgataactcggcattagatcttgtatttataggtttcatacttggtacctaggtatttgacccagtacctggatatcagatatcactggtggagaaaccgtctttggtcggttgcccgaaatccacaatagtctcggttccactaaaaaccgggactaaagatgatctttactcccggttggtggctacagcgggcatatttgatctttagtcccgattggtgttaccaaccgggactaaaaataatctttagtcccggttctaaatctgtcaggccttgtcaggccccccgagatctttagtcccaccaaccgggactaaagataggatctaccaaccgggactaaagatcccagggatctttaatcccggttgataacatcaaccgagaataaagcgtacgcacagcccacgcacaagcgcatgcgtagcccctctctctctctctatctcccatccttatctctttttcttctccttccttatctccatcctctccatccttctccttccatcctctccccttgctcttctctcaccccctctcctcctcccctccccctcttcctctgcagaggcagccgacggcggcgggatggaggccgggcgcaggctggcggcggccggccggcggcggcgggatgggggacggccggccggcggtggcgggatggcggcggccggccggcggcgtcaggatggcggccgggcgcgggccagcgggatggaggacgcccggaggtggcccggcgcgggccggcgggatggaggccggtcgccggcggcctcgccctcccctcccccagatcggccggaggggaagcggcgagatgg

SEQ ID NO: 25319 - DNA, 18398 bp, Oryza sativa
atctttagtcccggttttttcacccgggactaaagatacccggattggtagtcccggttttacagggggttacgaaccgggactaaaaagcacttctccaccagtgtatgataatctagcatctatgtatcacatactagagtttctaagatgtagtataaccaagagcccaacatgacatatctaattagaatccattgtatccatatataatctaggtaattatttgtctggtctaatccgtgcatggtataggacacatgcaaatagatgcaaccaatcttagacacatagctaggctactaggctctgccataacaagtaccctacataactagggtacgggactactagtagctattacagggatttggtatgcacaacaagctagtagtacctccggttttatttactagctaggctagtatcaaaagcaggacttaagcatgctgagtactagctagctgtcaggaacaaaactatacactgatacacacagcaaatgtgcgtgatgataatcctagcagcacgcgacatactcgggagaagccggcacgtggggccgcggcatggaggataagtggtataccgttcaacggtataccgttgtgtagtctttctctaaaatacggatggagtatgttcgagggaatttgacgatatttaaaatttatcatggtttatctcggtgatacgagagaaaaacatcaaacaaccgatgctaccgcctacggtcttgcgaataaaaaggtaaaataccgatggtgcacaaaatacatataactacgtaaaaagagaaaactagcataaatctgcaacattttatgacataattaatctggaacgtaaaaaacaagagaccgtaaaatatatattttatattaagatgtttcgtttacttagagcacaaagcagaatccgctgtgctcaagtatcaaaactggagtacttagtggactaaaaaccaaccaaagaattccgtctgccgttgaaagttgaaactaaactacgatttgggcgcgtgttagctgcacgactcgcggctttcgaaaccgaacggcacggcacggtcggagataacagaaacccacctggttatctgttaccgtgttctgaaatctgaactactacccaatgtttgagactagctcggtgaggttcgcaacatcaacctttttgacggctatcggctcgtgtcggctggatgcttcggcttgcgtcacccggtgggcgcgccgccagccgatcgaacgggaaggtgaggtgcaattccaacttctcctccgcctcccgtgggctgggctacctgttccatcgccatatacacagtccccaccgacacatgtccatggctttgctagtggtataatttcactttgattctctaaactggttgtcggatccggttcgtatccctaaactataacatcggatattttgactcctcctcaattattaaaatcagaacaatttgactccctcgactgttttgaagagacggttttgctgacgtgatagtgttgacctggtttcgtcctacgtgatattgacgtgatgcttatgtgatattagaattaaaaaaatatgtgaaacccgtttatcattaataaaagaaatattatgggattcacatgtcatcctctctttatccttcccttcttcctcatgtctctctctttctctcccctttctctaccccttcgtccgtctatgggaagagctaaagcggtggcaacagaagtgcaagggattccagggcggcaatggtaccgcagtcaggcgtagggacgaaggcggtggactacgaggtggagcagcgggatggtggtcgcgtggtgaagaggaaggaggccggcctcacgagagggagccatggaggagtgccggtcgcaacatcaagtgttgggtgagtgctagtgtcgatcgcaataccaccaccgccgagatccggctcttgcccaccatcgtcctataatattccttctgtgaatgacaaatgagtcctacattttaaaaaaaattaacaccacgtcggacgaagaccaggtcaacaccgccacgtagttaccacgttagcgaaaccgtccttcaaaacaattgcaggagttaaattgtgtcggttttaatagttaggggttgagatatccggtattgtgatttagagataagaatcagattcggctattagttaagagagtcaaagtgattttattcctttgctagttgctgatactacttgcgggatgcggcacatagacagatcacttaacaccaaccaggcaggccagtctccaagagtccaagcccatagccttaggccgaggccaggatgattctaatgggccttgtgccacacatgggcttcacagggccggaattcacacattgccctcttcttcctcttcttttaataatcgtattaattcacatacgtgctcagtcaaccggaacggggtcatttaacttaactgatgtgaattgagccattaacatgtggaccgtagtaaagtgagctcactggacagtaactcaactgcatgtgtagtatgggtgatctgtttcccagtcaacccatatgctcccccatgcactggcacataccccgtccagagattaatctgggcaaatgcttgttaagattcatgatcagatgttgaggttaagtccagaaatagtagaatactcatgcatgatccccacaaagaaaggagggagggagaagaacatgcatgtggtactagtcaactgtagatatatctgtaacggcatgaagctgcacatgagaagcagttatagttcgcactatttagagacctatagcttcggtggacatgccaacggcaacggtagaatcgggcactatcgatcggacagacgactctaactaatcctgtaccgtaatgagtgctactgaagattttagaatcatccactccaggcgagacatgcttgcagtttcagacatccaagcagagacaccatatgctcagctcaatgcggcgagcgttccaggtgatgatcatgatctacaaacaggcctcgcagcgacaatcatacagacccaggatgtgaacagaagataaaacagctcaaaagcaagcaggcttttctccttcaggccgggctaatcaatgcaatgcagcagcacggcgtctgcacacgcaatgcacaactctcgcgcagtcgcagaacgatctgaaatctgaatagagagcagaaacaacaacggagatcgatcgatcaatcgatcaccgatcaggtgaaggcgtgcataatttcagagattttgcaggagcaatccatctccaatatgttcggtcattcaccgacgctttcagaggaagcgagtgatcgatgagctgctgctgctgctcaactgcaggggaagctggcagacagggcagatggggaagtctcccaaccgcgagaactttatgtcgcccatgcttgttggcagctgatctctctgatgagcttgctctcacacccatccatcagctgcgccgtctcacatcatgcacatgaaccacccgacaccagcaaagatcacggcaagtgagagcattcaaggctcggtagctgcagcagccagcagcagctggtagtagtagcttggtccaaaccgatcagcccagtgagtgatgggttgccatgcctacctccctcccattcatgtgccatggccatggagttctgaatgctgctcagtgccgtttcttccgctgcagcttgcaccaaagctaacagaattcagatcgaagctgatagtacgtgctagtttgctaccaagttaacagcaatccaacagcacacacaacggggagggaaaaggggatattacactttggtcaaaagccatcttgcaggagcagcagcagccaaacatctttggccaaaaggaaacgggagtatgatgatggatgagaccttgagggcatcgaaagaatgaaagatcctctttgctaggcatcgccccagcacgcttaagttcgttcccttccccatgcaggcatgctctcgcgcgtttttttgagcaaccacatctccgtttctaccaaaagccatggagattgagatgagaacaatagggcattgcagatgctcttttgccaacatttccagtacaaggatggaagaactgcttctgaaaatgcaacgatcagagataaggaatttacacaggcttataccagtaaagagtaaaatgggagagatcgtgcaggtttctttaatctatgagtaaaacgcagaaatcgcaatgaatagcctggcccgagagaagaaatgcaagtactggtcacctgaacaatctgacataagctattatgaacagtaataaaccaatctgacagaacaacaatatgaacaattaactcctgatccggactagcacaacgcaagatgcaccccaggagaacaagatcatacaagctgcaatgctgcgttacaaacttttcatacgagacactatgcgaagctgcaaacaaaccactgtaaggcaatcttcatgcaaaatcagaactcaattaatacaccatgctcgcacttgagaatttcgacacaacttgaaccaaatctgccgaattgtctgaggcacgtccatatcagaaatcacgcctatagccaatacctaccccagatcatacatacataaatgcttcagactggcttcccgtgaacaaccacagggaaacactgtacttgtacgcaagacctattaagtaatgacaattactccactgatcacaaagatcacctttcaatacactgaatcactgattcacaaagatcaacttgaatagcaacaagatacgcaacaaaggaatccatccatccatctgcaccttgatagtatttgctttggtcaactgaccaacaatgaacatactgaaacctttgtgatgccattgttaaaaagaattaacaaatagaagtaacaccttaagacatcgttaatgaactcatccaataggctaatataatatccattatgtccagaaagactatgtacatctaagcacaccaagaactctagtcgcatatcatgaaggccaaaaccaaaactctaaacaaaagagagagagagaaaaagaatattataggtaaatactagagacaataacgaatccaactgacatattaacgcatattgacggactagacagagaaaattgccaaactcttttttagttttttaacccatcggcggcgaggttaagatactggcatgctgctcaggaaactgttggtttcaccgccaccggcttggctgggtcagtgccgagcacggtggccgccgccggcacgccgctgacagccgaagcatactgggggaggacgctggtgtagtagatggcgtggccattgctgtcatacgccacctgcggcgcgtaggcctgagcattcgacgcggcggcgggggaagggccattgccgctcgcattggcattgccattgtgctgcgcgacggcgtagacggcggggaaggaggtggcgccggggccagcggcggtggtgaagtagccatgcggcggcgcggggatgaagaagacgggggcatggtcagcgccagagccaggggcaacagatgtataccttcccggcaccggtaggaaggccgtcggcggtggagcggatgatggaggcggagcagcgggcttctcctggtacttgggcaagtagtactccggcgtggccgttggcggcgttggggtgacggtggcgggagggtaggcgcgggtgagggagtcgtcgctgccatttctcggtagggccgccggcggcggcgcggcggtagcgggagcaggtggtggtggtggttgctgcgcggcggtgtcggcgaactgtagcttctcgagcccctggatctggcgctggaactcgccgggagagacgaccggggagacaacgacgtggtcgcttacggggttggtggtgtggcggtcgtcgttcttggcggggatctcgacggggacgtgtccttcaccgtcggcgggtcaccggcggggtccttcaccttcaccgcggccggcgggacgaagccgttgtcgaggccgaacaggtagtcggggcccgtcggcgctggcaacaccggcggcggctgcggcatcggcacaaccgctggtggtggcgactgcacggagaccgactcctgcttcggctgcggtggcgacggtggcggcggctgatggacggagttgagcgcgtcgacgaaccactggcgttgctcctgcttgggctcgaggaggccggacggctgcggcgggggcggtggcgtgggcgactggacggggaagaggaaaaccctgagcctgggcgtggaaccgccgcgggacgagccgccgccagatcccggcgcggggcggagcaggtggaggcggtcgtactcgaggacgaggtgctccagatcctcgtcgttggtgacggagacgagcgcgtcgaggtcctcgccggggagctggtacttgacgcagaagtcccccggagaacccgcgaggccggccaaccgcgcggcgaagtcggcgaagcggaggggcctctcgagcgacaggatcttcgtctcgccgttgacgtacgagagctggtggtcgtgcggccgcggctggatgcgccccccgtagctcaccatcaaccgcaccttcgccggcggcgccggtggcgggggcgccgcctgcgccgccgccgcctccgagccctcgtggtgcgcgtcgtcggtggccgcggcggagtgcggggacgagtcgccggagtcggccatggcggcggcggcggcgcgcgttagggttggggatgatatgatgggggagagcggggtgaggggagagggaggctgttataaggtaggtaggggtgggatgaacgggttttggtgcgattaagggtggtgattagcgatcttaattctgtgtttagtctctaaagaggggaggggattattgactgcggattttggcgggggtttggcatcgggagatgtgtggggacagttgggattgaggtgtctactgtggatatgtgtgcctgctgtggcgggcccggctttttccatttctttcttttttattatcctgcttcttttcgcgtgatctttttctcacctggagatacatgcacgataggatactttgcaaattctaatagtttggttttagtattactgattggattagcatccagcaatgttgaatcagaaatgtgacgccgttggacagatcgaaatgcacctggcgaattttttcgaattggaaaaaacggcagcatttaaattttctgttcgccgatgcctggtctattgtggaggggctttttttagctgctgtgcggagcgtcagggcgtgccgtgatggcgacaagcggacggaccgatcgaaggaagcattgggtgcgtctggttgcgctttacgacggcccaaactgcctcgccgtcgccggtgtcgccggtgccagcccgcacctgagaattcaccccattttacaagtttggaagaaggaaagcgggcgcaagtttcgatgcgtgggcgcgcacccacagtttccacttccaaccgacagggtgcactcgggcgcccgggtgtgtgcatgcgtcgcacgatcgcccaaggccccaaaggccaagaggggtggtgtgctggggccgacgtacgtccatgtgtcgcgggggtgctgccgctgacgacgcgcagtcgcaggcgcagggccatgtggatgtgtgggcgccgtcggagttaattttggcagcgtgttaggcagagaggccgcggcagccaccacaaaaccggtcgcttctcctggtcaaaacctccgcatctcaccgcagccgcacccacgggcgccaccacaccgctgcacctgcactgcccatgcgccccgcttcgcatacagaaacaactcgttccactgaaattctgacgcatggatcaataattttagtagaagtactgccctttcctggtgaaccggatttgtttccccaaaattatcctgccatgacaaatttgttcgacatcgatggtcacatttccacaggtactacttatggtgatgaatatgtgtacgttgtatttgaggttagatatttgccaggtagtatacgtgataggaggaagaaaaaaaaaacaaaatgataccaggagtacttatttgcactactattaaaatgaggatctgacattacggatacagccaaaccagccgtcaaacgagtgaccgcggaagatggcgagcacccgatgatccagctattgacctggccctcttttcggcgcgtcacagtttaacttagcatccctaaaaactgccacgatcacggatctagccagctgcttaatgacctgggagagtgattacactgagcagtgggtcccatcaccaatagaggtccgtgggcccacgtctattttttctgtgcagatttccttcattctctttttcagcacacacgaaatcgattttatctatcacaatatcttttcttaccaaactcagcgcgtgtgatcttcttttctggctgctttgtttgaagagaagtgcacgattacagtgacgtcgttagtatcgatcccagatgaaagccggatactatattatcgccattagattagactatttgtttcacaacgcatgtggcaagccagttggtagttagcaggcatgttagccggatggattctggcaggaagttgtgtggatggagtatattagtagcactccttgcacaaaagatatactattagtagcaccaaattaacaatgctggttaatccatccgggcaatgtaataatgtacacctttgtgtttccaaccaactaatgcatgtgtgatcgagtagcagggcctgtgtttttttaagcatgcaaagaaggttaaagaaatcattagaaacctgacaatcaaggtgtctaatgggcaaccaagcaaagcaagcgagtgaatcctgcatcaccgttgcatagctggaaaggataactgatgatcctacatttttaataactgatagaaagtggcgtgccgtgggtgacggcggccatgattagctgtgcataattaccactttacaagattgctaatcagcgaaatcatgctgtttttttccttaaataaaactgcagaaaatttacgtgcgtacgtgcactttaaagcccaatcagttttttttttcggatttactcggctacagtttctgtccatgagaccaggggagaggcattgaccgagcgtcatctccttaatgggcccacgtggcagtcacagcgaaatatgggcccaccaggccggggagtggggagggtgacgcggcatgcatttgagctggtggcgtacgagcggcgcggcccacccaacacgttgctgcatcatctctccacacatatgcgttcacaggtgtagtaaagttgactcggtaaaattgactaagtaattcttactgtaacttttttttagaaaaaaaagataaatttaataactgttggttacttcgtgttagtgtagtattttcacgattgataatgatataagccgacaatattattaaggatttaagggcgtgtgaaaagaatagtggacggaatggccgaataggttctccgccaaagaggagatgctgctgatcgcaaagaagaggagtacacgtacgctttgcctcaatgagatttagagagcgatgtgcatataatgtgggtctcgattagggatggcaaccggggacccataacccacaacccgatgggtttttactctattaggaaacaaatatgttccaaatattacacccatggatctcttatcgggcctaaacgtcacccatcggttgggccgggtcctggaacgttctccatccacccgaacccattaacccgtgggttaaaaatacccataggcctcagcccagaaaatacaagtagcccaatgcccaacaacaaatctaagcatctaagtctaagtgtctaaccctagaaataaaaacccatttcctctctctctcactgattcacttctcctccctccccggtactgtgctgctgtagggtggccgccgccacaaaccctacggcgcctctcgcccgcgccggcgcacgcccacgccgcccgcgccacccgcgctgtcgcacgcctgcgccgtacggccgcacgcccccaccgcgctagccgccgccgcacgccagcgccgcgctcgccgcacgcccgcacgccacccgcccaccaccgcgctcgctgccgtacgcccccaccacgcgccgcacacaatacaggcctgcgcagctgtgtgttctgcacgcagcatggcagcggtctccggctccggcaacgacgacggcaagtgatcttcttccctctttattaactgttgcagctatatctaatgggtatgggtacccgtcacccgtgcgggtgtgggtatgggtgaatttttcacctgtgagcgggtgtgggtattggagcgggcatatttcattttaatgggtgtgggtatggtgtcggtgaatccaatgggtacgcaccgttgccatcgctagtctcaaatctgtaaagaagattagagtaggaattaacgcgtatatgtatagtatcagcgttccaattagacagcaactctttttttttttttggcttcaaattctactaaacgcaacctatgtaggagtagcacatgcacctccagcttactttggttgcacacacatgcgaatcgccttcccgaagttaagttgagtgtgttattcaaaccagctgcaattatggtcagtctacgcagtctctagtctcacaggtcctctttctttaatatgaaacggatagaactgaattagagcaggtataatagcaggctgtaagccagctgcaaacatattttaaggagataatgagaaaatagaaggataatgggctacagatttgtagccagctgtagcacggactttaagacgtagtgtgcgtatgacaggtgggaccatttattaatagtatagtatgtaagtattgtatgaataaactattagattggctatagataaattgaagttagtagtgggctatactattgaacttgctcttagggtgtacgtgatttagaagcaaacatctcgtcagactttcttgcctgcacacgatttagggattgtttagtttaagtcaaaattgaaagtttaattgaaattggaacgatgtgatgaaaaagttggaagtttatgtgtataaaaaagttctgatgtgatgtaaaagttagaagtttaaagaaaaaattaagaactaaaccaggcctcattccttctctctgtttgttttgttctggggctatgaagaaacagaagaaagtttcttgcggcgccacctcaacgaatatccttgttcgcccaaggcctggagttggactgaacaattctctggataacctcaacaagaccgattcgtttgtcatcatactacagtatcattaggatcagggttttcaatatctgaagatagcccttgacatgttcagctgattgcctgaaactgacaggtaattggtacttctagatgattttatttcagcttttgagccgggatatctacctggagaagattaccttaattaatttcttcaagtccgctaatgatatagtaggagtactatactagtatactggtactagatgatcaaaatggcaaccacctaaccgttaaaacataggagtagtaggaggagtagctacgtagcctgaaacctcggaagtgtagatggagacctcgcagctacacactactgaacaaacgaacggtccaaagccttttcacagagagcaacctccaaaccgggacaagcatctgctgccgtccatgcggcgccaagcaaagcccatcaccgtcgtgttggcaccatcccagccgtctgtccctctcagtctcacccatcatcatcatcatctcgcaagcgtcgtggacgcgaaagtgaagcttcatttgccgatgtactagcaaacttcagcctcagctacatcgtgggtacgctgcatctcctgctccatcggtcccaaaaacaagtatagttttacgcggttcatatctaacgtttaatcattcatcttattttaaaaatatttataattaatatttttatttttattaattgataaaatataaataatattttatgtgtgactatttttaaaattttttataaatttttaaataaaatggacgatcaaacgttaaatacggatactcatggctacatttattttacgacggaggttgtaccaattaacatgatctaaattgttcccatcaatcactatcacggccttaattaaaagagcaagttaattaaaccctctatttatggggctaccaaaaatatgatgatgggagcagatgcagagtactcggttaacttagctccgattgttaagctttaatcttcacatgcgtgcaagtaccagattgagctgttttgtgacttgtttagggtcgagagcctcgagtcccgagacacgtaggcaattaggcatgatgggtttaaccaagatacacatgggttagtgcaaatcaggattaaccaagtactctcacctgactagataaacatggaagctagtactacaagtcaccagccagagttaacaaacactgctctgggtcttgcgatccatgtgagctgaagtgtttgaagttccttccaaacgcattaacaaattctgccctgctttatcactgttataaccactcggcaatgtactgtaggagcagtagttagtggtacaggactatcggtaaactcgaattaggagtcgtggttgattgcattgacgagcgtaacacgagctggtgcagttggttggtacatctgcactcttcacccgtgtctgaatttctgctcgtctgctgtgctgtcgtcgtgctgcacagtctacaggaatagctagtggaccagtggagtaggaggatttacattttacaatctcgatatattgcctaggagaattgcgtgatgcatccacgaatagtactagttgctcgagatcgaggagggagacaaggattgtgtgctattttactggacttcgtgtatcctgtttctttcaccctttgctgctactgcctactagtactagtagtagtactagtttgcttgtgccttgcaagttgcaacatgttgtacgtatgcagttactcgctcagtccccacaaaaaaaaaaaaaaaaaaaaaaaaacataggtttctgtgccaactatccgtcttatataaaatttttttataattagtattttcattgttgttagatgataaaatatgattaatactttatacgtgacttatcttttttaatttttttcatagttttttcaaataagacggacggtaaacgttggacacggatttccactgctgcacttattttgggatggaggtaggggctgtttggtttaatgcttcaacttgccacaccacactttagactgccacacctccttagccttgtgtttggttcattaccttaattatgccaagccacactttcttaccatcttacccacatgtcatagactcaatcttttgcctaactttaccacaaatgtggcttacaatttgtaggccacaaaaagtgtggcaagccacacttacctaacattgtctaaagtgagttatgacaatgttagttaagaaccaaacatgctggtagtacttcaagaatttatctggcaggcaacatatgctactggacgctgatatttggcaccggattcagcccatctaattttgagcccaaccagatcttatcatatctgtcaaagtttattcggcccaactatatatcattacgaggcccaccagtggcagtgctcccctccctattggaccggagtacaacaaagcccaattgaagagacggcccaatgaatgggctgcagaacaaggcccacgccgcaattgctccgtggaacatagggaaggaaagcctcgcaagcagcaggcgaagaatcgaattgcggcctgcggcaatttgtcatcaaaactcaaagacatatttcagctacttgtcaatttgtcatcgcatacaaagcatcgtcttcttgtcatcagcaacttgtttgcgtacgattatgagctatgctttggcctacttccatcagcaagtgtgcaatacgttgagctagcatccagtggtcactggttagttagcagtagttgtgtactgccagtatagtagtagctaacaggaaggcacattcagtgtgtcagtcgacgagtccatactaagtcataacctggttgtccgttagctgcaggccggacccgatgcgtggaccaaaagagtatcggaattcagacacgccacatgattttattgatcggtacacgctgcaagtatggctgggctggtccaagcccaaaattattaagagcaatgacccggtttcagttgcaggcagcaaatggaagagaatacttgtagtatccaggaaaatcttcctctcaaaaactttgaaatatattagggcattgtttagttccaaactttttctttaaactttcaactttttcatcacatcaaaactttactatacacataaacttccaacttttccatcacatcgttccaatttcaaccaaacttccaattttagcgtgaactcaacacaccctagtatttgctgcagaactgtagagaaggattattagagcatgtaactgatgatgagaatgctgaattattgatgcaccaactcttcatccgggactgattcaaagggatttagtcgatttttctccctcgattaaatggaagacactggtcttctactctgttatcatctgttcaggaaacaggactggagtagccacatttaccatctgtaattataaatttataatatgctcatttgacagaaatgacatatatatcatccaatgcaatggaacatgagcagagagtagtaatctagagtaaatgcccatctgtttgtacattatcttaccaaggatttttatcaaatcctacctgaacgaaagcaaagccgaaaagaaaaaccatactaaaatagaagagagatcagggaacaatacacctaaactgcaagctgagagaagcagcactgaagaacaggacacgacatggatctatctatcatcatctattggaatctggattcgggccactcggaacctcatgcttgctgtcgtcgatgccggccgagttccacctccgtggccggaacctcctcgtcctcgccgccggcagcagaaggcgccgtccaccggccgggaccgacgtcgccgccgctggcaacgacgacgacctcacctttgcttcttcttcttcttcccccggaggaggagccagcgacacgacgagcataacggcgcagagaaacgcacagaggccgagaagcggcagcgcagcagctggtcttcttccatctccaatccatcgagctcttgccatgcaagaatcagcttgcagtaaagccttcgatctccccgatctcacaagccaccactaaccaaaactcccatgggcatctgccagaagacgagacgagagcttagctgaaatatcgctctctctagctagctgcctctcactctcactctctcagcgtgtgtgagctcagctagctcttgtaccgtggagacaatgcaagcaggcagctgttctattctttccaggattcacacatgggttggctacttggcttctctggagtctggaccaaaagtttgggtttcttgctttgcttgcttgcttgcaggtgaaatgggagatgaccatgtgtatgcaaaggcacggagcaggggtggctgcttcttatctactgcccgtgaagagaagcagctgagagagctttgtgtgatccatcgtgtatctgacagcatcatcaccatacatcgatggctttgtagacgcctcagcaagacatgcccctagattgtactgctactgtagctatatccattgcatgcatacgcatgctaattacttgcagtatggagtacgtagtactatgactgtatgagcgtgaatcaacatctgcattgtactacgtactgcagatgtatgattgcactcgctaggtgtgtgagaaatttacaattgcttcgagtatttacttttgtcggtcgcgagctcgcaggaaaaagttgatcatggaggacggagcagcaaaaggacgcaaaggacgcgatggaaaagacgtaagacggcatcaactgagagctttgctcatcttggtaaggctgtaaagctccaatccaacaaaatatttgacgctcattgacagtgttgctgatctttcattaactaatccatctcccttttaattctcatcttatttgtatatctgtcaagaacaaaatgatgggggtgctacgatgttagctctgccattcaacgtttccacaggctaagctagcaagcatgataaaaaggagaagattgtgaaagcctgaaaggagtagtagcatgcatgcatgcagtgcagccaggccaagccaaacaagaatgcttttccatggactgacgacaaacacaagctgcatctacacaaattcatgtccaaccctgtagcagacaggcaatgttctgcagttgtctcgtcacctcctctgtagggactcgctacagtcaccacacggaccttgcacatgaactcaggcaaatatatcatcacatgaactgtaaaagattgatctactagatggacaaacacaaacacttcactgttcgccatgtagatgctgccggatcgatcgagaatttgatttgccgtttttctcttcgagaggggacgagtggggcgcgcatgctggatgaaaaggttacacgaacttcaaagcgggcatggttaattatcatgggctctagagagggcaagagctgactgaaactggactaatctccacctatcgtctaatcacaactcattctgtcgccggccatgaatgcctcgtgattcgggatatatgcaaacggaggaagcatgcactgcacatcctgtatgctactggagtactattatcagcaggttacttttgtgcatctgaacgtggcaaaccgggcttcacgggagcaggcatcatcaagagccaaaacctcccactataattcttcttttcgactctattcttcaggcttttgtattaagcctgcagcaccctctcaatacttcaattacaataggatcggtgaccacagcttactaggttaggggacacaaatatataacttgtcccaagttaacatttgcattgtgcatctgcttttgtagcagtagtagtagccgtgctaatgcaattattgtggatggaacaattcatgtaacaatctcatgatttggatacccacggcggcaagcatgccggccgatcatcctagctactcgtaagtatcatttcagttgcatacagtacaatactccctccgacccaaaataagtgtagccatggttttctgcgtccaactttgaccattcgtcttatttgatttttttttttaaaaaaattaaaaacataagtaatgagtaaagtactattcatgttttatcatcttataacaacaaaaatgctaattataaaaaaatttcaaataagacggataatcaaagttggacgcggaaactcatggctgcacttattttgagacggagatagtagtattgtctgttcagttaggcttcgggaagtgtactaaaatattacaccaaaggttatcaaaagctggccttaaatacataataacttagcagcgcgttactactagagtactccagtatttaggaccctttaaatcacaggaataaaaaaaaatgaagaaataggaaaaacataagattttgacaagaatatagatgtaaaactgtagcgcccgttccgtcgtggcgcctagcgggaaaactatctcttaaaaaccctatttgcgaaatccgtttctttgcttgttgtctagtgtccgtgccatctcagatctcaaatccccgatctattgccgagttcaatcccgaatccaaatccttcccaattcaaatccctccgcaaaagtctatttcgcctccctcgggttcgatgggccgaatccctctcggcccatctccccctccctccctggctctctctctctctctccccgctctgccgtaagccgcgccgagccctccctcccgctctcacagccgcttcccgccgatgccgcccaaatcgccgcaccgcccgcgcgcgcgcgcgccgtggtggccgaccggccagtcgccgccgccgtcagcgcctgccgcgcctgccctgcgtctgccgcccgtgtcgccgctccactccaaccgccccgccgtcatcgccgtcgtcatcgactcggccccgcctctccccgcgcgtccctccaagggacggaggctgagctccccccctctgccgcgtcgccctctctccctc

SEQ ID NO: 25320 - DNA, 8385 bp, Oryza sativa
  unsure (1)..(8385): unsure at all n locations
aatccgagccgttggctcatctcccctcgtcccatgcaaccccccggtgtgctcgctttcgcatgtatcgccgtggttcgctccaccaatcgccaccgccgtccgttgtccgttccggccggcgtcgtcgtctacctcccgccggcccgcgtggtagccacgtaggcgccacgtcggcgccacctcggccgcgaccgggtcaagcagaccccggtccgccgcttccctccgcccctcgcgcgcgcggtccaccgcgagccgtgaggctgcgcataggcccgccgcaccgcgtcctccgcgaaccgcgcgcatgcgccgcgcctccctccccaaaccctagcacgccccgcgtgcacctcgctcacggtgagctgagtcgccgacaagcgggtcccacccgggaccacgcgggttggacccggcccaccggctctctctctcccctccccgcccgcgcgcgcgcgttgggccgccttcttgggccggccggcccattaagctcggccgagccgccccattctctcgggccgcgccctagccgccagagggaagtctaatttcccgccctagccgccgtaagtccgtttgactccgtccaacttccaaagttcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcgaggcaagccacctttaaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgtactctgcacgggtatcgacggtcgccttcaaacttaaaatctgagaaacatcttgggtaaaacttgggttttacaaaagacttggaaaacccgacacctgggtcggtgtttgcgaactaaatgaatttccaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtttgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcttagcgtagttttgtttgactactgccttgtgaaatttgctgttgtggaatgggtttgatgtttggaaaatctgcggctgatgggatcagccaggcccaggtggccgtttgaaagctgttggccgggtgccaatcttgatcaattcaaaagactgaaacattgcacatactccgaccggatgagacgcactgtctcatccgtgtcgtttgagaagcactcccttagttgtttcagaaaagagtttaaataaaatcaatcgcaaaaacaacagcctttctttgaagcctacattaaacacttatttcccatggcttgctgagtactcctgtactcacccttgctctatataaataatcccccccagttgctgaagaagatgaagcggatcccgctgacgaggagttcttccaggagcaagccggctatgatgagttttagggtttcggcctagttcccaagtcgcgcctgtgatgtttggtccaagtcttggcttccgcttcccttttgtaatgcagttgtgagctcgagatctgtccgcagcccaacatgactgtactcctactctataataaagagacctctgttgctgtgatattctgtcttcctgtgataccagcactgtttcctgggactggtatcgattaacgggttaatttggagcatcacgggctagttccggtcgggactagttcggggcgtgacaaaaacagaggattgcaaaacacagaaaaaatatagtaatgaccgtttgattggaccataggaaaaacacaggaatttgaggagagataaagactcaaaggatttcttcttccatgaggttctacctcttgttaaaattcctccaaaacttgtatggaaaaaggcattccataggaatttcataggattccatagggttcattcctttgattcaaggctttgtaggaaaaattcctatagcaataaaatcctcttaaattcctatgaattttctttgaatcaaagggggccttagcctcgaattacactattagcatatgctgttagcctttaggccgttattgaaaagctcacatcctttaaatttttgcttaaccgtatgctatttctgaacactactctctccgccccaaagtaaattcatttatacacataccaataaaaaatagaataaacatgctttatatcaaatatcaatacaactattttttcgctttatctactcccataattatttcttatttttacaaactccgatacaataattactctaaaaataaatttatttcaagtaaaacaacaatagctaaaaatgaatattacgggagagggagtattgaacacaagtgcaaacatgattaaggctgtgttcgggagtgagggtcccggcacataaaatgaagcagcgtttaccacatgattaattaagttttagctaatttttttcaataatagattaatatgatttttaagcaactttcgtatagaaacttttcacaaaaagcgcaatgtttagcagtttgaaaagcgtgcgcacggaaaatgagacgagggagttgggaacaactccaaacgaacgcaacctaaggctgtgttcgtttctatatataggttgggaacccctctcttgtgcatgaaaaacatagcggtacattagcgtgtgattaattaaatattatgtttttttaaaaaaaggatcaatatgattttttaaaacaactttcgtatagaaactttttacagaataaaacacaccgtttagcagtttgaaaagcgtgcgcgcagaatacaagagagagggttgggaacaccgagcaaagaacataggctaaggccattcacactgcacctaggtgtcattccccttcacctaggcatagctcggagcctcgcaagaacgggggcttttgggcccacaagagaagaggtggagaaaggggaggtattggctcgttcttcgttagaatcgcagcttctaggcccacaagagaagaggtgaagaagggggagggaggggagaagcgccgatgccgatggcgatgccgtcgtcctcccggatctgcgctggccgcgccgccccccgatccatgcctgccgccgaggaaggaggccggacggtgcgccatacggggagctctgcccggtgcggtctaagcttggaccgcgccactgcattgccgcctccggccccgatgaggagagatggaggcgtggagctcggtgccgccgctactccaccggcgctcgggcggcgacgtcgccgccttcagccccgacgaggagaggtggaggcgtggagctcggtgtcgccgccgctttgcttcgtccgtccaggagagagagtggtgcggaatgtgtgagaggggagagggagagataaaagggagcggagagagatagatgggacctactccaagcaacatgcattgtggagtatgtactatctccatcccaaaatataatactccttctgtttcgaaatgtttgacaccgttgactttttagcacatgtttgaccgttcgtcttattcaaaaacttttgtgaaatatgtaaaattatatgcctacataaaaatatatttaacaatgaatcaaatgatatgaaaagaattaataattacttaaattttttgaataagacgacggntcaaacgtgtggnnnnngttaacggcgtcaaacatttcgaaacggagggagtaacttttagctatgaatcgtccagttggaagtctttcagaacgaacggtgagtgccccaagcgctttggtgatactccagtgtgagcgtgactgtgagtgaggtcacgaaaatgttttgaagcggtttctcgcatggagctgtgcaggtcgtgatggcgcctttggtgatggtcagctgtaccctggagcctctcccgcagtagcagcagcagctaaggcagagagagacatgctactatggtgcacggagattggagatggagagtggtcaaaggcgtaagcaggcatgcatcgcttcatttcagttcagggggtagtctcgctgcttttcaggaggaaaggctcgccggtctctgaggccattgctgaatgaatgataggattgagcttttgttacaaaggagtaaagagagagaatatctgcacgtgactcggctcggattctactatagacgtgtcacgtgcttgtgtacgcggacggcccgttgcaggcccatctaaggcctgctcagatgggtatccaaattctcatgaagtgatattcagtcaatgaaaaaaaaactggcgatgcaaacatgccatgattttatcggttgtactatatagtaattatgattagttaatttttgtcgaaataatagtaccacatccgttccgaaatattgtaatttaggatgagatttaggctttgttcgtttctcatggttggaaacgttctcctccggcgcaaaaaaaacggaacagttcattagcgtgtgattaattaagtattagtaaaaaaaattgaaaaataggttaatatggtgtttaaagcaactttcctataaaaaattttttacagaaaatacaccgtttagccgtttaaaaagcgtgtgcgcgaaaaatgagtgaggatagttggaaactcttagtgccgaacacaaccttaatcaatcctaaaacaagattgagatatgtccagattttttgttataagatgcatcaaatcaatgttttgggtaagatatatcaaatcaacgttttgggatgaagaaagtactctctccgtatctaaatataaaggattttagttggatgtgattagcgacggagggagtatgatagtttagcaatacaagcatgtcaagcagaggctggtgtgagtccatcatctgcagcgtcatggattacggataaaagcctgctgactttgctgtggtttagtgcgcgcgtgcatggagatgaccagatgacagcagattagcaggcagagtcccaagccagcagcagagccagagtccactaaatctgttgagcgtacgtgtcttcttcatccacccatgacgtccagtgctccaggctgctgcctgcctgcctgcgtttttcttgatccttggggattctctgctcagctctgggctctggcactgcctgccgacaaaaaaacaaaaaacaaaaagggcctgtccacttggatgggccattattattgaggcccatccaaacaaggtaaatcatgagataggctaatttgcctcctcctcggaataaagtcattcttaggccctgtttctttcagcttgggattattataatctagattattaagtcagattactataagttagattgttataatctgtagtagaataagcggttagttgtttctttcctagattattagagcctagattattgggtttgtaagtctaaaaagggagtggggtggcatggtgggtaatttttcatccaataatctggaaaaagctcacctaaatgagcttatcagattataataagctgggctccagattataataagctacttcaataagttgtctgtttctttcagcttactcctaataatttgtattataataatcccaagctgaaagaaaacagggccttaacctctcacggttgttttcaaataaattcatttttagcagtcattacatcaaagtttataaagaatagagaataaatatactgagagtaggcaaagtgctgaataattgcattgcgattcgataagttggagtattttagtatttgtcgttttatgttggtatacgtaggatgtgtgaaaaatgattttacattttataacggatgatgtagatagcactaaattgctaacggtacaaggaaatggcggtggctttggggccttcaagacggtggaggctgtaccgtaatatggagtatttgggccaaatatatattgggccgggccgagttttgttcttccacaaagccgtcgtggttatttgctgctaacctcaattcagcagatgaaatcatcaacatcatgtggccgtgccactttgcttcctccatacttaacattctgcattctagctccatccattgcctttgatttcttctgcaccaaatctcatcatatccaatctactttcttaccgtacagttacacacgtaatccatccattcttataaaaacctaaccttgttaggggatgagacttaatctagtacaatgaatttgaataatcctctatctagatttctcatactagattgtgtcctgttttttaattaggttgggtttttttaaaccaaagggagtatctataaagatcgagcttcatcgtagcgtctcaaaaagctttcaaactatatactagcagaattatccaatagcaaaaccgttcttttcttagaaaaaaaaatacagccaaaaagagctttcccaaccaaattggttttgagtcgttggatttcaaacggacgcctcggattagcgcgcgttcggtgcgggagacgttccaatttccacgcaacccgaggatgacaatgacatgtggaccccaactgctactcttgcgctgcgtgcacacgtggagcgagttgctgccacgcgcgtgccacttgtcatgtgttcggcgtcgggcccacacgtggcaggtcttgttcgtttgtaccgtgacctcctgtgctttttcagctactctagctgtctagcacagagcagagtagacagagaccaactcatcgctgggacacgtcaccttcctttctatgctctcttgatgaaaccatctctctctctctgtgtgcaaaaaatcgagttacacagagaaggcatatgagataattgtttgacctaattagggaaatgaacagcagtaaaatgcatccatcataagcacgccaaaacatcatctgatgagtttacttccattttatttttatttttttccctgatgaatggtgtttacttcactttgctcgtttacttcgatcggtctcgccaatcctaccagaagaagctaaaaacggcctctctttagaaataggtgaatgcctcagcctcatctgagcaatgaacacagaatctcgaccgatcaaggaaaaatgttcttttctgaacttgtcttctctgcatcctttccttgccgccggccaatttattgactcaccgagaagtttgataagtacaagagaataacaaaataacatggttgttgtgcagtctttttttttgcttcttcttcttaaacagattcttttcatcttgagccattgttgatctttgctcctctggtcgtcaactcttttctcctgtttcagggcgtaggacggaggaggagatgagaaaaacaagaacacttccagctctgaatttcactctgcatgcataagttgcaggattaggctgattgcagaagattcggtgagttgtttgacactcgagagaacttggtttgttttgaatttcggtctgtttatttgacctgttcttgtacctgaaacttgaaagactccgagtaagaggggagtaaacgagtgataagccccgcgatttgttagcggctgtttttcagctaaccatctttcaatttctgtactggtttgtcagtgacttctgcatgtggctgtgttgtgcgactaccttggtccttcctgattagtgatggggtttagcgcatggtaatctgtttaatgtgcatgcatgccgatgatctttcatgtagactgtatattcctgtgcttagaagccatctgtggatcaaatccatgttgtcttccaagcaattagctcatctgtgatttgatttgtacttactatttgggaagaatttttttgtctttatagcttttcttgcatgaattccattccatgatgca

SEQ ID NO: 25321 - DNA, 3009 bp, Oryza sativa
cattgtgtacctgtttggtgttgctctcccacctatccaaatcctgatgatccgatcggtacatccaccggttcggcgagcaatcttgttgaattcaacatcaactgaacctggtattttgcgaacaccatttcgcataaaaaattcagtagtagtgtagtactatatgttcatctaggctgaatgtattttttcttttccttttagctgtgacaatgtctgtgtaaccagcttcttccatgcaggtggagctacagaaacagatgacttatctgttttacaagaaaagatagaaatagccaccaatagcaaggacatcaatgaagctgataaaatgcatttgtataatgcttggagcactttactggatacgaccagtgatgaagttatgaaaagttcagacgtgccgcggccgcctcatctggagaattgcaggcttaaatgggaaagaaataagaaatttgacagttatagcgacaacggcgtatttcctccttggacattatggaaagggtcacttggtcttgagttattcaaccagaactattcagattcagaagagtggaggcaaatgtttttcaggtcaaatgctaaatctgacagggcgccatatccaccttgggtgtgtaaacttgcctgaactcgtaattgtcttgtcagtactactatgaatgcagtattctaacttttgagttacaacaaaactttaaagattgcaggatcagatgaagaaaactatccactgaccagacaagtgcagagagatgtatggattcatcaacatcctccaaactgcagtgatccaagcttgaggtttctctatgcagactgggagaggctaccgggatttggtataggtgcgcaactcgctggaatgtcgggacttcttgctattgctataaaagagagaaggattctagttgcaggatactacaaccgtgctgatcacaatggttgtaaaggtaggaacaatccagcttaccttgtagattatgaattgataatatgatatgtgtagtgctacctcaagttgtaacttttaactgacatgataactgagataactgtcaatgttcaattttcaggcctagcaagatctagctggtcatgctactttttacctgaaacatctgcagactgccagaaacgtgctttagatctcatgcaaagcaaagattctagggaaaatggaattataaaagttaaggaaaactatacctccaagcaaatatgggctgggcatatacctaggtaccatttcgatgcgctggtcctgtttctggaaagctaaacacgcacccaatactgatgagctatacacatttactccctccgttcctaaatatttgacaccgttgattttttaaaacatgtttaaccattcgtcttattcaaaaaatttaagtaactattaattcttttcctatcatttgattcattgttaaatatacttttatgtatacatatagttttacatatttcacaaagttttttgaataagacgaatgatcatgtttaaaaaagtcaacggcgtcaaatatttagggacggagggagtatatctcattcatcgctctgttcttgtggctcttgccgattcatgcacatgttttctgaaacctgctgttatgcaggatatgggggagaccatggaaatatatgcaaccgacaacagagatagatgggagattggttaaaaatcattgtaaaatggatcggagatggtggattgcacaggtgtgtacctcatgccaagatgaatgatgagcatattttgtgctattcataatggggatgcaaatatgctttatcaacctgaaacttccatgtaggccctgagatacctaatgaggttccagtcagagtacatgtgcagattactgaatgtggctagacattcagcatttggcatgcaggcagcaaagatggttcttgaaaatgtcccagatccaccaaagtttgtattagcaatctgaagatttttatgttgctttgttccgtggagagttttgtctgcgcatcattcggataaagcaacattagcactaaccaccttacttttttagataagtaactgaaagatttcacaattgcagcctagcattagcagaacagaatctgacattgagcgacttgtgtggtcggagcataaaccatatatacccgggcctcttatcagtatgcatgtaaggatgggagataaagcttgtgaaatggaagtagttggctttgagaaatacatggagttggctggtcgtcttcgaaaacgttttccaagtctcaagaacatctggctttctactgaaatgcaggcaatttaactcctcaattctcatccctcgtatggtgtaaattaatttcttcatttcattggtctgtaatttaactctgctaatgctgaaatgtaggaagttatcgacgaaacaaaattatatcccaaatggaatttctatttcacaaatgtgacgcgccaagatgtcaatgtgagcatggcaatgtatgaggccagcctgggccgtgagaccagcacaaactatccccttgtcaatttcatcatggccactgaagcagatttcttcattggagccctgggatcaacctggtgctacctcatcgacggcatgcggaacaccgcaggaaaggtgatgtctggctatctgtcggtgaacaaggaccggttctggtaagcaattcagaagctgctaaaccttgttcattgtattttagctcctctgaatagatatgtttggcctaagtttgcttctgtacggcaatagggcatgtatatatgcaccatcctagcagataactttagcgtgtgaaacttctgagctaataggaaaacagtatcgttatatcaaatcaggtccatatattttgatctggtatccacttaatcctagatatatattatcctgaggtccagtgtacccaagaaaaaagaggatgcacttaccaaattttcagtggtactcataatgctgataagtggtacacgagagatccaat

SEQ ID NO: 25322 - DNA, 15972 bp, Oryza sativa
  unsure (1)..(15972): unsure at all n locations
caaacgaccaaacatgctaactaggaagcgctggcaacgggggatgggcaagacgccaaaggatggcctcttacgccatggctgcgacaacctcaggctagggccgggaatggttgtcgaacacatggttgtcccttttcattccaaatagaccaaccgccaagagtcacaatcgtgttgaacccacgacgatgctccctcggaactttgagccgacaggagcagtgccactcaaagaaagaatcagcgtcagagggaaagcactgagggaggccggggcttgaaaggacagtccaccacagctatagggactcaaggcacccaatcagaatgtgatcaactgtttcttccagttggtcacaaaagacacaataggttgggtgcggcgagccacgcttctccaatcggtcagtcgtccagtagcgccagtgagcgaccagccacaggaagtagcgacgtgacactgaggtggggcaaaagagcgccagattggtaggtgctgaaacgagatcctgcccgagaagaggccaagtaagctgatcgggtggagtacgaccccgaactctcccacctccagttgaaagaaccaagatggccctctgagagagtcgttgtccgcagcaacgaccaaatctgcaagttttgcagtattgcatgagctgtctagattgattctactaccaatagagaccactgtaaaactccaccttttttttacataatggaagtattgtttgtggcctctacatcaactatgatgcacatggccatattatggacaccaggattttaaccctagtggtaagaatcacgcacccacgactccaccaccacaccaatggtgcttcaaataaatggatcatttcgacaaagttccaatgacagatgagaatgttgaactggccatttctatatggagaaaggaacactgtagcatgaacctatgcactaagaattgtgctctacaaattttctttagccaaccttttccagtcaccctacatgagtagatgacatgtaatactttacctccttttgttcttctcctaataaggtaccattctctagtgcttccatttgcgattcctggccaagagtgatgcactagtttcttctcaacaacccatccatccagtcactgcttcttagagatggatggatcctgaaactctgaaagggacactgtaacagtgccctgaagaaaaggaacaatgaacttctcgtggcatacatcgtatataatgagtgcaacacatcacaatgccaaggtagtggacatgagcacatcgcatttcagcttgctccccacttccaaagattccttctgaatcctatcagcttctaccatggatcaagccccagggggctctctccccttggacaccatggaatgagaactgtgcgcacgcgcaatggcgatcgcgccttcggtggggcggttcttggagccctggtgactccattgacctgatgatttcaagttggatgatttttgcaaatgcaatcagtatttggcaatggtttgtgttggggttgttactgtatgcagtggatgcagatgtatgaagtttagcagcagtaaaaatgcactactgcatggttgatcattgcttggcctcaatggctcaatgttaggtatcagaattcagaaagtggtatattctgatggatatatagtatatggatgccatgcatccttatctgaagtctaggaggtagagttactatagtagtagacgagtagtgccctagcaatgcatggaacttgtgtgcatttttggatgattattgtaaggcaaaactgtagcaaaaaatgggttaagacatgggataagagagtgcgttttctgtaggcagagtgcatcttctgacttggaatgcagattagaacactaacagttgtatcatcacttcagtcaaaaaacacttgtattattaccaggtatgacgcatgactcatctggaacatattcttgaaagaaggagcatcattcaaaaaggaagtcacccggtaagggcattatctccaaattttggttaaaaacaggaaatccgatactaaaaggtagtgagaggaggcttcatgctgctgacgaaccgtgcaaagcaccaaaaacagttgcagtcaccatggacaagactcatggtcagcaaactgcagaaaaacaacgcatttccggcaaaaacttcttccggcttcagtctgaaggccgagaacaaatctgctacgaacacatccaactccaaatcgtgaccatcagtctgaatcgcatattagaaaaaaaaaagaggagaaaatacataaaagaaaagaaataaagaagagaaagctgcttttcttgtttctctttacagctgaaaaccgctctcgtctgcaactttttcgtgtatcatcagagcatccaaaaggaggagaattgccccagacaaattgtgaggatcagagggaaacaaccagacacacacatacacagacgcatcgttatgggagacgtcagcctccaccacctgcactgcactggctaattttgatcactgaattaagcacacacacccctactaactaatctttctgaaacacatagcaattgagcatcacagtccctacggtagagatcattcgcattgtttaatttaagagcaattttatgaagaggttctacgaggtattaaattttactctaaatttttttgtatctcatggtaactcctcaagtactgtaaaattgctcttgatttaatggatcatacatttttatgctaccaccttaacaactggtagtagaattcatcaatcgatagttgagatcactgctactagtgatagttctaaccgcagtaaaagtacttaatattcaatgccctgttctctggcattaaaatcaaatcagcagatcattttaggatcttagggatttggaattcataaatctatatgatagtgacctatttttgcccactaattctttctttcccatgtcaatgtccatgagctgcaggaacaatagggatcacctagcagcacaccaacttgtgcactgcccacttaggactttggttgcaaatatacacattttttttcagataatgaaatgtatacattttatacatcatcatctgctcttataaagtagcacttctctccacttagatcctacatatgtgcgatgataaatcactttatggaaaaggattggcagggcgatgtttaattttttgatgaacaaaacaaaggtcggcataaatggacctgaaagtagaaaaaaaagcttctaatcccaatagcctggattaggaaaacgccagccatacgctcatctttttatcatcaaattaaagccaaatgcagtgaccattttaagatcacattatgcactttctttattaaaaaaaaaaatgtgccaaaaaacatagtattattgtataaaagattacataattaattgggtccacctgaaatttcttttcgtacacgatatagaatctaccacttcgagcttttcctaaagctagcgtagatagagatatgcaaactgtaaaatcacttagcaaagtaatcccacataacttctcagactaattatctcttgagaaagaaaacttgaaacaacttgcattgtagtagacaatcatatatgaagcgactgatatgacagattagtagtacaattcagacagattagtggtacaattcagtgtccaatttgccgctcgtcgtgaaaaacattaattcgatgaaatgaaagcttaattaatcaaccaaaagatggctttgatatcatcatatggtttgcatcgtggatcccattgagcattgatcgatctttgtcacacatctctgatcatctgtcagaaacgtacaagactctcccagatcacagcacgtttatccggatcaactcctgaaaagatgcacattccttggtggaatatctttgcgcacgtaaaagttcatatacatacgtgaagattacaaactcattaattacgtgctaactagtaattaattagtaaaatcaatccggacacactagaacactagaacatcatgtaattcagaaagcaacgctggtttaatttctcactgacaaattgctgcacttgacacttgtcaccctcaaatctttcatattttgcacatttttgttgtgattcctttagctaattctgctctgttacttataaagtacagtcattgtgcacaattagcttagctccattactcagaagtatgcagccatttcagtccaatcagttgtgcattatgcgaagcaaaatttaactataactttgtatgttctattcctatccaagataccaaaattaataaactaaagtgcaattgagagagagatgcccgattagccacaggtttcttagtgctatctgaacttacgcactatatcattctgcaaacaaacgatgcgtgcacgggttaaaactagaatcatactgcaataagttaactatgggcatagctagagattagtgaatattaaacaagtcaattagccaaccagcatcctaaacatgtcctaaacagaaaggaccaattagatggctggatgaagcttttaattaaactgactttttcttatttttggaagcatgagccaataggaggatggtttagaagaataaatcatgcagctagtgttgcgaatgatctttccattctggcttgggagaaaaaaagaagaaagggttatctctctctctcatttttaggtcacatttgttgtgaagtggacactcatgaaatggcaacaacagccagcaaaggaaggaaggaaggatgaaggaaaaaaaaaggcctttattatcatgttttgcattcttgttaaggagcattaagccctgaaaagtaggtgctagccagtgccttgcacccttggtgagatttgttaacatttaattaagctatctctacaaacccttctcttgaggctttctggtttgtgcttaggacttggtttcctcctgaaaccaacaagaagattcctgcagagaaccagaattatgctgtgtgcattgcacagttgggccagttagtcacggcaccagattttgacccttgcatgcaagggacccccaaaaagagagatatatgtgcttcccatgagctgacacttgttttctttagatgagctgacgcctgtttgttgctgaataatcatatggattcctatcatcctggcatgcacaaacatatcgctccaagaaactttacaacgtcgatgtatttgttctgcccatatggtgaccactggaaaaaccactatgaatatgaaccgctagttggctgtgtacacacttgttggtgtagaagccggcttttgatccattaataaaataaactgctagaacaaatgctaggaaaaaaacaataatttacagcataatgcaatttttcaagaacgagatttcttgaagagaacatcttacaaaaaaagatatcgtgcgaatcacgcatgattttcttttttagcatcatattttttttcattttctggtaagtttgtaggccataaaaattttatatgtctgattctaattctaattcaaaaccatatattttttttctaaatgtttctatattaatagtctctaaatataaagtttctttgtataaatttttaaagacaacatttcatgatagacacgacattgactgaacatgtttgcgctagacccagacacacaaatattggcacattaaacctacctaacatcataagctctatggtgtttgacaagactatgactactatatttttttttcaaaaatataagacttcagctagtttagagtatgaatataacaaaatttagctggacctataccaaacgaggtcggccgggtttcctattgtttgtggcgagggaggcagcaagcaccatatccgaggtgtcatggacgtgtacgcaacgcgggtgtacttacccattttttcttcgatctctttcttctgttctgcacttctgcttggaccccatgacgtgcgacgcaacggcagctgcgaccacttacactgcagtgcgtaacggacatggaggcaaaataacgcctcaccgtttcaatttttttttccgttgcggaaaaaaggcgcgaaatacacgtcgtggagacaaaatttttcgcgcccccgcatccgcgcaggggagatggatgtgtatgtacacacacgcgtagatatgttatgtacgtacgtaagcgaactagttaattaatgccaggtaatacgtacgtatgcgcgcacttataatacgagaaataaactggctgacctaatattttcttccatttatgacatgttgttttgtgttgaaggactgaatagctagtgatttgtgatagttatttaagggtagaagcaaataaattactttctctctttaattttatatattagaagtcattttaatttttttcctaatcaaatttatttatgtttgatcaagtttataaaaaaagttatagcattttcaacgtaaaataagcatattatcaaaatatattcatcgctagatttaatgaaactaatttggtattttagatattgctaatttttttcctataaatttacactagaaaaaaaatcaaaacgacttataatcagaaaaggagtgagtaaatattaactagtccctactattataaaaattgaaaatatttttgccggtattttggtacgtcatccgtatttgagtcggtttttaagtttatttgcttttggaaatacaaaaggagttgtataagaaatttcttaaaaaaactcgcatgccaacttgaaatgaaagtcggactcctaattgcacacagtgaatttcatcctagctaaacatataacaataataagattaaaatatcattcacccattgcaatcgcatgggcattttttctagttaaagaatatatttgaaacagcaattaaaaaattaaattcaaatatagaaagttcttataaaaatcacgttatctagaagctcaggaaaaaaaaagtgtgcacggcaaattcgattcagtttcattaagcgatcgatgttgggcggctagttcatttaatgatggtcgcgtcgacgccgtcgatcgatcataccagagccaaccgtatacagtgaacatattttttcttttttcttttaggatgaggtatgcgacttgttagtactgtcgaccttagctacacttttccgttgcacggctgcgccactatccgaccaactcagctcatgtgcatgcatgcttactgtgtaaccgatcagttcatatttatctttttttttaaaaacacacacacacacacaaataccatgtactccactacaattgtagatagataccttagagcagtggtgtagttagaattttctcacgcctaaagcacaactagtataatttacataatttacctttatttttcgtgttttgaagtttttaaatgtaacttttaatagatatttaagcttagggcaacagccctaactgccctacccagttttcgtcactgcgcctagagaaatataccttttttttaaaaaaaaagaaaaacactaaaaagaaagaaaagaaaaaggagtaggagtcggcgtcatggccacgtcaggccggcgtcgctgcagcagcggcggtggcgtggcctccattgcgcatacatggagagcatccggctgatctggtccctgtactagcagaaccctagctaagcttagctccattgtctccaacttgcgatcgatccatccatccatccattaatttccgcgatccaatcgaaccacgatatgtgtaaagctatagcatatctacagtcactccatgctgcaccgcacaaaacactctaatcagaattaattaattaattaattatataatcatccatcctattttaaatacattagcgggtttccgtgtttgtcgtttgaccgcacatcttatttaacgaatttataaaaaaaataaaaaaaagtcgcgcataaaatattattcatgttttatcatctaatagcaacaaaaatactaatcaaaaagtttaaaacaaaacgaacgatcaaactttagacatagaaatccacatacatacttaaaagtttacgaccttaattagtcctactcccctggacactgccctcttctttaattaactaaataattaattaacacatgagctgattagtgatactaataagaaaattatagtgcatgtcaactagccaattacttgattagttattgtctttttttagaggaggcaactagctaattagcagctgcatgcatggtcacctgagtgtgagtggccgagtaggttaagcaagggtctgtctctgcttgattcctgcagctgctcatgtttccctcactccattgcccctgccttttcgcccaaaagatgggccgctcaaattaacaacccggcctaaagcaaccggctttctttcctttctttctttaatttctttccttctcctctttaattctctgcgctacaaatatgtatacactgccttactctaattagaagtaattacttaatcaatttctcccttaatacagaattagcatccaaccagatcatgcgacgaggcttaattacgtgtacataactagtatataataatataactatatatgatcccactgatcgaattaagcaactaactaagccactaactgaatgaacaggacacaaacagttctacgaatggcatggtcgatccccactatgtaagtgtatatatatatctctgaattcagatacacctttctactttaatttagctaagctagctagctctacctaatattgtaacatacaaggccactatctgtccctgtatgtgcaccagcagtgccaaatttcgctgcatgcttagctaagctaagcttatatagcaggagcactcgaggtgagcagagagagaggattgaagaagaaggagaagagcaccaagctagtagcctgatctctctctctctctctaactgtctatctatataagctaacaaggcaggacggttgttgcttgcgagatcatccctgcctgcctgtccctttcctgcatccatccatccatcttgatcttctcctagctcgattccacacatgtgaacgtacgtacgtttcagttaattgttcgatcgatcgatcgatcagctgctgctgctgctgctgcaacgaggaagaagaagaagaagaagatggtgaagttctcgagggagtacgaggcgagcatcataccggagtggaaggctgcgttcgtcgactacaagcggctcaagaagctcatcaagaggatcaaggtcacccgccgcgacgactccttcgccgccgccaacgccgcagccgcagccgaccaccttctcccgccgccgcccgcagagaaggaagccggtggctatgggttctccattcttgaccccgttcgcgccatcgccgcccgcttctccgctggacaacagccttctgcctcagtacgtcgtcgttgtgtctcgaatcaaatactaactaataaacgtgtattaattaattaatacacatttctgatgttaatacgtatgtgcatttcgcaggaggatgaggagtgcccggacagaggggagctcgtgcgatccacggacaagcatgtataaaattaattagttaatttgattgtaaataaaactaagtaattaaattgattgtaaaaatggagatgcatggatggatggtgtaggagagggagttcatggagagggcggacgaggagctggagaaggtgaacgcgttctacacggggcaggaggcggagctgctggcgcgcggcgacgcgctgctggagcagctccggatcctcgccgacgtcaagcgcatcctcgccgaccacgccgccgcccgccgcgcccgcggcctcgcccgaagccgctctatgccgccgccgccgccgtcctcctcgccgccgtcgtcggtgcacggctccagcggccgctacctcctctccggcctctcctcgccgcagtccatgtcaggtaggtgacaccaaccacccacacacatgaatcctgggctagctgcacatctctttatgcatgcaatgtcatgtcatgtcgatgtcgccgtcgtcgtcgtcgatggcgtgttttgcagatgggagcctggagttgcagcaggcgcaggtgtcggagggcgcggcggtggcggacgaggtgatggcggcgctggagcggaacggcgtcagcttcgtggggctcgccgggaagaaggacggcaagaccaaggacggcagcggcaaagggcggggcggcggcggcggcggaggcggaggcgtgctgcagctgccagcgacggtgaggatcgacatcccggcgacgagccccgggcgggcggcgctcaaggtgtgggaggagctcgtgaacgtgctccgcaaggacggcgccgaccccgccgcggcgttcgtccaccggaagaagatccagcacgccgagaagaacatccgcgacgccttcatggcgctctaccgcggcctcgagctgctcaagaaattcaggcacatcttccctcttcatctttcctttttgccatatctgacaagctaaaaccacgaagtcacggtattttagaacaagacttgccttttgtgtctatgtatattgtcttctatgccatgcatgatgcatatatatacgcatttgtaagctatttagaattctgatggccaaacctcacactaatagcatgcaactgatcgatcacactaattgcatgcacacaaatgatatagatagtttggttaactgaccaactaggaaaaaaaaattaagttgtttcttcatagatgtatatctaacaaattactactatgaatattagttgcagcatgagtcatggagcactgtgtgagcagcacacaactacacctgcactgcacccaagcatgcagtacagtagtagtttagtcaaatttcaaccccgttttgcatggaagcatccgtgtaaatcacgtagccatccatacaccatcctgtgtcacctgaaagcgactgtttctcctttcaaattactaattcttttgtggtttttgaaaaggtagattaattcaccggttattttaggtggctgtctttatatttcttttacttgtcaattatggtgttcttgtggttctgacggatttggatgcttttttggttgcatgcatggatggatgggagcagctctctcaatgtaaaggctttcaccaaaatattgaagaaatttgtcaaggtaatatactaattagccacatctgtgcccttttgaaatggatggatggaagaatgaagagtctaaataatagatgataaagattaaagaaaaccggtctacatatataaggcttctaggagaataaagttctaagtgtactattagtagtttagtaccctcaaagcagaggtactagatctcattctcgacagtgtaatcctagtcactagtcagcctaataacatgagacagcataaacattttcttgcaggaataatttaattttttaatatatttttttaaaaaaatgctactccgagctgacagtgactggtacgaactgctttgcatttcaggtgtccgagcaacagcgagctacagacctgttttcagagaaggtgaagaggtcgccatttagcagctccgacaaggtatcatctggtgctccacaatcctactgcaaagctgcacaaacatacaaattcacttcaatcagttttttgggggatggaaacatgtctctctgacgaatatgaactgaagcatgcgaaattctgaacaggtacttcagctagcagatgaggtcgagtgcatcttcatgaagcatttcacaggcaatgacaggaaggtggcgatgaaataccttaagccacagcagcccagaaacactcacatgatcaccttcctcgtaggcatgtagctgagcaacttcaagatcagaatatcagatctgtcatctgcatttggcacacaaatctaacttcacttcttcttttttttcatgttctaatttgcaggtttgttcacgggcacttttgtttcactgttcatcatatacgcgattttagcccatgttagtggtatttttacttccactgggaactcagcctacatggaaattgtgtaccatgttttcaggtaaattcttgagaattacggttcagttctaggggtaaagcactatttagaaatagattttttattactgcgtttgtacttggtacttctgttcaggctatatatgctctgttcttgacaagagttcaattgattagatttagcatgtgggctcaatgtttgcaaatttttcaaatttcagacttaggacctcatgataataaaagatgcaattttacctcaaagtaatgtatagatgtgaccttgcttctgcagcatgtttgctctcatcagcctccacatcttcctgtatgggtgcaacctcttcatgtggaagaacacaaggatcaatcacaacttcatattcgatttctcctcaaacaccgccttgacgcaccgggacgccttcctcatgtctgcatcgataatgtgcactgttgtcgctgcactggtcatcaatcttttcctcaagaacgccggtgtagcctatgccaatgctttgcctggagcactcctactagtaagaaacataaactttgggaaaatttggtaattcagctctgtttcatgtactgattttcagttctcaactcggattctgttgtttcagctgtcaacaggtgtactattctgtccatttgacatattctaccgctcgacgcgatactgcttcatgcgtgtcatgcgcaatatcatattttcaccattctataaggtaaagactaaagacctcatgagttttcttatcacaaattgttgaaagcatctatctgataagcaggctgctttgacatgcaggttctgatggctgatttcttcatggctgaccaactaactagccaggtaatactgaagaaactgaactttacactagagcttttgagagttggagctcagcatcttatgagtgaactggtgctactatctgcagattccactattacggcacatggaatttacagcgtgctacttcatggctggaagctttagaactcacccatatgagacctgtactagtggccaacaatataagcatctggcctatgtgatctcctttctcccatacttctggagagccttgcaggtatgaatctttagatgggaaatactaacgattaacaactttgtttggatcagtttcaaactaatagctgtgtcatgttttgaagtgtttaagaaggtacttggaggaaggacatgatatcaaccaacttgctaatgctggaaaatatgtatcagcaatggtagcagctgctgttaggttcaaatatgctgcaacaccaacaccattctgggtgtggatggtcatcatttcatcctcaggtgccacaatttaccagctctactgggactttgtcaaggactggggcttcttaaacccaaaatcaaagaaccgatggcttcgtaacgagctcatcttgaagaataaatcaatctactacgtatccatggtactatgcttaatatacttcatttctgactaggctagaaaattccagatctaggacactaatgccttcaaataattacagatgctcaatcttgcacttcgcctagcatggactgagagtgtaatgaagatccatattggtaaggttgagtcgcgcttactggatttctcgctcgcttcactagagataatcagacgaggccattggaacttctataggtaattggaagtacttttacaaggaacatcaattttaatttaatgttatggtgtaacatggtgaaatggtttatgggattgcagattggagaatgaacatttgaacaacgttggcaagttcagagcagtgaagactgtcccattaccattccgtgaacttgaaactgattgattaagcagtaggacatgccggcatgctgccaacatcaaggccagtaaggatcagagttccaggaatggagatgctgcttgccgctagatttggtacataagtggtaataaagtttgcagagaccattggtgcacaagaccatgatgttgctgattaggatggaataagcttaaatcagagcagctaatcgaggcagttcgtcaaaaaagaaggaataatcccttcttggtccgatgaagattgttgggcgtcatttcgctaacaagatcttaattttgtttatggttgtgttatgtatgtatctggagatggatgcccaccctccaaaaaaaatattccatgaattcatatgcaccattgcatcaaactgaattcaaataatttgccgataaacaaaataagtaagatgtcaatgttagagaaggaaataagaacacaatggggtaaaataaacatgcaatagatattaattaactgaaggggaagaaacccaatcatttctgctaatacagtgaaagcaagatgcttggcactacagatgactaaataagctaaagcataaacatagtacaaatatattacatgtcgatcacatgatgcacacgataaatagatagctatgacagatacctccattgtgctggacggtctcttgagacaagaagaacccttgatgacgagtaatcgaatgtagggcagtacaaatcatcaaagccaatagcctctcttactccaagagtggctccacggtcaaagctgtaagtttgttgaccgtcctccttaaaggcgtcaaatgcaaatagtcccataccacatgcagccaagacaaggttggagttgccccatacttgggttattgaagagtgatggaagtgggcattgaaatcaggtagctcataggttgcaacaagctttccctttctcagtgaatattgctgaactcgtgatttcagacccccttttatttgcagcctaccttctgtgctcccaatgaataccgagtcaccacgtgagaagattgaacttgctgtaccaccatgtcttgccattttaagaccgatgccagcaggtacacgaaagtcaaatacattaacactttcttgtgtgctaaaaacaccatcatttccctccacctcacaggaactaactctgcaaaacagaacgataaacaagttaactttgaaaacatgtcagctcacacaaaacagaacttacatctcctttagattagttacatttccaagtttcagaatcatcaatgatcaagacaaaaaaaaatcagctattggtaaatgaactaaaaaatcctgcatttgcaagcataagccaagttcaaccagacaggatctagtatagtgttaccaatggtacacaaagggcattcaagctaataattccaggcgtacctttgacgaactcctccgcccagctctgcatcagtgttgttcacatgaaggcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25323 - DNA, 7088 bp, Oryza sativa
taaactcaaaatcaacttatgaaaaatgaatacataaataagctatatcattatgacaatatcaaaggaatggtgtttatagatgtccaaatttatatgcagtactccctaccactaaggattgaatgcacaatgaactcaaatcaacttatcaaagatgaatacataaataagctatatcattatgacaatatcaaaggaaaggttaaaaaaattcaagttactctatctatcagcagagggcatgaagagtcaaaatagagaaaataaatggaactggcccaaaaatactttctacagttgcctttaaaattttaactacacgtaagaagttcttaagttaacaacaataatcttaaggaaattgaaaaggttaaccttaaagctaacagattactataagaaattcagaatgaagtagcttcaattgttttcaaactaatttataagaaacttggtgtgtttatgtgtactttcagaataaaacttcataggaacaaaacctccataatctctgtatttatctgtctatatttgaacttttaagaaacagaaaatatgataatgatgtgaaactcatctaagcaataatgtaataaaccaacagagacaatagcagacctggaacactcgaacgggtaaccaattcctttgatagagcatcgacttgctctttggttggcacctgaaacaaacaaatacgcatcagtccacactaatagctaaatgctgacaaaaataagaataggaaaatcgagattacaagtataacaggtaaacaaagaagctcctactgaatcaacaagccctgtttctggaaggaactttattggcagatcatcaaactatttcaacaaggattctataagaaaggcaaaagccaaacctttccagtcaaaagaagccaaaggagaccctccggcaaaggttctccacctttaattgctgttggcagcactttctggcactctggaatcgagagacccctgaaacgaataccctggatagaaaagagagagatttacatccaacagcaaaacatggagtgatacacgtttaaatttcacaaattccaactaagttacaactctaactcaaaatatgaagcaaaaccgccacctctaaacgataaatcataaaagcatcacactctttcaatgaagcacattactatatagtgacttcagaaatgagaaatctagactattttgtccgtgtacctcctttaaatcaatgtgctaaagttgattgtggaacttgattcacattgacaaatatgaataataattacatcgttgttactgtgaattgaacagatcatgctcaactgttagtacagaaacttgtttggagatcatgaaaatatggtgattcatttgtttaatttttcatctattgcacattacaagatatatatagacaaaataagcacttctgcttttatattatggtatcatagaaccatacatagttacaagtatacctcctccgggtcaagcaatgatgtttcccaaagcattccaatcattcctctcatcccgccaaggacctggagaaacacaattcaagactttagcccaatcaattaaggacacccttaaaaagcaatagcaatagatttatccataaataatcgatagcagaatcataccatatcaacagttatgtttccaagctggaccttcccatgttctgatttaagtttctttaagcgatcctgtaccagaatggtaaagtgagttgtgcttttctatcctgatctttgacaggaaatcagctcatatatagagtttaggtaaaagtgaactggtgagctagctgcaagtaggtccttctctgatacagattctgaatgttgttattagtgcttgatgcaaaactaaacttgtgaagaaaacaataacctgataggtcaatcttgtagtgcattttcaatagcccagagaaccaagctagtgatgggggatttcttaaggtgctgaaacaatgcgttcaatacagtgttcatctaacatttgcttctatgccccagcacagcttttacacaagagagagagagagagagagagagagaagaagaagaagaagaagagaggtaatccgcaacatttggatgttggatgtaagcatgccctcacacagtaacagcaacttgcatgaagcaagaagatggcaacattataggctaaagcaaaaaaagtaaagataaggaattggatgccagaaacatttcaactttgtcgaattattagatgtgctagcgagtaacaaaacatacctgttgctcgggaatcaattcctgcagctgggacttaagatcctgaaagcataatatttaggaacacaaatcaaacatctttttcagagcacatttccaacttaatttcaatcgtagccagccacagaaggtagagagggtaactatcaatttcaaccatgcaaatatttatagcacgaacaaacaaacaaagaaacaaacaaactattattgtcttacaagatcagatggactctgcatctgcagccatctcacaccaccaagcgtggtggcctcctgtgcctggcagcaacacgagcaaacggaatttcagcgccacaccacaaatgcacaaaaaaattgacatggacgatcgatgatggatcaccactactcaccatgcgggatcgaatcctcgaaaccgcggtcaggccccggaagaacgccatcgccgcctgcaggggtggacctaacagttgaattgaaccaacccccagatattatactccccagattgaacctagcttccattccagatcgagtggaggataagacaaggttaaggcgagttcgagggcgcgctcaccggaggcggaagggaagcagcaggacgacggcacccgccgccgctcctagcgaggaggagagacctcctccgggatccgaggccgggagggaagacggacggggagattgcctcgcttgggcaccgccgcgatgcgatgcgatgcgatgctcgccgtcgccagcgatggagatcgggtcgacggcggcggcaaggagagggatggatggggttgggtttcccttcgccgtcgtcgagtcacgggggagggagaagacccatcgactaacaaggccggcccattaagcaggaagcccagcccattaaggagaggaaatggctatacatacgacccaactgtcgactcacgtggtgtttggatccagggacttaactttagtccctgtatttagatactaatttagagtattaaatataactacttacaaaactaattacataaatgaaagttaattcgcgagacaatttttttaagcctaattaatccataattagagaatgtttactgtaacatcacacaggctaatcatggattaattaggctcaatagattcgtctcgcgaattagtccaagattatggatgggttttattaatagtctacgtttaatatttataattaatttccaaacatccgatgtgatagggacttaaaagttttagtcccatctaaacagggtctgaataacggttgtaaatggctactccctccgtcccataaaaaaccaacctaccggatgtgacacatcataatactatgaatctggacatattcgtagtaccataatatgtcacatccggtattagattcgttttttatgaaacggagggagtattttgcatattaacatgtttttttttaatctatggttgcatatctctagtcgtgtaagtcgtatgtattgcaacactcttaaggagaggacgaatgttgtttagtagcatgggctatccgtatcacgaggcagcggagcacacgctttgcagggcgtcgtggatcggtggacgttctaccgcccgcgaagtttaaaaagaaagattgatttttttttctttcagaaaaaaatacttgcatgcgttatatggggaagaaaagagaaggaaattgagaagagaaacagagagtgtagtcgcctagtcggcaaatggtagtaagtggcgatcataatgcatattgctcagcttagggcatccacaatgtgagccactcctagagtgtcctcactaactgaggacactcgtagggggaacttgtctcgcaatggagggtatccctggatgggcttctcaaaatctgaaacaacccgataagggtactacatctcacaatgggtgtcctggctcaaggtagcccagtacaaaaattccacccatacccctcatcagaccactagcccagcaacctcttccttttctctttctcgcattttctcttctcctccgcccactgtctccttctcttccgatctctccccctctctctcagtcgaatgaggcgcggtggcgaacggcaagcgccgcgtgaggtggacgatggcgacgggcgcgcggcgtggccgacggcgacgacgtgcgcggtggccgacgacgacgagcgcgcgggctggccgatgacatcaattgccagatccccttccctccgccgcggggtcgtcgccgtcgccgtcgagggtcgtcgccgtcggagtggcggcggagtggggcttgccggatctggcctcgagcagcgacggcggcggcttgccggcgaggtcagcgcccggtcgccctcctcccgctcccctctctccctccagccgtcgccgtcgccgtcgccgaccccggactccgccaccccgtgctgcctcacgggtcgcctcgctgacaactccaccctcaactccgacacccccggcacccccgcccagcgccgcctcacgggtcgcctcgccgacaactggctcgccctcctcttcaaggctgccgagcttctcctcgccgtcgcgatggcgtctggtggagcggatcgacgagcaggcggcgctgtgggagagaggcgagggtaggagggggatttggggggagcggcgaggagacgggagcctgcagtgggtctcctcccaggggcgagggtcgtgtctctgcgaaaagcagttgctccttgcaaagagccgtgtccccctgcttggcgccgcgttcctagctggggagacgactcacgctgaaaaggggacgggagggaaacggccgtttgcgagggcacgagtcgacggcacccattgtggatggccttattagtagtagtgtcggtcctatcattgtgtagcagtaactctttggccactgtaacaggtgtaaggctgtatttttttttggaggggttggaaagcccctccccttcgcatacaaaatgggacaatagattaacgtatggttaattaagtattagtttaaaaaacttaataagattaatatgatttttacagcaacttttttatagaattttttttataaaaatataccgtttagtagtttgggaagcgtccgcgtgataaacaacagagtgaggttaagaagcaaacatgacctaagtgtgccctatttttacaatggattggaaaaggagaatctggttccctacgttatccatatctttttatattatttttcgtccttttaatccgtcaagtctatagatggccatgtgggccgcccggcacggcacggcccaggcccggccgtgcctgggccgaggcttgtcgggccggcacggcccgaccgacgcaccgggccgtgccgtgccagcccacgtgccgcactcatagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgctgtggtatattaatagctaaaataagtctatttaaggtccctattctttagacattgacatttatatgtctatttttagtccctatactttgtgtaccgggtctggcctgccagcccatcgtgccgggccggcccgaccgtgccgggccagcccagcgtgctggtggggaggcccaggcacggcccgacggtcgggccgggccggcatgggcccgacccaagtcgggccgtgccgtgcttgggccgggccaaaaaggcgtgccgtgggccgggccttcgggcctcgggccttatggccaactatagtcgagtctaagctaaaaataaattcacatcttactaatcttctcaacaccttaattaagtttcaaccaaaaccgtaaaccatctcctttaatttcatcgcctctgaagcggtgacactctaaaacgcggcatgctgctttccaaaacatcaggttgtgaagaacttcccgtgccattctcgctctttgctgatgaacagcgacgaccagcgatccatctctgaaccatgtggttgatgtgatcgtgcatcctctgatttccaccgtcgatgcacatctcctcgaggcaaatggcgttctccgcgaagaacttgatcagccggactccgatgcagtcgttgtgttcgtccagatgaaactggattccaactcttctcagcgagctccgcaagcaatggaagattcggccgctcaatccatggatgtcaccactgacatcgtccaagtccttcttcgtcgagctgcctcgccggcggcggcgagcgaagcggcgcgcggactcgtcgaggtccgcccgccgccgctcccgcaggaggtcgtgggcgtagacgccgttcttggtggagccgtgcggcaccatgcgggtgaggcggatcgcgaggtcgcggaggttggggcagcagcggagcaggttggcgatggccaccgtggtggacgtcgtcgtcgtccggccgccgctcgccgccgcgtcggcgtggcgcgcggtcaggtcgaggcgctcgacgccgtggagcgggaggaggagcgcgcggcgcgccgccgcgcgccccgcgacggcgatgtgcttgaggtggctcaccttcagcttcagggacttggcgccgcggaagttgtggaggaaaagccagaagttggcgcggaccgtgtcggcggcgtcggcgtccttgtggtggaagtggtcgaggaagtggagctccgcgcgcgccaccaccgtgtcatccggcggcggcgccgccgccggcgagacgagggagaa

SEQ ID NO: 25324 - DNA, 13128 bp, Oryza sativa
ccgccgcacccggcgagatcaagcacgcggagcgtctccaacggctgcgcgtcgaggcacaagcggaactccccttcgctgctgctcgtgacctccccgtcgaacgacggccagtacgcttcgacgacggcggcggcgacgcggagctcctcgacgcggcgcgccgccgggtgggacaccacgccggcgaccacgtcgtgcttcctctcccagtcctccgggtcgcggtgcaggaacgcgtcggccgtcagctgcatgcagatgcgcatgcgctccgtctccacgtgcatggtgagccgcctgacgtggccggcggcggcggcgagcgcggcgtgggcggagcggacgaacgcgtcgcgggcggagaagaattcccgctcctggtcgcggcgaacgtggacggcgaggttgacggcgccggtggagcgccaccgcgacgagaggaggctggtggacgcggcctccttcgccgggacgaagtgcaggacgcgctggagaaggtcgtcggggaggtcggagatacggtcgacggcggcgccggcggccatcgtcggcgtcggcggcggcgatggcatcgaccgatcctatcagcaagaaccaagaaggcgatcgatatttcagatgttgtgatgcgacttagtacggataggatgcggcgagacggagcgaacgggctggaccgagtgctgaagccctacgggccgggttagctgggcctcaaacttcgggcctgtttggtacagctttaactcctaaatataactccaggagttgagtttggagtagtacattttgtgagagagctccatccaactgcactcctagtttggtggagctgaaactgtttagctgagatggagctgtgccaaacagactcttcataatcaaatgctcgtggtgcatgatttgatttgggatctttaaaaaatatatctctcatttttaagtgtcgcataaaaattatcaacaaaatctttttaaaaaatagatctactatatgcatagtcaattttaacttataatgatcaaatttaactttaaatagaacacgtaattcgtggttaaatttattattttcgttttgaattatgtaattatgaaaagacatatcacatattggtctatcttgacattttctttaaaatttttgatgacttttaaatgccgcgtacaaaatgagaggacgttccttcaagtgataaaaatccacttccatttaattttcaattttagatgtcatggttacttcaaattgtttttttaaggtgtcatgattacatcaaattgtttgattcataagagcaataacagtaattattacttcagattcattagtagaatgtgttctttagactaacttcacaactcatatccatcgtttttcgcgtgtatgttttttaaactactaaatagtgcgtcttttgaaaaaaaaaagtttctatcggaatgttgcttttaaaaaatatattaacctagtttttaaggtttttatagctaatacttaactaatcatacgttaatccagcactctgttttacgtgtaaaggggaagtgtttccaacatctaaaaagaacacagcctattaatgaattttaggtgttgggaactactccatcgcgcaaaagaacgacttgttagcgcatgattaatcaagtaatagttatttttcaaagaaaatagattaatatgattctttaaaataactctcatatatatatatatatttatttaaaaatgaatgtttagtactccctccgtcctataatataagggatttcgagttttttgcttatattgtttgacctctcgtcttattgaaaaaatttgtgcaaatataaaaaaaagaaaagttgtgcttaaaatactttggataataaagtaagtcaaaaaaataaataataattccaaaattttttgaataagacgagtagtcaaacagtgcaaacaaaaactcaaaatcccttatattatgagatggagggtagtttggaaagcagtacacggaaaaagagaggttgagttggaaacttcaaaaaagaactcagccatttagatcagtcaaaatacaatctagatatgtttgataagagcaagggtaataatatagccagctgctggttgtatagatctttatacctatctctcagctcacttatatactagttagctcttcactataaacatatggtccacctatctatctcgtaaattttcttggtgattgtgcctaagccggctgtaaacttacggcttgcttctcatctctctcctcttctctctcatccacctcagtattcagccttcttagagctcaatattattcttgctctaatttttcgcacaatctaatactggtactggtactccactaaaaaaatgattacttaagattattttcatgcacgattgcgcatgcaagcatatcatccgaagttgataactgccgccttgttcatcacccagcccttgatctctcgcaccagctcgtcctggatccacaagggccccatggcgagctcgcacctcagctcacggatcaccgccgcgctccggagcaggtacatggccagcgccctctgcaccgtgccgccctggtagtgcaccaggttgatctccctcacccgcctcctcaggcaggccggcgccaccatggcggcgccgctcgtcggcgcggcgaggacgctgtgccggttgtatctgaggaggtgcttgtcatggagctcctcctccttgtggtaacagtatgcgcggtagccgtcgtcgtcgtcgccgtcgtcgagaggctctgggtggaagacgagcgacaacgcctccaggtttggcgcgaggtcgaggagcctgatcagtgcggcgaagatggtgccgtcgtcgtcgtcgtcgtcggggaggcatcctcctaactcgaggcggcggagggtcgacaggtccgggagagtcgcgaacgcggcggcgtcgtggaggccggagccgaggcgagcggacgcgaggtggaggtgctcgacgccggcgaagcggcggaggaacgcgccgagcatggcgagctccgacctcgacgtcacctcgtcgccgcagatgtcgatcttgcagtaggcgaccgtgaccgtctccagagagacgccgtgcccgtgcttcgtggtggtgacgaggaagaagtcgtccggcacttcgccacggtactcgaaggcctggagctccgacggtggcgacgcgtcgtcgtcgccgaggacgacggtgtccaggccgtggcagcaccggagagccagcctgcgtaggcgccggagccccgccacggagagcgcgtgggcctttgcgtagcaggcctcgagcgtcaggtcggcgaggcgcgggcagccggagatgaggcgctgcatgctcctctcgtggtcggactcggtgacgtcggccaggagcagcgtctcgagggacggcagcgcgatggccgccgccggcagagcgagccggacggagccgagcgacagcgaacgcagcgccgcgcaggcgaagagccccctcggcacgctgtactcctgcggctcgaaccgccgcctgtacacggccatgggatccttcttgccgtcgtcggagaggacgtcgtcgtcgtcctcgtcgtcggcgtgatcctcctctccgctgctagggctctcgaagagaatgtcctcgggcggcatcgtcctccaccgtctcggcctcgcatcttcgtcgatcgcggcggcggagcggcggcggagggagtagtcgcggtggcagagcgaggggcggccgaggcggaggtcgagctcgacgccgtcgggggcgggctggttgacggcgtaggcgatccactggtccaccgcgggggagaccctgtgggcgtagccggccatggagacgcggagcgcgcggagggggacggcggcggcgcggcggtggcgggcgaggagggcggcgctgacggcgctggcgaacggcggcggcggcgggttggggttcggcggcgggccccacccggggctgtacccggcgaactcgtcgtggtcgacgacgggggcgtcgggctccacgagggagacggtgtggacggcggcgaacgtgtggcgccaccgcgacgagagcaccgccgcgcgcgccgcctccttcgccgggaggaacgacaggatgtggccgatcacgccgtcgctcagcgagcttagccggtcgccgtcgccgccgcagccgcagccgcagccggcggcggaggtgatggccatctggggttggtcgcgagatcttcgttaccttaattaatttctcgatacgagttgggaacttctaggatttacggtgacctttctcaccaatatacgagtgcccttgttttacgaaaattgaagtacacctctttgtagtttgtactcgaatttctaaaacaaattggacaacctacgaaaattatgtttatttctcacggtctctagcttagggtacaaatttaacatctaccttctgtatccttatatatttccttaattgttacggcctctacgagtatcttgatattcaaatacaaaaggttttttcacataaaaccctaatggtataattttcatatggacaaacatgtatatttctagtgagtgtgtagattttaggcgcctaaagtttcaaaaaatttagtaagttttttcaaccctccgatgacaatccaatgtatatggttcgagggcagctactgtataggatttcattgcaaagtggtagtcacgggataactaaatcccccgacagatttaatatgtatctttttctgactgaggcccacgctgtccacgcgattccaccccaagcagaacccggcttggtattgcgcttcgccagcggcgccgcgccgccgcaactacttcgagcaggagtgctccttcctccggctggccagaaccttactccgcacgcgatacctcgccggcgacgcctgcaactactccgagcaggacttcccccatccagagcaggagaggactttggttgtgatagcaataggagacaaggatcaaggctagggaagggagaagaggagagaagacgtgtggtgcttgatacttgataccttgcagccagccatgctacctgataccttacaggtgcccggtaccaggtctgatacttatgggtaccagccatgataccacaggtactaagcatggtacctactggtaccatgtctgatacctgggtatcagccatgatacctacaagtaccaaagtatgatgataccactaaaatgtcaccgtaataaagaactaaaaatcatgtgtttatcaagagagagttgaataaaaactaataaaggaaatatattccaggaaaaaagccaacatagctgtagaaacacctatagaacatgcagaacccaaaatcaaatgtagaactagataacgtaggagcttggaggtcgcgagcctagatctgggtgtacggatccacaccacaagaggtctcttgtccttgatgacagtgacctcgtcgacaatggccacctcctgaaatgtgatgggcagctccgcctccatcatgtgctaattgggcacctacctcactaacagcttcacgatctcctcctctactccgcccacacctccaccagcagcaatggcggtggcggtgatgtcagcttcctccacgcccgatgcgccatcccacaagacctcgtcgcctccgtgctccatgagggtggtagagagagagagagagagagagagaggagggaaggggaagagatgagaggataaggttgaatagaaagtgtggggagtgagagatatttactggtagtacttatcccgtgtctacggaatactgatgttgagtagtttttctgatacggttctcatcactagataattcatactatattacttatcactcttgaatgattgcacaataaactattctcacttacaaaaaccaacaaaattacatgaaatagacttttgagtcataaaaatatataaaaatctctagaaaaatattcaaacttatataaaaagacaataaaatcagatatatatataacaacaaaattgcagtaacaacaatgaactgaattgcaaattgcatagcactgcagtttcaggcttagcaatatgtagttttaggttcccctagaacctaacaaatcacattctaaacaaattaaaatatagaaattaccaaggtaacggaaggagttaccatggcactaggttttgaatcgtgcatatgtctctgagttactttgaaaggacgtgccatgtgcttcaaactcaataatacattcatcataaaatataaatatatatttacattttttctatatttttcgattatttttctcccaaaatttgaacatatgtaattataatgcaatcgtaatttaattacattgtaacttgtactatgtaactttcatataactttgaacctttagatttgttttaagattcgtgtaaagaaggaaaaaaagtcaaggcatacacacatgtgagaggatttgttcccacaacctccatttcacggaaactactatgttatagagggatttttcaaagttacgtagaagttatactataaatgtatatgtggtccctatatatatacctttttttaaaaaaaaataaggttgaggtgagaaataagtatgattggttgagatgagaaactatctaaacaaattaatcgagtgatgtttgtgactcgttgggatgagtaagtagatgcataagttgttttaaaaaatcaaataaatttattttgctagcttttagtaattagtactcaataatcatatgttaatcatgtttctagttttacgtgcggctaatcattagtttcaaaacacactttagtagctatattttgagatagaggcagtaaataacaatgctcaccaattctttaacatgaactaaaatgtagttaattacacacaagcgtaatgttatgaaagctctcttcataacaaatttggctatatatgtcattttgattatttggtatatccaaaatctatattttgtactacaccaatttaaaacgacattcttttatcactgaagataacaagctagaaaaaaaaaacccgcattttatttgcaacacacaacttatcaagaccttgattaatttcagtcacttgcaagtttgcaataatccatctctcctaatttcatcgccgctcaagcggtaacactctaaagcatcgcatgccactctcaacgatccatctctcaaccctacgattgatgtgatcgcgcatcctctcgttccctccatcgacgcgcatctcctcgaggcaaatggcgttctccgcgaagaacttgatcagcgagacgccaagccagctgcgctcgtcgttccggaactggatcccaacccttgtcaacgagcttcgcaagcaggcgaaggatcggccgctcaatccatggatgtcaccgccggcatcgtccaggctttggttcatgcaggagatctttgtcggcggcggcggcggcggcggcttcggccagcctcgccggcgggcgaggcggtggaccgactcgtcgaggtccgcctgccagcgcctccgcaggacgtcgcggcagtagccgccgttcttggtggaatccggcggcaccgtgctgaggcggagcacgaggtcgcggaggttggggcagcagcggagcaggttggcgatggccaccgtggacgtctcgctcgccgggtcgtgcagcgcggcgacgtcgaggcgctcgacgccatggagcggcgggaggaggatgcctttgccgttgccggtgacggcgatcgccttgaggtaggtcaccttcagcttgagggacttgacgccgcggaagttgtggaggaagcgccagaagcgcgcgcggagcacggcggtggtgtcgcggtagtggtgaggcccgtcgtcgtggaggaagtgcaggtccgcgcgttccatgtccgccgccggcgagatgagcgagaaccgccggggcagccccgtgtacttgaacgatcggagcctcggcgcgtcgatctccatggcgccctcgcagtcgctggcgtcgtcgtcgccgttgtggtggctcccgtggcccctgcacttggccagcacgagcgcggtggccgcggggaagcggaggcgggcgcagcagccgtcttctttcgtcccggcgaggaagacggactcgaggtgcacggtggcgagcgccggcgcggagtcgacgacgccctgcaggtcctcgacctgcacgacgcacagccgcagccgcagcgtcgtcagccgcgggagcgccgcgccggcggggagggagacgccgccgcacccggtgaggtcgagcacgcggagcgtctccgtcgacggctgggtgccgccgctgccgccgagggagaggtggaactccccttcttccatctccgtgacctccctgtcggacgacggcccgtcggcggacctgacggcggcgacgcggagctcctcgacgcggcgcgccgccgggtgggacacgacgccggcgaccacgtcgtgcctcctcccccagtcctccgcgtcgcggtgcaggaacgcgtcggccgtcagctgcacggggaggcgctccgtctccacgtgcatggtgagcctcctgacgtggccgccggcggcggcggcgagcgcggcgtgggcggagcggacgaacgcgtcgcggagggagaagaagtcgtcgcggcggcggacgaggacggcgaggttgacggcgccggtggagcgccagagcgagcgccagcgggaggagaggaggccggtggacgcggcctccctcgccggcgcgaagtggaggatgcgctggatgaggtcgtcggggagatcggagatgcggttcgcccctgcacgcaccgactgtccgcgatggtggcgaggggacccggccggttcgagctcgtcggcgcctcggcggtgttcgcgatgatgcccgtggcgtccatgaagcggtcgccgaggcgcacgaaccacgtgtagttggggctcttcttgtccaccatcgggcacggcacggcatggacgctggcggcagaggcgcggcaggccaggcacgtccacatccccgtccacctcgtcgaactccacggtgacgcgctcgtggagcacggggaggtgcagcatgagcgcgagcatggtgctggccgctggtggacgacatgaacacgtaggacagcacgccgaggtcgcacgccacgtcgactatgggcgcggtgaacatgtcgagcacgagtgcagcgacggcgtccctgacgtgtggcgcgtgcagctagctggatgtaccgcgcgatgaactcctccacgctgagctgatcttaagatacatgattccaaactagtaaactaaactcatgatctgatcgatcagtaaacaggctgctgctaaagcgatatacgagtagctagaaaagaattaatgaagtgaatggaaagatgattgacctgtggcttgagggagagaagaggcgtgccgtgggccgtggccatccttaagcagtaggtcgccggcgaaagctttgcggcggtggtagtagttttgtcgacacggaacgcgagcttgccggcggagtcgtagacggagaagccatcggtgccctggaagcctatgctggacctcttccacaccgtgtacaccaccggctgatctgtagcggcggccgcctgacgacgtgcacggctgctcccgccgccatgtattgatctgtatcctcctcacgctgctaattgatgaggctaactttgagagtgagggagcgttagctagattattattagcttaggtaggggaaacaaagcaaagatttggttgggccaattagtaagcaaaatgatgaaggtatggacaaatagtgcagggcacgtaggaattaggattaggattgggattggcttaattagcgtgagggagctggcatgcattcatcttctactattctactctacttatccactgcgtgcttgcccgccgccgccgctgctccgcgcgcgctgccccttgcctgcttcgcccgccgccccgcccgcctgcagtctcgctgaagtagagaagagatcagggagacgaaaggaaagagaagaagaaaagagagagaagagaagagaagggaggacaatgacatgtagggcctactgtatgccacatcagcgaaaccgggaaaaattaggtcaatactgcctcgggaccttttgtgcacggtttatgatagttgaggggtagagattttcggtattgtggattaaggacctcagacaaactcgacgtaaagttgagggacgtcaggtgaccttattccaaacaaatttgatttccaggggttttaagacgacgtagctagttcaagttctttaatttggtcgtaaaagaaaagtacattaatttgcagtttttttccaagtcaccgtacgagagttgtaagaggaaatgtaattcaaaggcaatcatttattggactagatagacacccatgctacaggaaatacaattcaaaggcaatcatttattattatctagcccttgatagacactcatgctacataaaaggatactattgttgggctacatcaaaaggatactatttattgttgagagtggtggtggtggaagtataacatagatccaagaggagaagtcaggccgatgtgtccctttggtagtggcctaggtagaggaggcagaattgacacaacgtacgtagatgctcagggtagggagggtcctagtgacgtctacttggaggagtcgggaaggagtggaaagggatgcgatgaccgacaaggtagatacctgcaagaattgcagaatcaatgtctaggtggctaaggagacggtggaggaagttgaggacatcggcaatgtaaatccaagacagttggcaacccccacgaggggaaaatggaaagttactggcgatgattcctcatcagacgattcctcaacaagtaagatgaagtgtttggggacaactcagtagctaaaattttgtaacaagacctaaacacaaagcaaacctttttccatatatatccaaaccatccatgagcggaatccaatttgagagtgaaattttgcagccaaaaccaaaccaaaccaaatctttctccatctatatccaaaccgcttaaatccattaggtgcttcaacccactcaaagtgttaccacattgaaatcttgtctattaaatccatttgtcgatgtgttaatgttgtgttgtgtgtaaggagatagtgacatctagagtctagaggtggtttcagaggagaaagataaagtaggtggtgacgtggtttcggaggagaaagagaagggtatgctgaagtttacaaagcaatacaaatctctatctctatctctactattataaaaattgaagatgtttttgccggtggcttggtaagtcgtcgtgtccaaatccgtctcgcacattatcactgtcaatttaactatttatgtgtcccacatgtatgagctttaaacgttggattttccctaagaaaatttgcttgttcggatcagtgacttcagccgattgtatttcgtgctgtgcattgtcacgaaccaactgccaccgcgaagttgtcatcttgccgatacgatctgttcagcaacacggtttgggacctgttgtcacgcacctatatcaacaccaaccagcagcagtcagttgtgttgccgtgtgccgaggccggccagcagcacgacataccattgtcgatttttctctacacgcatacactgtatcgagaagaattcctaccgtgttcatcagaaactcaatccaatacggtctgccgggtatacgtgttccagaaagattaaaaaaaagatcaggatatcaaagccgagatctattactacccacatatcgaaaatccacacgtgcaacaagacgatcagcaacagtagccgatcgatcacggttgccaagagaaatacaaaaacctaatcagagaaatattcaatcaagctactgcacacatatctctctatctctatctctttctctactattataaaaaataaagatgtttttgctggtattttagtacggcatctgcgtatgagtcggttttaagtccattcgcttttgaaaatacaaatctgtatttgagccagtttctaagttcgttcgcttttagaaatacagaagaaattgtataagaaatctctttaaaaactcacatactaacttgagacgatcggacacctaattgcagcttacgattttctaacaaaatatatatccaagcgaatttaacacagtgaatttcatcttaactcgacataataataataagattaaaatagttttcacctgtttaacattacttgccccgtttaaaatttcatcttaaagcacggacattttttctagataaaatcagaaaaggtcacaccatttaacattacttgccccttttttctattcgatactttttaccttttgcagtaattagacttcataatcggcgttaacatattgtattattattattatagcattatggacgtgttgcccgcagcaaatcaaatgaagaagtttatcatataacacttgtttgacccaaaaacagtagaggagaccactatggctgtacggcatattaattttcgggaaatttattaacgtacagaatcaaaaggttataataagtcaaatccataatcaaagaaatagtgatttgcatctctaagcctcataaaacaaatccagtattgagaccaaactttatagggcctgtctatagatcatttgacagaaaaccccctcacagatcttagaaattttagaccattcgattgctttaagattcgtgtagacaaccaaaccctaaaaatcctctctcctctcccgattcctcacgccgccgctccttagcgcttcccccgcctccgccgccaccgctgccccagcgcgccgccgcccggcctcgccggctggccgaaaggtgtcaacggcgccgatgaggcccccctccccctcctctcctttgcctcaagccgacggcggcaagctgtccgtcgtcttccctgtcgccggcggcagggcgccaccaccggccgccttcaactaccactctttccgctttgcccccgccgtctacaccggcccgctgccgccctccagccccgttacactggc

SEQ ID NO: 25325 - DNA, 3450 bp, Oryza sativa
caccccaccccggaccctaaataagaatagtcaactaaataagaattgtggcagcaaatagacaaacccatatattttctaaacaatggattaaaatttcggcctacatcgacaaggacgaaaacagccaaagacaaaccctctttcgaacaaaagaaagaaatcaaactggacaagatcaaattaatcgatgcatggttgcgcaaagcggcatcatatcaaccgatgttgacaatggccgccttgttcatcacccagccctcgagctcccgtgccagctcgtcctggatccacaagggccccatggcgagctcgcacccgagctcaccgatcgccgccgcgctccggagcaggtacatggccagcgtcctctgcgccgcgccgccctggtagtgcaccaggttgatctccctcacccgcctcctcaggcaggccggcgccatggcgccgccgccgctcgtcggcgcggctaggacgctgtgccggttgtagctgaggaggtgcttgtcgtagagctcctcctctttgtagtacgtgatatgcagcatggcgtcgtcgccgccgtcgagaggctccgggtggaagacgagcgacagcgtctccaggttcggggcgcgctcgaggatcatggtcagcgcggcgtagatggcgtcgtcgtcgtcgttggggaggtatcctcttagctcgaggtgggagagggctgaaaggtcgggagcgtcgcgaacgcggcggcgtcgtcgaggccggagccgaggcgggcggactcgaggtggaggtgcttcgcgccggcgaacaggcggaggaacgcgctgagcttggcgagctccgacgacgacgtgacctcctcgccgcagatgtctatcttgcagtaggcgacggtcgtcagcgaagcgccgccgtggatggtgaggaaggtgtcgtccggcacggagcccctgtactcgaacgcttggaggcgcggcggccccggcgaggcgtcgacggcgacggtgcgcagggcgtggcagcagcggagggccagcctgcggaggccggcgacggtggtgagcgcggtcaccgtggcgcaggcctcgagcgtcaggtcggcgaggcgcgggcagccggagatgaggcgctgcacgtcgctcccggcgtcggagacgcgggcgaggagcagcgtctcgagggacggcagggcgatggccgccggcggcgcgagcaggcagtggccgagcgacagcgagcgcagcgccgcgcaggagaagagcccgctcgggacggcgtgcaccgccggggtgtagtcgtatcccctcgtggacttctcgtcggaggagatgacgtcttcgtcgtcgtcgtcgtcgtcatcctcatcacagccctgcggactacagctccgacgcggcggcggcggcgacagcaacggcgagcgcgggatatacatatacggtggactcagacccagattggcatcttcgatggacgcatatcgcacgggggacctcgacctcgaccgccaccgccgccgccgtttgcggctcgcatcttcgtcgtcgtcgtcatcgtcggtgtcctggtctgcgtgatccgcgctcgcgccgcggcggcggcggagagagtaggccttgtcgcagagcggctcgcggtggaggcggaggtcgaggtcgaggccaacggcggggtcggcctggttgacggcgtacgcgatccactgatccaccagggaggcgtcacttctgcagtacccgacggtggagacgtggagggcgcgcaggggcgggacggcggcgcggcggtggcgggcgaggagggcggcgctgacgacgttggtgaagggcggcggctggttggggtcgggcggcgggccccacccggggctgtacctggcgagctcgtagtggtcgacgacgggggggtcgggctccacgagggagacggtgtggacggcggcgaacgtgtggcgccaccgcgacgagagcaccgccgcgcgcgccgcctccttcgccgggaggaacgacaggatgtggccgatcacgccgtcgctcagcgcgctcagccggtcgccgccgccgccggaggtgggcatcgtctggggttggtccagatccatcttgacgcggacggtttcgtttgatggcgagatatttcaggatttttcgggggatgaaccgagacggtttgttgttaggtcaaagaaaaaaaagaaaaagagggacatatactcggattcggagtgtgctccacgatttaaaaaagaaagaccaacaccaggtgaaatcgcagtaacagaatccgagacacgaacacgatgaacgccaccgttgcatcaccgtcggagccagccgccaccgtcaccgtcgcatcgctggacgagctccgcgaggtggccgagcatgatccccgcgcgtcggaggaggacgggggcctgcgcgtggcggtcaccggcgtccccgtcagccaggcggaggagctgcacgcgctcgtccgcgaccatgtcgaggcgaagctctggagcgtcgtcggcgaggtcgccgccatggcggcgctcaggtccgcggccgacggcgccgcccgcctcgtggggctgagccgcgcgctggacgccgtcgcggccggacacggaggacggagccccggcgccggccacggtgccccgcgtcacgctgctgagggagcaattgttgccattgacctcctcccatcggcgtcaatccactatcgcgcgaagccacgtcatcagcctccctcactcattctcctctatcgccaacgtgcacatgcagatctcaattgaacgtcttccttaccagcagccgtaattggaaaaaaaaatagaactgacacgtgggtcctacgtttataggtattttggtctatatgatgacgaaaaatataacgatgataatatgatttgtagatattcggatgacaagtgtacaaatagatgaattgtagtaacatttatctgaatcagcatatttgcaataacatggatccaattaaacaaaaattgggttacacattacgttacgatgaattggagtaatatctggcttcccaacttgagacctcgaggatgtggataacaatgggaggatcctcgaacgggatagtcatccccaacagggcagcgatccgtgccctcgtcttctccgccgtccgccggaagtaggccatcgagtactccagcgactccggcgacgtccatctgtcgccggagtaccgatagtagctcagcgcctccgcctgcctccctatgtccaccgcctcgacgacagcaacgacgtacttgcgcgggaggaacggcggcggccgttgggtggacacgtcgcgggccagctccgtcagcagcgtgatgcggggccccgtggccggcaccgggacgccgtcctccgtgtccctcacgacggcgtccagcgcgcggctcagcttccacgaagcggtcggcgccgtcagcagcggacctgagcgccg

SEQ ID NO: 25326 - DNA, 18640 bp, Oryza sativa
  unsure (1)..(18640): unsure at all n locations
aagaaagaaattgcactttttgtggctggtactgaattccgccggcctaagtgtgtacatgccccatctaacaaaagttgggttgtacatgcatgtctggaaagcccaaatcctggttagatagtctggcaaaaacaactgggcctatactcgttatcccgttacagaatagctagtgttaagcctgacctaccaaacaatggcccaactcacaagagcaattcttaggtagacgacgttgcttctagtagagtgtaaaatggccgagttctttttctcaaatcgagtttgtcataagtaaaattgtaaccatactcataatatattatctccgttccacattgttgtaagtagtttacaagttttagttgtgtcctaactcaaatttctttattttttattaaggttttgttcttttctaattcctcattttgaatttttatttttacgtttttcaaactcctaaacaatgtattcttgcaaaaagtagtgtgtatatgccctatcaacaccaaatacctagttgtttatcttcggtgaacactaattaacaaaggcgagaaaatgaaagaagcaggtagtaggtgttagatgggcaaagattggattttgattctcatcaaccacaaggccaacgtcttccatggaattttcacaatttaatctaattaacctgtcaggaataacctctctaataaattaacttcactgaacatcccatgctactcatttaagcagtaaaaaaaaggaaatacatatttgagcgaactaattaaccactagtgcataaccaaatcagtgagaactcccaaatgcgacaagaggatttggtcaggtcagcaatttgccgcataaacaaaacacacggtttcagagtgcgtatgcaagcggttgtcagagtcagagtcgtcgttggccatgaccaaactaaactggttttcagactttcagtttagttttgtgtctaagtactgtggcacacgcccttttcggtaggtgcatgcgtgagcattttcttcacaagaaccgaaataaatccgattatattaggtttagtttgtgtgataactacttaggctgctgcatctgatagccaaccaaagattcttgcagggcttacagccatctgccttttggtttctatgacaatgagacttcacctgaacaatacaaggaaatgattattcagatcaggtttcatgatttcatcagtagcttcatctggtatcctatgcatgcaaaacttttctttttggaccaaacattcagttgcaagatttggttgaattctcattctctgaagaacttccaaattgagcagaagcagctctgcagggcattttcaggtgatctcatgaacatgatttgccttccacttgtcacaagactaaatatcagtggaacttcaccaaactctgcatcagctgtcagaacttacaggtgaaaacccgttgtgccaggacgcaaagatatgcagcgaaaagaggagaaaatcaaagctgccaagattgaaatctttgcccttctacagccgcaacatctctgaatttctgacctgcaacacggagaaagctctcttcttctgctccgctgctgtcacgaaccagctggaaccaacactcgtagtgatagtgcgtgtgtttttagaagattgttcaagtcaggcatgtgtgtgaataactaatgctctcctaggcctaggtacagatcgccgcatcttaccaagattgaattttaccacgtgattgatgaaaacttacaaaattcaaacaaacaatttcatcgagtgttcattattgcattaattttatacgtttagaagcactttggatggttacaataatagcacatggaccaactgcatatttggtcttccattttctgaacttcaattaccattcttttcaagagttcaaacatcatttcttttctttttcttatatactatctctatcaaaagcaaaaccctagggaaaaaaaggtaattttaacattcatgagaaggtattaggaggtatcatattttttagtataaaacttagtaccttcaggtattaggtaccttgagaactttgttgagaaatcacacttgtagtagctagcttgttaaacaacagttcttggtcaaactctcctccagttgaaatttgaagtggatttgtccatgcataagtgcacatgtactactaccaaatcagtttgatcaactcaaaattggtttggtaaattgattggggcattgcaaatcaatcattcacctactattctatctcttcagtatatgctccataccaaacataacccctagttggaaaattttactaccagctaactgcaccctacttaaccctgaatatcataggtcaaaaagaacaaaaacaaaatatacaagtcattatcttgagagggaaaccagagtgatggtcaacattgctatcatactaggcctagcagctcagatcctaaggtcaagaaatcttataattaatattgacatgccccaaattcagactaaaagaagaaacccaattgatctgatactgactcaatgactcaggcagtttacaagaaaggaatccaatcaaagcagtaggagggtgtgagaaatttctctcctttttcctcaccaaccaccaatatggctgcatggaatggatgatggatgtatgcatgcatgcaaagatgaaaccaaatcaaaattgagtcaaaactcttcagatttggacagagatctgccatttcaggggtggtagtgccacatgcctctatgtagctacttggacccaagaattgaaggcttcttcacaaatatggacaacttttaacactgcctggtttttcacctaacattcttccaacttttctctctctctctctctctctctctctctctctcttcttggtgtcatgtggaaacaagatgacctgtgaatcagtgaatggtaaaataattgggaactaattatgcagaatttatatttttatcctccacaacgacaatgagctatggcactgtaaatagttataacactcctgctgcatgaattatacatcttgaaaattctcaagacaggaaactaggacttcttccatttcctatggtgttatcttgaaacaaaattttctttttggaaaaaaacagaaaaagaattggaaacagtcctgtagacaatctgttagagttggcttggcttctttggaacatgttgggagcacactttgaacagaacatacaggacaaacctttgatctttccttatcatgtcaacaagggacaaaacatttcaaccagcaagtcttttcacaagcatgctgggacgcgtttacgactagatgacggctaagccgaatcctctttgaaagcttcaggtttcagagttcagagttcagacaccaaaacatgttcttacagcacaaattaatccagaagaatgttgcaattcagacggagaaagcttctgatttcagaaggaacggatatggggagaaaaaaaataaaggtcaccgaccacactttacagatatgagatatcgatcgaataagctgaagaacaaactgaagatgatgcataactgaaaacatgacctctgaatccgacagcgacatcaacaaatttgcttcgtcagccgtgttggcgacaggcgtcaaacgatcgatcgtatgcgcccatggtttgcgacaagtgggtattctctgaaactgtgatcgatcaagctgttttactgtcgagcaaaatcagcagtagattacagtacgttagcatcgtcgtcagtgacagcatgcttatctctttcgtgtgaattcaattgcctcttgcggtttttgtacaagtgattgctgttgtgttcttgactcgagcgttacgtcagcgaccttttgtgatgttgttaccagggtttacaactttggtatcaggcgaccgaattcccggaacgaaattatttgaaaattgaataaattttgactgaatttaataatttcttttctaaattccacaaaagcatgaaattttcgggaacaatagtttcgtgccggtgggtccaaaatttcggaaattttgaactgaaatctcaaacacatgctgttactgtatttgtgggagatgtcctaagcagaatgacccggggggggggggggtttgaagaatggacacataaaaactactcccttcatttcaaattgatctacatatttttttttattcttaaatgatctacatatttgtgtttattcattaagtctattcgttatttgtgcattggagtaaatggacattgatgcatgcacacaagtatttataacccatatgcaatatcttgatttgctattggctaagaaatagtgggaatggtgcatgtatcgagtttgttgctataataaatatagtatgagagagttattagtttttttttgtcttggtgtacctatgaaatatgtagatcaatttggaatggagggagtatttcacaacaaaagagagtttgtggtttggatttggaatttgggtgcaggtgatttatagactacggttcagatgttacacaaaaaattatggtttcatcaactacttgttggctttgtccatcctgaaataagtttatttctggttctatgctaagtcaaccatcttaagtttgaccaatccaatggaaaaataaaaataattgatatcagatgagcatcattaaatctgttatgaaattatttttatagtctacttattaggcactataaatattaataatcttctctttttagttaaatttaggatggttttaattagggaaaaactataaatgtatttattttgggattgagagaatattaattttagcctttttatgcctttaaaaatggcacagcagataccacaaattatcttttggtacttctctagtgccggtaatacaccccgttcttttggttgtttagtgttcaaataactaggttaatttgaaaaacttaagatagcatgttagttttaaacctagtttttgtgtttctcagctaacacaatgaacttatttctgtttggctagctagatatagggtgtaggatagtacagtgcaggacagagacggttggtgatctttgtcattatcctttatatattctggcaagcctgatcaagagcctagttgtatttggaaaacaatacaggtgtgcgaaattaaaaaatatatatatcaaatgtccaatttgttccttggatcattatctgccattactgctgttccaaagcttttaatttgtttcatatgcaacctgtctattaaactaagctcttgcatgacgtagaccatcaactgttgatatcattttcactgagttttttaaagacgatatatatcttctaacttcacatttttgttaatttgttaacgtgccgtggtacatggaataagaaggggaaaaaaacagtggtacaaaatattagaagaattaccaacacacatcccagttgtaatctggctagtaaagacacggaatttattttttttttcgcaactcaaattgagaagtccatgattgggtatgcagaagtattttctaatttaagtttgtaaattccactaaagtgtgaagtcaggaaaaagataaaaggctgtgccgaaaatgcgggcatctatttggagctgaagcattatatctgtttgcccatatctgcttaatttaccccaaattttacttaagaaatcagagaggaaaggagacttacttcagtttgtcgtcctatgaatgatgcaacatagcacttgtcaagcttctcctctttaatcttcttgtctcaaacttttgaaacatatagtggcttagtgggcaggcatgaaaaagctctgcttggcatagacctaatatggcagcagtttttacaacaattttcgggattttctgtaataaacaaaagtaggctatgatgtatccgatgattttgatatttttgttcatatctaatttgatgcagacttctgtttgtatcattttcattgaatttctttttgtgaagaaccgacactcaaatttttttagataatggaatagaatgacactcaaatgaataatttgtttgttactctccaattaaaaaaaatttgctggtttcaacatttctgaaaatgaataactttgtggacatatataacaccggaagaaatactggcgtgtcctgacgtttatcatagtcaaattgacaaaaattgaacagagaaatatctctttctaacgaatttgaccatgaaaaggcccaaaggtgggaataatattttagaaagtgaggtttctgatctgaaccgtccaatctaccgacatgaaaatgaaattcctcttggaactaatgaaaatgaaattcctcttggaactaatgaatacaattagaaccatccatttccatacccacatttccaaaataattttagcacggaaattttttgccgtcctggatctttatatattttccacgaattattcgtggtctcatcaagtggatccatacatttccacttcaaaaagaaacaaaatgttgacatacacatttaatttacaactacatgatcaacctttgacatctcgtcatgtttcttcctccttttttanccaaagttcgttatgacttatatatgtgaaataacttctgcaaagcaaaaggttccacttctctttgtcgtcctatgatgcaatatctctgaaacttccgtactacttccaaagttcaatctccaatgccccagccttattataaaaaaagaagtttggtgtattgatttattttaatcagagcttgtaaattcatatcatacagttgcaaccggtgccaaaatggatttgtagttttattaagcatattatgatatattttgtcagtgacaaaactaacatacatgtttgacgaaagcaaaatctaggaaggcgacacacaggtgcctttgatgtgtttatttctacctactggataccttgtttgattcgttagattactgtaatttggcagttatactgtcactacacatagaacacaccatgatgaacaagttgacagaataatgggcaggcgatcaaaaggtgcatatctagctttgtaacatctgtatgttatcaatatataactactgtataatgtcctaatcaggcaggtgatgactaatgacattgacataatcctctatttgatcagttaattaacaaggagcaagtagatgagttaaaagacatgtatataaaacaaaagagctcaacatctcactgatccgacccagctccagctgcaaagaaataatgagttactgcaacgatcagctcgatagaattagcctcaaaacgacgtaggaccaaatttaattaatattctgaacataattaaatcgcagttacttgttcctaacaaaaagatagagaagaagaaaggtacgtagcttccattctcagtgacctctataaatctctcaaaagattgaaccaagtatcttatataaggcatcaaaattgacgccacggggacgtttcccaagccactaatcgggatgatttttatgaaaaaaagctatatatataaaagttccttcaaaagtttaaataagtttatttttaagtttattaaggttaatacttaattaattataatctaatttagtgttttctctcgggtaaggaaaccgactaattggttgaaatggtgaaatggacgcaaccaagattgagattaggggagaatcgacgtccgagatcgtttgggcatcccatttagtttccccttaaaacaagaataacgactggctaccagcaagcactaattaactggtgagcagctatcagttttatttttctaaatggattgatcatgtgattaattaagtgtatcatagaaaggtgatttttttttgacgaaagtgattaaagttttttttaaggaaagaaggtatctctatctaccttatagttagtagtaattcaaatttagttagggtattattaattttttccaaaccttaatatttgctagacaatatatacttctacagaatgtggaataagttcatttttagcttctcttattcgtcctaaaacaagttcaattttgagtaatcattgtattgtagttggtaaatgtaggatcgaattacaagaactaagccaaccagaggggggtgaatggttggtatacccaaaaacctatacccaaaaaccgaaaacttttagcggaaataaaagttaccctcgaaatcgacggaagtcggtctgaccgagattgatctgccggtctgaccgagtggatgccgccggtctgaccggtgttgaatctccggtctgattgccgaagtcgcctgccgcacctgccgctgcagccggtctgaccgcctcgctcccgccggtctgaccgccgcaatgccgccggtctgaccaccggtgagttgccggttagaccgccgaaacccggtgaaacacaaatcgaagaactcttaaagtggatgacgactttattacttctctctgtgtttacaaagtgcaacaacagcactccttacaaaaatttcgactaaactcgaaaccctaaaccaaaactcaactctattgctctctaaagcgatacaggaagcctcacgctccctctctatttataccacaaaaacccctactcaaaataggtgtagaactcttatacacaataggactccatccttcagtttccatacgttttacaatttccaaacgtgcagcaaacaaccggccgcaccagaaatccaaaacggattcgctcccaagctgacgtccacgcgtgaccgtctccgactcgctgccagctgggcccttgcttctcctgggccgacttggcatgccgccaacagccaccgaagcccaccgaggcgctctcctgctgctcggccaaccaatcatgcacacatacatgcttcaccatgcatgtatcgatcacacatacatgtacagcaacgtacatgtatgcatacctgcacgctacagtacctcgtgtactgtagcaccatatactactccaactttacaattcccttcgcaaacactggcacttgcacgcacacctcgtgaagcccgttgcaaagatctctcccacacgatgtccatccaccgtatgccatcttgtatccaacttcgtcacccggtatactttaccgtctggacctcaactccttcctgagtttagtcccgatccccaccgttgaccgaacttgacctccaagaatccagactctactcaccttctcacatggtatccagaccgcaatagacctctgctcctccctgagcatagtcccggtcttcaccattgaccaaggctgacctcaagtcacctgcacacaattagacaaaacaaccgtttctgggcacagatatcacaacctgacccacattagtcacacgcactcacaccaacattcacacaaactctcaaaccaattctttgattaaatcatttgcatagccaattgttcatcacaaatattaatcatgacaatgatttcacagtaaaagtaggagataaatacattaagagtatataaaggagagaataattgtatttggatttgataaagtgagggtattctaatccttttattttatattgacatgtatagaatgtgtgaaaaataaatttattttgggacgaaggtgtaactttctttttggatggagtaagtaattaagtgaccactgacccaacaatgattaagtaagctatcaatacatgtgccacttaccctgcttagagcaggtacagtagcagactatattagtcagctataagcatattttaatgagataaaagatgagagagatgagtagcgggcaacagatctgtagccagctgtaccacaaactctaagacgtaatgtgtgtatgatatgtgggaccatatactaatagtatagtaagcaattattatatgaattggcttttagattgactatagatgaattaaagctagtagtaggctatactattaaacttgctctattattgacaaaagtatcattggcactgttcccgatgcgtaattaaccccttaaactaatctctacccgctttacctaattaacgaccgtacgtacgaaacgctagtcagctgagagaccgttgacgacacgtgcgaaacgtgcgtcaaattaaccggatagcagtgtgaaatggtgaaatttgtagtagttaattactagtatactcccaaagagaaaatcaagctaggctagcaagcttgtggacttcttttggaattagtagctaatctcaatcctgcagccgtacgatagtgagataatgaagtgacgggctcatttccaggtgtatactccctctgtaccaaaatataatagatatattttaggtgatatattttaggtggatgtaacatgtactagacatattttaggtggatgtaacatgtactagtcctataaatttagacaggaacacgtcttagtacttaatgaatctggacagactcctgtacagattcatagtactactaggatgtgttacattacatcatctaaaatcacttatattttaggatggatggataatcaatcatctcattagtcagccctagctagttgattaatgaaattaagctcgatggctagtcaagctttttcacacgcaaggtttagctagagatgaagatcatatccttgtaggggacgacacaccaataagtcatctcaattgaccttaatttgtgtagttatctatagctttgcatattataaatatgagctacagagaataacagatgacgtgcatgcttcttctagatgttataaaccactacaattcaggacactttaaaacagattattaactacattattgtaatagattatctacacgattataagaataaattaaatacatgaataaataaactaaacaaatagtttagaacaagggacccgaaatattttatgagaaaacatactatttttatagatgaggggaaaataatcggttacaataatccaatgaagtacatgataaaagggcatgcatggagtcccggtagatggattgttgtatttgttaattatctattatttctttttcaattaatagaggtatggatattttttaaattcaacattaataaatgaaagttgtaataattctgaaattaaatagtaaaaaatattaagctgtacccatcaacctagctactcttatgatttcttataattcagctgcaatttttttttaaaaaaacaattagtatattataaattgtgtaactcttcttttagtctaaaccgtcatgatttggtccatttggatggaaggccaaacatatgcactgtttatttttctgaataactcgagtttcttgaaatgttcgatttacatagatataaataagaacatttctcatacaaatgtaacagctctaatatatatttcgagccattatataccgttacaactttaaccaaaaccacagtaaaaaaaaaatgaagatctttttcttctcagagtaccatgtgcaaaatttggagccctcaagagactaagcacatgtaggtttgtttttattccgttgtaatataataataactggacgaacttttgtgtattcaatctaaaaactcaaagccaagtattagtgactacattaagtaaattaaggatagattgatcatgatgatatttaatttgtttagatcacacactagtaaaaaatgattttcctgtacgggacccacattagattgcagacgaactataagtggtcacatctgtaaaaatcgtgctctattttcgcatgcgactctttaaaatgaccacacagaaaaatcaattttcgcagacgagcctcttaacagagcctattttcgcgtgcggacctgttaagtgatcagcatgcaaaaatagcccacccacctttttagctcctgatgccactagatctcctcccatcctcccactcggccactcccactccctctccctctccctctcatcctcccatctctcctcctactcctcccatctccctctcactctccagccctctccctcctccctctccccctctacccactcccggcgatggtggcagcctcggctagggcggcggtggcggcagcatcggtgagagcggtggcggcattgatggtggcggcatcggctagggtggtggcggcggagcggatccgtcgtctgccaccgtggggagggcggatctgtcaccggccaccgcggggagggcaggtccgtcgcctgccactacgggaagggcggatccgtcaccggtcaccgcgccgcgggaagggcagatctgtcgctggcgaccgtggggacgatggcgcgggcctcaggcagggcggcgatgacgacggcggtggcagcagtggtctcccagcctcgggcgtttggatccgtcgtgggcgactgcggggatgacggcggcgggcctcgtgctggctggcaacggcggcggtagttggattagggttccagccttccagggcgtcttttgattttcttttttttgattttttattttctcgtgcacgtgattttcgtgtgcgggtgtgtcaactgcacgaaaaaaattggattttctcagacactttgtttcagacgggtggaagatccacacctgaaaatcgctttcggctgcacggaaaaatcgttatcgtactagtgataatgagatcatcgcaacatgaagctcgttgctgtcgcaccgaaattcacgcttcgattcccatagttgagttggaattaatatgagtcgtcgttctggtacgacgacattaaacgaattctgaactttgattccttgattcgtgtatatatatatgcatatataaattgggaaacgaccatcaccgattgatttgtggactgaaagtaaactcatgcatgaattaattgtatgatatatcatagctccattagcagcaactaattaatattcgatagatccgtctattaaaaataaataaccatttttatacacaacaattattattcgacgtgcttgattcttactacttgactatatatatatatatatatatataggtatagctaatctttgcctgttggaggtcaacatattcggtttccgttgagtagcaagctagttttattttttctttatgaaagaaaacaagtcaggagtcgtagcataccaatccaggaatccatcaatcgttcaatatatactttaaatattaatcaaggcaattaattaactaaccgtgattaaccttttctagatttaacatgaggccatccatatatatacaaatcatccagtttgaagactggcgcaacactccaaatctacatgtttttgaccaactttctctttgacatggataaagtcgatacaaattttcctcgcaattccgatgtcgacggctttgtggcaatatgcaccaccatgcttacacgcaagggagatcgaggatggctcaaggaagaacgtacaatatttgctgttaatttgatatccaaaatgtcaattatattgtaatatattaatatcatgcatgcgtctaatttaaattgtgagatttagtataagccatatatgttcttttgttaagtaggcaactatatattatctacctataagatttcatgaattcttgtatgccgtcgtcatcgttgctgctgttaattatattgttgcagctactaatgcgtgttttagatgtcgttgtactggctcgttatacacaataattggacagctcgattacttttttttcttcgaaagttgacaagagaaagtatcacctgtctcttgaaataattggatggctagctagtacaataattgtacatgcatgcggctagttttaatttggtacgtacgtacgtacacctccagcatatataacaataggtccacttaacaaattcaagttttgtcaaaacaaatgaacaatatagagtgaaaagctgtactccagataatttttaacgtgtcctttatggcgcccgttactgttactgcatctattttatattagtataaaatatagtaatattttttagtttgaccaattttacagaaaaatatagtaatattttcaacacaaaataaatatactttcaatatatatttaatgttatatttaatcatactaatttaattggtttggtagatgttgctaatttttctataaatttggttaaaactaaagaagtttgattagaaaaaaataaaagcgacttataatatgaaacggagtagtagtattttactaccagtgttatcgccaataaatatgatctatgccactagtttatgatttctcctaccagtaagaacaattaacctccttaattctattatctatagttgagtgaggtagtaatacaaattgacaaggtccactagatatgagaaaaaaagaagattataattctactaccagaaaaaaaaacacaagaaaaaattgtcttaatatgtgcttcatcatttgcatcacatcaatggcgaaaaacaacatataacaatattaattgatttaaaatttattactaactggcaaccgcataataagtaacatatagaaacattaatataaaacctcagtaaactaaaagtgatcttatcacaaaattataggtaaaatagcttgattttttaatacaaaacaaacatatcctggtttatattaaaatttaaaggtgaaagtaaattggattgattatattctgttcattgaacaaagctataatgttaatatacagtactagaaaatgatttttccgtgcggtcgaaaaggggttttcgcttgcggatctctcatatgtctgcaccgtagggtatgtaaaaatccgattttttcgtgcgggtgcttatgccgtgctcctcgtggtcatcatcgccgctcccgctgccgccgctcttgagcctgccttcgccgcggccggctcccgagcccgccatcgctcccagtcgtgttgccgccacccacagcaggatctaggcgggagaggggcgccacctccagatccaggtgagcgaggggcgccgcagccggggagggtgaggccgggctgccgccgcccgccgccggggaagcacgaggccgcgctgccgccacccgtgagtgaaagacgagagacgagagagtgagtgacagggagaaatgagaataagcatgaggaggtaagagagatggagagagaggataagatgaaatttttgaagtggttgagagggaaaagatgtctgaggagggagagtattttcacgtgtggacgtcttaagagacccgcatgtgaaaatcaattttcgtatgcgaccccttaagaggggttcacctacaaaactagccttatttttgtgtgcggacccttaataggcccgcctgcaaaaatcgatttttttcgtgtagtcctcttaagggtctgcacatataaataggaggatgatttttgcagacgtaaccagttatgttccgcgtccgtctgtaatctaaatagctccttttacaggaaaatcgtttgtgtagtagtgatagtttggcatataaatagctttgccatggccatcacataattaattacataacacgagaacacacatcacagcacaatatattgtacatatccagatatgctacagtaggacagttaattacgatcaagattggcctggctaaattcagagattattgtccatgtcagataaacatctatcgttaattctaaccgtctctaacgtggacatgtcgacaactacatgcaaatatatatcctcttggcaattgcatgcctagctagctagctaggacagatagctttaattaattaaattgtttttctcaccagtttcactattaagggtgtgtttagttcctgaaaaaagttgaaagtttaaagaaagttgggagtttaaaaaagttaaaagtttatgtgtatagaaaagtttttgatatgatatgatgtgatggaaagttgggaataggagggaactaaacacggcctaattcaaaacaggcacgcaatttattttgtcaactggaactgttacttgatagggatcaagtgatcaatccatcgataggaaaagcccaattgcttttgtcaattctagtttaaatacatcacatacgctgcattacatgtgtggttatccaaatgcccatagatcaacttgtccatttccgggctgctactgtctctggctttgacacattacgaccaattaattctttctgatcttttcctgtgaaaattaagcgcgaaattagactagtaatgtttatgaggaattctcatttgaaaattaggccccaataagagcgaaatgccaaattatgaacccccacaaaaaaaacaaattctctagtttttcaaatggggcccataattaatatatattgcatgacgtgtgtactatatcatctagataatgtagctactgagttttagaaaacatttccttttgttgcttttatatttgctaatccaaccaatgggacagatcgacaggctctccaataaactgaatccttttgttttggggtggaataattgattcttccatttcaaatggaactttagtatgttaaattaatgtatgacgtgtgtactactactataatatccaaagaatccaggtccctgtagttcaagtcctatgaccaagtgtttgctgatgtctttaagactttaacattttatttttctttcccttctcctgctgcttttatttgttaaagttggttgctgatgtctaaatgcaaccaacttgaaataaggccgtgtttaggtcgtgtgccaaaaatttttcaactatacggatacacatttgaagtattaaacgtagactaataacaaaacaaattacagattctgcctgtaaactgcgagacgaatttattaagcctaattaatttgtcattagcaaatgtttactatagcatcacattatcaaatcatggcgtaattaggctcaaaagatttgtctcgcaatttacatgcaaactgtgcaattggtttttttttcgtttacatttaatgctccatgcatgtgtccaaatatttgatgtgatagaatttttgcaagtttgaagggcctaagtcctttctgaacttttccatctatcaagaaagaatcaaatggaggtgatgttttggtccttgaatagcatagatacctagtcaaacaatagtacttaagcaccatgattaagattttgctaatgtctattttttaaaaacaaatagtgttaatattatatcagctcttgtacgatcagtgcatcatcaaagtatataactataaacccatctccaaaaaatagcatcaaactatatttatgaccaagaaattttgccagattcatggtaggtgagtcacttcatttccatagaattcccaatggtcagaaaccaggggaggcgtacgtttcaatgggctccttgaaaaaaaaagattatatatttttcctaatggattacctttcaccactatttgagtacctatagttctactagtacttccctctgaagcttaagaagaaaacaaggattagttgccaaattgcaattttttaaagcactaataatacaagcattactaacgtttcttgacaagtattttctcaagaagcttctcttttattcttcatgccacttgcaaggaccttctatatttcgtactagttgttgaattcaagctcgtgcagattgagaaacttcaaatcaagtccaaactccacagttaaattaaacacgtgtggaaacatgcctgcatggaagcagcaactaagttttggaatggaccaaacctgaaactgcatgcatgaattcatgctgatatagtgggatactgagaagagtatttagcagcagggacacagctagcttccatgaactttcttgctgctgatcagatgttgatgcagattagattggattagattaggtcaaacaatttgacaagatccaacatgcatgcatgtaatatgcctgagatgactgtcctagctgacaggcaaagaccctgtcagatgtttgacctcaggggagtttgctgatcaagcagggctgttcagttaaaacagagaaggtgacagcataagcagagtaagactgttgcgcttctcaaactgttaaacgatattttttttaaactttttctcaaaaaagttgctttaaaaaattttaagtttttatgcagtaatccaccgttttgttttccgtgtatatgggataagtagtataataagtactccctcagctccttcagttcacgggtaaatgtgtagtttaattttaagttatcctactttgactacaaatatatattttaaataatctaactatttagcataaaagttgaatcattatatttgtaattataagtagttaactaatactttttacattcaaatatactcgctgtaatagttcgatgtcgctaaaaataatcaaagtttatttacttgatgccaaaactaaccattatttgtgaatggaatgaatagcagttaagcaatccactctcactatattattgattaagttgcccatgcttacggtaatacgatcttgacagtgagaaaacattgcaagtttgacctaatttgggagtaattaatatgatgtaaaaatattccgatggcaagcatcactgctgtgtt

SEQ ID NO: 25327 - DNA, 1637 bp, Oryza sativa
cccccatccccctgtacgtcctctcccctttttctcttcctactacaccataaattttaaaataataaaaaaacaaatttagaaaattttatatataaaaatactatatataaaaaatatttgaattcaaatttaaatttgaatcgtatataaactttttacttataaactttgggtctataaactttaggtgtatagaaatactatatataaaaaaatgaattcaaattcaaattcaaacttgaatcgggtatataaacttttaacttataaactttgggtctataaactttaggtgtataaactttagatgtatagaaatactatatataaaaaatatttgaattcaaatttaaatttgaatccaaatttaaatttgaatcggatatataaacttttgacttataaactttgggtatgtaatatttaagtgtataaactttagatgtgtaaattttaggtgtataaactttaagtgcataaattttctaaaatagaaaagtaatgtggtgtaaaaaaaggaaagtggagagagggggggattgatcgtccggagcgatttatcgcttgttaggattctcgctatattactactcgtattaaagatttgggaatggtttatggttccaactcccaagtcgttcgtgcatcattcgattccgacatcctcgatattttcaataaatgggattcttctgatgttcttttctttaagaagagtactgctgcataaaatttaattatacagaagagtatgggaagaaatccagtttcataacaaaaaaattatgttaagagccctatgaccataagttccgccacctacccatgcataatttataaataatcaaatcaaggcaatgaaaattttaaaaacaacattcaattctgatactatcaacaaactgatggaagggataagttttaaaagaatacattctagagcaaaattagttgagtttttttttctctcaaccaacatttccttcagtcgataagattgattttttttcaaactcttcagctgaagacagctattttcatgcatgtgtccagaaaaaaaaaagaagttccttgtgtgatttaattgggaagaaaattggtctaacaagagaaaagaaaaaaaagtcgctttaccggtgccattacggccctttttgggtacctcatgatagtggcaatattcaatttggttcagagaacttaatttcaagttaatgaactggatgcctctgtttgtcatcttgcatctgcaggattagaaagatagtctattcggcacagtctaattctaggtcttgatattttcaacactcacgaaaacaacttatatatacagttgatttttttttccaaataatgaaaatgatacattcaattgatatggaccgtatttcatcaccatgaaaagaaactgaattttgaccacaccatctagacttgaagaactttggcgcgcatatggttgcagcattgtttgaagcagagaagatgacatttttttggaagaaacatcaatttccagtcaattgtagatgcgaaaattgtctcgagaagagaaaaaaaaccaaaccttaatggaatcgctagtataaacatcgtcctccaaaaaaaaaaaatttttatactacttctaa

SEQ ID NO: 25328 - DNA, 738 bp, Oryza sativa
  unsure (1)..(738): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttctcactgattttgctttcatcgctccatgatgatttaaagaccaatgcagacgggttatgcaatccaccattctctaacgccaccaatttccggttgtctctaaatgcaggtacattaaattcttttgcaccatcttccatctcccgaagctaacagaacagatagaagtgtagataaaaaagatattaatgcaactacttggttgtgaaaacttcaaataacattttgatagtacttttgaatcgttgaaaaaatcagcatcgaagtacttcatggaagccttcaatgcaatcacaccagtaattggttcttttctggaaacatcttttgcagaaacagcctcctttgtatcctgaaaatgaacagacaaattgctaaaaaaaaaattgtcgcaatgaaaataaactgaatattaaaaggagagcaatcttgccttccagatcttgtggtatttggaaacaagagtatatgaatggctcttcccacaggtt

SEQ ID NO: 25329 - DNA, 5518 bp, Oryza sativa
  unsure (1)..(5518): unsure at all n locations
acgaaagggtttcatgacttcatgcttggttgatgattgtacatttgtactactactactactccaggagtctctcgctttctccttgtttgtttattttgttggagatttggggtttgattttgtcgcatcttatattgcgtgggtgacagtttgtttatgattcactaagaggcataatcctattgaaaaccatggtcctattgatttttttttgacctttttaatttttaattttattagtattcatttccatttttcaaaaaaaaactgagcgtcgtttagccacgccagcacagagttatttggccacgccaaaaggtttagatttgaaaatatttttttaaatgactattaataaaattaaaaaaattaaaaaaaaaattgatcatattatactttcgatatcctgtaaaacatttttttatagaaagctacaattattttttttgttaaaattatcggctattggctaggcgttttagataactacaaacaatagcatatgattttattataaaacataacttatatcgtttattacaaaagggatccatttgtcctgcacgtatgcaatgtgtcggagggataagctccaactgtcatgggaaaccacgatcttggatcgtggaggggtttaaggcattcaaacatgctcgggagtaaaggacgcgaacaagtactcctatatatgtttatatgtttggacctcctgaaagatgataccctattcctatttgataaaaatgtccatataaagttaggagctctcaagctagcaaacctagttcatgttgattattgaaaaactaaccccttctaatcagttttgattgggcttttatacccaccatctctcactattagccgagagaaatgatatactgttgtaacatattcatgtcgaaaataagtgaaatagtaaggagagagaatatgaacagacgactaaattgtcgtcggccctccaagacgagccaaagctactgcatctaatttctccctgcatgtgacttgtgattggatggtgagcttcccaagacaacatgcagcagcagcaattggattacgcatgcaagcaaaatgtgatcatattatagtagtacatcttattattgtacaaaataattttaactcaaaccgtatttgaggcggcatgttttagagttatcagctggctgtatcattgaacttgctcttagcctattttctaacctttgagcttcgagccagtttcagtcgcctatgcagcctttctatgggactccacaccgaatccacctataaaggctcattgttttcaccgtagtctcaatgacactaacttcgttatctttatggagctttctaaaatagtgtatcgctttgatcaagtaaattagtgcttaaagggcttgttcggttgcttagtacaacggctgctaggcaacccaaggcagctgatcgcaagttgttttgctgcatctacaagcagctgcttggctgctaagaagggcgaacaaaccagtatgtagttttgtacttttgttgacttaaacagcaaagtgattagtattgtgataggttttctactgtttagattattatatacttgtaataaatatgtacttggcttgcacatttttaatatcctttgttctaagaggcaatcacaaatttgccaatggtttgaatcgttattacaatactgccgctagaaaattgcaaaaatatcaccagaactgatactcaagtggcattcttacaaaattaaaaaaaccaatggcaaatttgtaaaatgccctttttttctaaaaatagaagcaaactaaaaatttttaaaacccacaatagaagcaaaataaaaaaattaaaacccacatggaatccacatgacactgaaacaatatattccaccttgtttatctatctctcccatcatttggtcttggtagcggtggttgtggtggaggtgcgcgggtagttaggaggtgaggagacactaactagtgtgcgatgtgcccggctggcggcagaggaggcccagtagtcggcggagacgcgcctacaatccaggagtcgatgtcacccgctcttcccaccatcgtgagggcttgctcatagtgccgcttcttgcaccagcaagcagtagaagacaccacggggagcggtgtagactggcagaagtagtggttgtgccggttgcgaagcggcgcatagatttggaggctaggtggagtatggcaggagcggaggaggcccgcggtaccaaggcaatgccatgctccctagacctccctgctttcatcgagcccgcgcttcccctcatcgcattgctgacgacaatgactcctagcttccatctctctcctttctccccctatctttccctctctgttctctcctatcttcttggtgttgaggcctgaggcactcacgatggtgtgatgacaacctatgaggattggactagcagcgaccgacctgagcttccacatctccaccaccggtcaggctcgatggtgtagccgccaccgccacccaactcctcttcgttggtcgcctcccttctcctcatcagtcgcgtggcttggaggtttggacagagatgggaggagatagggggagagagggaagaagacttgtttcactgatatgtgggatctacatacctttttactttatgtttttattttttcctctggtgctttgggactatatttgtatcggttttaaaagatgaaaggatgcgttatatatatggtattgcggtttaaactcgactttaagataaggaacctaaagtgaacttattcaaagaaaagggaaaacataccgtaacattggggggcgcctagctggcgcgtatgcgccgctagcgcgcaccttccccatctaaccacctatactagtattagttaacattacttaacactaataacaataattaggaaagattttaaagatttttttggagatatttttactaacagattgaaaatttttcaagttagaaactttcgatttaagatttaaattttaaagttaaattttgaagacattcaactcagatttgaaaacattcaactcagatttaaaaacattcaactcagattcgaaaactttcaagtccagatttaaaagttttgaaaactttcaactcagattcgaaaacttttaactcgagattcgaaaacattcaagtccaaattttaaaattttgaaactttcaacttgagatttgaaaattttaaagttaagatttaaaaattacaaaaataggaaactaatataaactaattacgattttttttattcgtacggcaaggaaaaacaaacggtgaaaaaaaaatgaaaaaagaagaaacgcgggcgtaaaaaaaaagaaaaaaaaagagagaagcgcaagcgcacgtgcatgggacttgtgggccggcgtgcgcgccggaaacgctcacacgcgaattagcctttccggtaacattgcagcctatgacaaatcgttcatgggccgattcatcgtaggcccaactgacccattccagtccgggcccacctccactccccgagggataaacaccacgtgttcacactcgccccaccccccgagggacagcctggcacaactccccaccgtccgatccagatccgaccgctcacatcgccccagccacgtcacctccacctccacctccacctccacgcggccacgtgtcccccgcctccccaaactttttgggaagatggcatttgcgagagaagatggcaaatagtaaaaaatccccgcttctcctcctcccatctcgccgcacgccgccgccaataaaacgacgcgacgcggcgcggcgcggcgcgacccgatgcgacgcgacgcggcgaggagagggagacgagctgagcagcggcgacatggcgagggggagcaggaggaaggggtgggcgcgcggggcggtggcgttcgcggcggtggcggcggcggtggcggtggggaggcggtacgggtgggacggggaggcggcggtggcggcgttccgggggcggagggacgcgctgggcccctgggcggcgcccgcgtacgtcgcggcgcacgcgctcacgctggcgctgtgcccgccctacgccatcctgttcgagggcgccgcggcgctcctcttcggcttcctcccgggtgtcgcctgcgtcttctccgccaaggtgctcggcgcctcgctctccttctggatcgggaggtacgggacgagttcctcctcctcctctttcttcgcttccgtttcggttgctcgtagcgctcgtggtggatgttgagcagggatttgtagacgtcgagatctagacataccgtgttcagttcgtgcgtgccctgatttgattcctgtttcgcacgatcgagaagatctgacaagaattgtgatgagagtcgtatgatcggagatgggttggaggaaaaaaaataggctggcatttgtgctttctcgtgtccttcgaggaggaacgttgcgagattctttgcttgtctgtgtagaattgttggaatttttttgctttatatggaatctggttatgatgttagagaaatactgcggccgaaggaagactgatttgtttgcacttttttttggggtgaaaggtggttggtaggttcaagaactgaaaattgcaaataaaattggaaactctcatccttagtctgttaaactgtataagaatatataaattcaggagctgctgggatgaaaagctaatcagctatgcaatcttgtgtgtacaagcgtacttttgtacactggtgatagttaatggagtagtaatgctaagtgaacttgaacatgagattcaggaggacaatttaatggttttgggaacagaaaccaagagtacgctgtaacttagcatatggcccattgattgattctggttgaaatttcctgtttggaacaaaggagttccattgaaatgctaggggatatggcctgttctgttcccaggatacattgtcatttatctttgatatcatacgatatctttgatatcatatgtttagttgcaccttgtttataactacagaacaatactaggttgatactttaatctttgatatcatacatctttggtaagattaaataagaaaatggatcctttgtgatataaacatgtgattgtcacacgtaactttaattagaataaaccttgtggtgaggaggcctctaatttggcagcccaacatctgagagctctcccgatcaacatnnnnnnnnnnnnnnnnnnnnnnnnnnactgtcacaattatattgttgccatgctatgtataaatgatggatcaatgcttattgtttataatactaactttttagtcatattgcacttgattggtttgtataattgaattttttcataatcaaattctgaatcattgcgctccaatattgcttacatcattccttcaaacaatcccaaataaacaattacttagaaaacggctccaattgaacatgttaattctgagtaagttaataaactaaccaaacctgaaagttatctt

SEQ ID NO: 25330 - DNA, 1855 bp, Oryza sativa
tatgagcagccacaaaatcactcaagatggtggcaactttgccaacacaacacatgtatgaatgctctccagaaggctgcagtcatactgtcaaggtcctccccatggagttgtatctcttcaagttgctccaagaccgacctgccctctactaaattatacttaagataactttcagatatggttagtttactatgttcaattgaaccattttaaagagagttgtttggatagttttagaggaatgctgatgaagcaatatttgagcatattaaattcagaatttgattacatacatgaaaaaaaatccaaattgtataaaccaaggaagtaaaagagacaagaacttctgctgccttataaacaaataagcactgatattatttatacaactagcatggcaacaatataattgtgataacacataacaagtattactacaggttatgttgattgggagggctattggtagctaggggaaatcctcgcaggttcctttagctccatgtgtttggcctttgaggccagctcggcccaatggcctaaagcagcccaaagggcctcatgtcagaaatcccgatggatcggtggatagaactttaaacaaacacaaaacacatactatagatgattcgaaaaacaaggatgaatttttctgtttacaaccagaattaaccgcctagagcgattttcacgttgtgcctaatgccacgtccatccccacaacgcatgtcgtttgtctcaatcatggtgagagatgcgggcagccatgagctagcctcgaatgccctccaccaaaactaacatgcacgacatctacacaatctacacatctacgcacgacatctcatcgagatgaatgacgtgcgccatggggatggacgcggcattaagcgtggtttgagaatcactctaggccgttatttccttgtaagaatctggctttaaatgcagcacaaaagttcttccttgttttttggatcatctacagttcgcgtgtgctgtgtttgttcgaagttttatccgtcgatccatcgggatttctgatagggagcaataccacccacatgaagtggctgtagttgtcgacggtcagaaggaagtatatgctgtttgtttattgccataacatttagcactaacatgatttttgcagcaaatccagacattctcatgttttgcgaagtacgtaaactttttcgggttcacttgttcctctgtccatggaagttgaatagcccattatggacatttttgacacttttgctttttatttggatcaataaatgaggtcaaatttcagctaataagaaataataatctctttactctagcccatcctaatcacactatgcaggaatctagacatctagatataaggcccactatatgttgataacttgatattatgatctgctttattttgcagattgatcatcaatatgtcctggatacttttttttttctggttaaacaaagaaagtaaaatcccattttacatgttttgaataagtgaacttggcaactaaaaattagtgttatagtttgctttgtgatgccatgcaagtgggttcttgcagttatgctggttccatattgaatattgatacagttaaaagtggccatgcagtcagcatcttcaattatactgatgctctttcaggcacaataacatcattacgtcaacccgtctagtgtataacgctgtaatgggatttggatgtacatcctattatttgtcctggatcacaatttttttacctagataaagaaagtaatttccccatctttgtgtggttaggtaaattgttttataggtcagttcatttctcagttgtccatcatcttctatatg

SEQ ID NO: 25331 - DNA, 11385 bp, Oryza sativa
cttcttaaaattttcagggcaattttcagactcttaacttcagcaatggattggctaaagagtaacaagtacttccatattgtggttaaaggggttgaacgtgatggctggaaatttgtgctacttgctagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatgggtttactgatcatattgggttattcaatatagtagtagatacaacatggatgaaattgctagatggatgatgttttctagtttctatctgacgatttcagtcagtttggtgtataacagtggttgtactatgtgatgcacttgattcatttctctagctgttgtggtcctgagtatgaaagatcagcatctcaccacacaaggattaagaccaaaattttttatatattatccccctacaggtggctaaaacatagatcttatgccttatctctatctgtctgccatctcatttgttcttcacaacttgtgaaggcaattgggcgcaatgggtacaggtagtgcctacccatacccatgcccatgagattatctgtgcccgtgggtatacccattactacatgacaggtaagaatgattgctcatgcccattgcccgcgggcgccttatgcccgcgggcgtgcccgtttacccgccacaacaaaagcagctgacaaaaagtctacaagcttctaagttcgaatcgaacttaaaacatcaaatattctccgcctcggtgtcgtgtctctcctctggcggcgatagagtaaggggagagaaataataagggaaataaaagggaaattgtaaaaaacaaagaacgtggcttatgtttctagtggattttgctcctagcctacatgtaagttcgatttcgcaggtaaatgggcaaagcaggcatgggtagtgattacccatacccatgcccatttacccatcgggcatagcttttgacccaataagatactcatgggtataaaatggagaacaaacccaaccctaatggggtttttacccacgggtaaacggtcaaacgggcacaattgccatcactattcactcacaagcccaattgcagtgtccagtctgatgtcaattgtgacgtgaaaagtgcgtcaagcaacagccaagccatcctccttgcttcatcatcaccaggcaagtttggcatgctctggacaagtagccttcctttgccttttgctttactcggtggaactcaacaccatttgtttagtgtaattagtactgccttttgcttcttgaaagtgaggagcttctctttctttttccatgccttccttttcacccttgaaaactcctctctctgattaagccaggcaacttgggcacctggctagttatatactccatccatctatttcaaaatataaggcatattttatttcgttaggaccaataataactttgttatagtataattttgtgatatgaaatagaatttattatattcgtatttaaaaatatttagttatgtgcttttaataacataaataatatcccaatagagtaataattgttggttaagcctcgtcataacgagataaaatataccttacatttgtaacagaggaagtatatgccacacactgctttgtgagatggtgctgtaactgatgttgttaatcattgagggtcactgtgctatattgctgatttgctgccacacatgaatgtgtggataacttgttaggtgatcaattgtcttgggagatagaagataacatcaattttgagtccctcatgttcttgtcaagcgatttatttttaatttctgtttgatcagttacagtaaaagtgggtcttgtgtggaaggtggtcacctggagaaacttgtggacttcatgtctctgcttttcattttagtagatgacttggttcctccatctttttcagggatgaattcttcatcattgacatcttggggtgcaaattttggaggattttgaaacgtcggttttgcttccaggacatatttcctcgctgatagtgattttccatgattaatggcttttcttgttttcacaagcaaaaaattgaggaagattgaaatgaagaccgtagtattaaataatatatattgatcaagaattaaacaacagaagaccagattattgaagagcttactaattaaatgatggatgagaaacatttctaggcttgaccaactctccaaagatcaaccaaaggtgtgcaattttttttctcttaagtagtaagaatggaaagcacattaaaacataaaatattgaacctaagtgttatttttaataaaaatattttaaataaaaaaatatgattgatgttcaggaactagcagtctccaagttgatcctgcaaacaggaatttgtcagtttatatgtggttctgtcgtaattgctatagaatcatcaacatcgttattaatgtaaatacagtcagagtacgctacttcgcattgcaataatttatttattaaaaatacgcaagatttggattagtcaagtacttggttttcccacaaagtcaagctgaaacttctttatcatgagatttagatggcaaaaggagtatgatactacataatcttgaccaagataactgtatatgaaaaatatgtttcattatctgatctcggtaataaacaactaaaaaattgacatcaagtttggattatccggcacacttggcagaatttgagacaattttttcttgggagaatttgagacaagttcataaccggatcaggatcagatagaatagttgttgaaatagttaaatggaactaaagttaaaaaaaaaagctcagatttttattgttcaacagtgcatttacagccatgaattgcaaaaagtattattttgcgtaatcccctctttatcatgcacttcacagaatacaatggaataaaattgaaggaacagaaagaacagatattccaaaaagtaaaaaccaaagacaactactctagttgctatgtgggccaggagggtaccatcatgctcatcatcttctagaaccctaatatgttggcagtgctcattggttgtggacataggacatgaggttgttcttgtttgttggtcaccaccatgtgcagtgctccaatatcaggtgtgttcttcaggtccgcaattcagtaccagccacaaaaagtgcaatttctttcttgcaatgggcatgatttttcttgttcttggccaaacatttgtgatatttttgacctgattaggcctccatgaaactctctacatgttactagatacaaactgattttatcaaattggctactctaagtattacaaagtattatctgggagaagatctgtacaaaggggggcattggattattcttccagagcaaaaaaccgatgaaattatctggccaagcctggccacaatcaagcaatacctactttgatctaatccctctacatttccaatatgtatgtcatcatacttgtcatatgtatagaactttgtatgtactaaacatggccgtgcgaaaactttggttttgattccagataactagaaattctccttgtggaagtcgaatttcgtgctcgtctttctcgagaaatcttgagcgagctcacgcagttccttcgtcagcaccggcgcgccacagtagaacacccctgtaatgtcaaagaagaatcaaatttagtgtaaaaattcagaattccaatagtgcatgaagacatgataggattggattgagatgatagcatcatgcctgataatgatacagttaggtaagggagcacttcttgaaaacatggcacaggcatatcttgggaatctttttgtgcatatgaactgaactttatgggtgaagaattttaggatacctgactatgtattgtttaatgtatagctcgagcctaaagggactgtatgccaagcggttgtaactatcatcaagtaacaatgattggtcaatccataaattatatagtactaatatgattcctattcaacctaacaaacttctccccaatccacaaactaagtgcataaataaacaaatctcaaaagtctgatgttgctaatgctatgcatgtattgcttgtcaaaagcttcgacgaagaagtatttagtattcctttacttattagctgaaactaccaggaagcactaacttctattttttttagagaaaaaatgttactcaacattcattgcaatctaattatcagtgacaactaacagtgattgatctgtccccattccctaatctcaccagcaggttcctgttcaaccttgataactgctgcacccagtccatcactacttccaattgaacactcaacctcaaaactctgatcatgcttgtccccatcagctagatccccagaagcaacttatgccaaccccaatgcagctcaaaaccagctcagcctactatatcaagaagtctaatttcccaaagcatgtagtatagatttaaaatttcccctactcgctcgaaaaaaaaattatcggttggggataaaaaataaaaatatcccgacccgacttttcacagtcttcaatatgcaaatttgatttaaaacttgtaaagtctctaacccggcattttacggttttcaagatgcaattttaattgaaacccaattttttacggttttcgagatgcgactctgatcgaaacttaacggaatgttgggagaactagacaacaacaacaacaacgatgatgatgatgacgacgacgatgatggtggtggtggtggagcttaccgacgcgttggtcgcggtggttgagggcgatgcgcttgtagacgttgcgccagttggggcgggcgaagtgggtcttgacgcgggtgccggagacgacgtcgacgccgtgcttggcgtggttgagcgactggagcatagcgatgagcgccgaccgggcgtccccttcctcgtacacgctggtgcagtagttgtgcagctcgatcacccccttcttgtccgtctccgccacctcgtccatcaccccccggaaccactcgaacgacccctgctcccgcgtcacccagtagaagtaggcgcgccgcgtcttgaacgccgccgacgacgacgacaccgagttatcgttgccgtcgccgtcctcgaggtcgccgtccagctgcctcatgttgtttatgatgtccttgatgatggagatcatcggggtggcgccgatcccgaggccgacgaggaggacgatgtcgtactgcttgtagtcctgcgccggtgcgccgtacggcccgtcgataagcaccttggggaagctgcagtaggaaaaaaaattgattttcttaaaattttattaattaagctaaattattaccatattatgatattatctttgattaattttgataaggaaattgaaatggtacggttttgtagacggatacttcactgttgttcagctagaaaaaaaatgggaatctttagtcctacattttacatttctaggatggagatagaacatgagcagagaatatgtgtttgttctctagtcaccaaaaagatttcattgtttttccctacaagacaagaaatattccattcttgttctacaaagagaaaaacaaaatcaatggaatatatggcttggcaaaaacatccccccttcaccttatcctcaactaagggccgtcttccacaacacagaaaaaactctatttatcttctcttccacactcatatcatcattattcagttagttgcaacctacttaacttactagtactaccaccatctcaccaaattaattaccattacaccgactaattaaattatcaccaccctatctacaaatgtcaaagatcatgctctgcagaacagcaaaggtcaacccctactacacaagaactacatatacacacacatgatgaggataacaaacacaagtgtcaccaacagaagggacacaataattaaacaagccatgtgaaagcatgctttgtactactactattactactacattttgctcatgcctgatgcaagagatgatctcattctcacacccagtgcaagcttaggtcagagatcatgcataccatgcatatatacatacacgcacaaaaaaaactatttagacagatattccattgaaaggaacaattattttaggtcagagatggtggctaccaactcatatcacactagcactttacactaatccccatcatgtgtgaatcaaaaacctagtagtggtaattatgtttacacggccactaacacttactaccaaccaccaacctaccctgagccacacaagtgtaaatgtgtgaccaagctgacccgatcgctcggtcgcaaccctgaccggcgacccggtccggtccgacccacctcacctcacctcaccggctgaatcactttccacacgctcgttgtaaggctggaccccatcatgttggaccatgccgactagtttctctttttttttttggtctcttttatgtggttttttgaaaaaaagggggaaaatgtggttgacatttgagggaaatgcggggaattttcgtagcggggaagaagaagaaggggggattgttttgcgttcggggttgtgttctcaccttgggttggtcatggcgccgtcgcggtcgtactccgcccggagcaacccgctcttcccttccgtcggtggccggcagacctgaaaaacataatattgtcatgattaattcttttttactttgcaaaaaaatgtacaagtcatttgttaagctaaaatattagtgatagtaaccgtgacagcgatgataataataatgatgatgaggaggagatttgtaggggcttaaggttggataagattgtgagatttgtgacaaatagatggtgagatgggactagcggagtacccttgagaagacgttcttaagctcccgtgtccagtcaccgagcgtcctgatgtggacgctgacgtagtcgtcctgtggggccgacgtgatggagaatgggtgcctgcaggtggggtcacatggtcagcatcacatccttatcacagattatatatatatacacatatatccagcttatctcctctgctttggcttagccgtcctaataattatataaaagatgatgctcaaagcattcccacttaaggaactttaattgcttaatcaaatcaactagacccacaggtgatttaattaattattagtccaaaaggcatccttatgcactatcctacttccattatatatatatatatatattctgataatccgatcggacggctcaaatcgatcggtgtgcttaccattggaacggcgagacggcggcacagttgacgaagatgtactgcccactcttgtacttgaaaccctgtggcttggagaagtgcagcgacagcacatttccggggtacaccgcaaccttgagtatcttcactggcctcacgctcgaccggagcgccctcgtcagcctctcgcacgcgtacaggaacatcggcaccgccaggtacatccacgtctgcgtccacgtcacccaccatcagcaccgccacgtaggatagagagacgagggcatgtacaatggactaatagataaaggtttagtggtacgtaccgttttcttgtaccaatccttggtaaggaagaggtagtagccgtggacgatgaggagggcgtagacgatgacgaagcagtggtgggagtaccagaaggcgttgaaccccgtgaggcggttgagcgggcgggggaggcggaggcggccgcggcggaaccacggcgtggcgagggtgaacgccaccgccatgagcaccagcatcaccagccccgtccacccctccgtccccttcacgaaccaccagtagttgggcggccgcgtgtcgccgaagaacctcttcatcggctcgtactcggcgtcggtggcatggagcagccgtggaaaatcgcaggtaaggtgagagatgacgtgcagcccggcccccacggtgatccccacggcgatcaccttgtggaagttgaggttgtcgtcgaacggcacgacgcgggcgacggcggcgcggttgcggatccaggtgacggtgttccggcacaccgggaggaggatgagcgccatgttgaacttgagcgtctcggcgccgcccttggcgacgcagacgcagtagcccatgacgtggaacacggcgcggtgccggtactggatgaacttgtaggtgaagaggcccgcgcagatggcgagccacaggaggagcacccagacgcggcgccagttgtcctcgaggaagtaggaggcgcgccgccaccaccgccggagcgggttgggctccgccgtcggccggaggttctggctcagcatctggctcaggttccggctgttcgtcgtcccgatcctcaccgactggctcggcgcttgcagcagcagcatctccaggttgtacagctgcaaaatcataaaattattatcggccatggttgccggcgacattgacggtgacgtcgattctggaccgaaattgtttgagaatttagtgaaatttgactgaattttgaatatatgtacctcgatgtagccgaggttgctggggtcgagctcctccatgatgaggcgagcgtactcctcggactgctcctgcaccttggacagcttgttggccgacgcgctcagcgtgataatctggaaggaagaacacaatagttttaattataattctaattaattagtcaaaaaaaaggattgaatctttctacaaaagaaaacaagaacttgatccaaaaggggagggaaaagaaacacgatctttctctatcaaaatttgatccggtaacaataatcaatttaagaatgcgagtctggttggccattgcgatcgagacacgacacgaggaaaagaacttgaattagaagtcacattaaaaaaaaaagtcaagcaagaactttgctgtcctcaagagagcaggatgtgcagttgtggagaactggtcgatgatgctgatgtgcatgtgccaactaagaaattgagcttcaagctatccaagctactactatcttaactagaacaagaaacagagatcgaaactgatcgaaaaccgcttggaatttcagagaaaatcagcaaatttttctgttcttggagggacaaaaaagctgggtatgtttgaattacctctttaacctcctcttctgtgatcctgccatccgcgttcttgtccaccctggtccattaattaccaaacaagacagttgattaattcagccattgacgagttaattagtcaaaaattaactgttggtttaattggtgattaaacaaataattaatgaagtgtggttgctaaatacttacatgtcgaagaaggtttggagacggctgtcgaagctggtgtcggagatttggtcccagaattccagcagctccgccttgctgatgctgtcgccggagatgttccgccgcctcgccagcgcgtcgaacagctcgccggcgaactccagctccttcatccctgaagccagccagagagagtgattgattagttgatgagaggaagaagacgacgacgatggagaaggtgttcgagatggtaccgatgcactggccgaacttggagcgggggaggaggccgtccttggcgaggtcgtcgaagcgcttctcgacggcgggccagccggcgccgccgtcggcgcggctgatgaacttgaggcccttgagggcgtgggcggcggcggacttggagcggtcgaagcggggaccgccgccgccgccgccgcggcggttgacggaggcgaggcggcggaactcctgcgacacctgcttgatccgcgacgacgcgtttcggatcaccgagt

SEQ ID NO: 25332 - DNA, 3627 bp, Oryza sativa
gccacccccgacggcgcggacagcggcgccgacaccgactccgcgaacctcgcgctcttcctcatcccggacctcttgctcagtggcccgctgtgcggcaccagccgctccctctgcggcggcggcgcctccgccccggcctccacgatgtcctctcctccgccgccggcgccatcggcggcgccagccctggtatggtgcatggcgcaacaacaacaaacacctcaagcgcgctctccaattgaactcccaagaaatgaaaccaagaaacggcagctgctccctccaatggcggtttcgattcgtgtgggtggaggaggaatggaggatggtggggtgggagagggcgtctggcgggtatatataccggaggtgaggtgggtgaggaggggtgtgtggcgtttaccagtcgccatggtcgccatggtcgtcggctcaggccgctcgtcggctcgtggggtaggtgcgtcgcgtgtgtgcgcgtctactgctctgctgctgcgttacactctgcactactcgctccctctttgacgctctggactaatgtttggccactcgttttattaaaaaatttatataaatattaaaaaaaattatgcttaaatcactttagataataataaaataagtaaaaaataaataataattctaaatttaataaaataaatgattaaatagtacaagcaaatattaaaatccatattagggtaggaagggagtagctgctgcgctgcgtttcgttttttttctttttttttttgggtgggaataaaattctgcggtcaagcggcggctgacgcggaaacgaacgacgttaaattaatatatttcttgggctgaatttgggctcgtgttttgttttatctatttacttgccattttttcccttcgctttcgttttttctggactgctctgtttcggaccacagaagagtacgggtagctcaggtttttgtattttgcagcgtcgttgtacagtacagtggtggtatctctggtgtacgtacgtatatacgctttccgtatatacgtttttattgttttttttggaggatgcgttttttttttgttgtcgagcgtttggcggcgcgtgctcctgtgcagtagcattcaggacttttacgtttcggcatagaaaagggaggctccattttgtgccgtttagaaagtgcaagtgtggtttcaacctgatatcctgtcttcattccccgctcgcagtttcttcttaaaaactatttaagaaacaatactcccttgaaatcttatttttcaaattttgttccaattatgatgtagattttattttgatttccgtcactattttcttaaactactgtacaaatgtatctctggtaaaaactttcttatatataaaagtttctttaaaatatcaaataaatttatttcttcaatttgtaataattaaaactcaattaattacgcgctaatgattttttttgttttgcgtgccttgtcttcatattcatcttaatttctatctcaaatactcacttattcccaaatcgacgaaggataatttaaattacatcaatcaaaacaccatacataacattctcttacaatgtatgtatatgatgatcaatttaagaaattttgaattctattatatgattatcaatttgagaaggagctgggagtaccacctaagaatcataattatgacattttggaaataaaattataatcccaataaattttcaaagtaaaggaaccatgttttcttcttctagagccacattgaacgtacaaggacgcgctggtaactctgaaatttcagaagtcgttccgttcaaaaactgtagacatagagacattttttgcatgtagagagagaaatttaattaacttatcatttgtaaggctgtcagataaattgagccaccatcgatcataatcaaacacatactcgtgagagaaaaaaaggatattaagtttcgttaatgtccttaattatacactacgatgttcctcgagcaaaattaatttggaaacggcactgggatatggatgttctcattaccaggtcaatccattcgatcgaggagagtaattgcattcttacctgcattgtacgacttcccgtgtgtgggggcattcactcattcagtactgtccagaggagtatactagtagcagtacaagaatcaccgaacccgcgttttttattctctttgagcacggactaaaaatcttgaggagaacagtacaacgtttcccatcaccactataaaaatccccgtacgtatcgttccataggtgtaggttcatttaaaatcgagtaggtgtaggttcatttaaaatcagtatctataagcttttccttatctttacgtgataaaaaaatactttctctgtttcagaatataaaactttctagcattgcccacatttatatagatgctagaaagtcttacaatcttacaaaggattatatgtgccggttcaataggaaaaaccggcattaatattataggtgtctccatctcaaacataaccactttttctccatgtattatcgtaatattagacgtacatgcatgcatacattatctatcaccattttctcctctaaattcgtgttgttataaatcctctatcatcaaacccccaatcacattacttgcaggtataaggtgattaaattctttgttggctttttcgttagtgatgctttgtgcatgccttatattttaaaataagggagtaaaaaacgaattatttgtttcacacttcaaaaactatattttcttaaaagaaattcttttacttattacttttggatcactttgtaaagctatttatttattaagtataattttcaaaatatataatttctagttataattaaataaataattcgtattaacaatccactcaataatatgttacaaatacattgaaatttcaatcgatctcaggcaaaactgacttgtaatattaacctatacaataaaaacaacggagtatttttttttatatttacgcatacaatctgaaaataaagaatggctcggtttggtaaggggcacctatgatatactataagtacagttttttaattaactggtatctataatatattagaggttctgtttcttttaatgacgtagtgaaaaattagacaaaatgaagttttagtctaaatttctgctatatataaattgcattttgatatggactattcttcctggtacatatttggtaatggcattttttttacaatttttatcattttagttttgtacttagattttatgatattttttgttttactttgtggatcataatgtaatagaatcgttgtttttagtttttccccaaaattttgaattatttccaaactgactcatcttcctgttctttttattttttaagcctactttcatatattttgtggataattgtctgcaaatcaaattgttgagatttcattttatatattctcgattttattaaatctcatatcattttttttgcatgtactctcgtgttaatgtgttttttaatccaaaatttgatatttttaaactatatatatatatatatatatatatatatatatatgtatgtatatgtatgtatatgtatagacgggctgcagga

SEQ ID NO: 25333 - DNA, 4016 bp, Oryza sativa
attaaggaggtaccgtggctacaagtgccatgttaataatataacgtattccctccgtttcatcatattttaaattttaaagtcgtttgaccaaaattatttaggtttgatcaaaattaaaaaaaaactagcaatatccataataccaaattagtttcattatatttaacattaaataaattttggttcaatgtttgtttaatattaaaaatattactatatttctctaaaaacttgatcaaacttaaagaatttttactaaaaaaaagttaaataacttgtaatatgaaatggggggagtactatattacgaaccgagcatagtttaactggttaagttaaatttcttatgatgaaacctatccacctaggttaatggtgcgaactgaacgtaccttaactggttggatttcttgtggtgaaacctatactcatatttttttagtggtatttgacataccgtaatgaggcgtctatgatgagttcgtcgatattaaggtaccaagacctagtatttggagatgctcataggaatatggtatatgtttatagagattagtgtacacatgtgtatatgattgtctgtgagatatgctatgttttaaaaaataatatactatctgttgagtcaatctatccgtggttaattggatctatgccattataattttgtcgaattgtaaatattactactatttacgaaattggctaactgttattagtattttgtaagaatttaaaccatgccattatattcgtctcggacgacatagttggaccagttttttacaaaccgtattttcaaatatactaaaatacctccagccggatgatgagcgggacccatctgttagacctacctttaacctcaagcattttatcatgtgtgtggtataggcaagtgatggcggggtcggtggcaggcaagttatggcggcccgatcgacattggagcttgccggccggtggctactacaaccggcgggagactaaatctagctattgcaaccggcctcttcgatcgagctcctgaccctccgccagcctaggccgagtttagttctaaagtttgaacccctggaaacatcacaacatcaaacttttttacacacacaaactttcaattttttcatcacacatcattttaattttaattgaacttttaattttaaggtgaaactaaacacacccctactcaaagcacgtgtggaattaaggttgttgtggccgacggctgggcaggagctcaacaaaatcctgacccgccactagccttctcaagctcctagcgggcggcccaatcattgtaaactgatcttgattcaggccaagtttaattctagaatttttcttcaaacttccaacttttccatcacatcaaagctttcctacacataaacttccaacttttctgtcacatcgttccgatttcaaccaaacttttaattttagcgtgaactaaacacaccgtgagctcttgcttcgtcaagctcctgtcccgctgctggccacaacgaacttccacgtgcgctggtcgccgcttcatgagctcccgtacaccggtgcacgtacgccttggcctcatcctgctcccaacaagcagttggccttgccgaactagaggaagggttgaggttaaagatgtgtcgacccagtcccactaatattatcctatatgagttagggataatattggtttacaaaaaatacgatatgcaaaaaaaattgatctaattgtgtccaaggcataaataataccacggtttaattttaagaaaaaagtaaatagcacttagccgattttataaataacagtgatgtttttataattggatagagttacaatggatggttcacgttaacccatgcatctatctatgtgagcagaccgatcacatgctctactcgtagacaagctgcagctgctgacttgctaccagtacaatttaccgtactactatgtagttactctctctataaaaaaaccaatctagattaagatactatctcttctactctccgtcacaaagtataataaatttgaatagataaagacatatccaaatttattcgtaccagaaaccattatattctgtcatgattttttatgggacgaagggagtagtatttagcactagtagctatgaattcgtagcttcgccgccgttctagctaggaattgaattgaagttggagtcagtatgttcactttgatgctatttttaaccatactattttttttagcaaagttaccataaaaaatatctacgtttagtttgttattaaatttgatcaatacataagaaatcctatcaaaattttggtaatattaccatcttgttaaaattttagtattatcaaaacttgataagatttattttagctccaatctaaaacatgcccgagatattgtgtcgggttggggttgggcaccaaatggaatccggccaccacatctcgcggttgcacgcatgcatggtgcgctgccaccgaatggcagatatgggatattttgggatgaaacgagacgagacgatcgagggttagggatatctcgtggtaacgtacgtgcatgtggtgaacagaaaaattcaggctgatgaaaccaggagataaatatgtgcactagcatgtagtactaccagcaggggtcacgggttccaaaagaactgggatatgattggtgagtttggactcgtttgtctgaggaacacaagtctgcctttgttacttccatcgtctctagatataactatcttagtatttaacgtatctcatcgtagaagtataaatctagatcatggtactaaaatatatcttattcaatcttatgttgatatattgtgagacgaaaagagtagatatttcgatgatattgttttgatgcacacgaaattcaagcattttttaactgatcaggtgtaggagaagaagaatgcaagtaattcgaaatctgatcgatgaaataattgaatgagagtcatttcgcttaattttattctttgcttaaaattatagaatacttatatttataaacgaagaaagtaagtgataagaaaatatggagcgtatgtattacacaatctgatttttttatggaattgcacaagtatatggagtaggaaggataaatgctttcacttcgattcatcacgtcgaaagagagtgcaatgaaacagtactgcatcagttagaacgaggcattgtgtggtctgacatgagcatgttcccatctgcgttcaagatcttgttcactagtctcaaatatcataataactatattatttgtaactatgaataaggcacccttctttctcgcaaaaaaaaactcccattacatttccttataaaaaaaaagcttagttcggcccatggaaaaacctttttagttagtttcaaaagtaccttttgcagattatatgtgttttattgactctaacgatattcattaagttataaataccccatgtgctagtggaaattgttccacaaaatttgaaagctgtctactaaattctaaaatcaaaacttatttaatcctcccggacagctgaaattacatttgaatttttaacatttataatttactagaaaaaaatacccgtgcgttgtaatagataaatgctattttaattttattattgttatatagtttagctacggtaaaatccaccgtaggaatttgcatgaatattttttcaaaaaatcatgagctgcaattaagagtccgtatttcatcttaagttagcatgcgagtttttttaaaagatttcttatacaactccttttatacttccaaaaagaaacaagcttaaaatccaacttatggatctgtatttcaaaaaacgagcaaacttaacaaccgaatcaaatatgtatgacgtaccaaaacaacagaaaaacattttcaatttttataatactagagactaataaaaatctaaaaatgaatttctgttgcatattgaatctaaataaatgagaaaattcataaataaagttatttcaagcataaa

SEQ ID NO: 25334 - DNA, 372 bp, Oryza sativa
  unsure (1)..(372): unsure at all n locations
gagttctactaagtggacggtgatgtggacgtgcctggtctgccgcgcctctgccgccagcgtccatgccgtgccgtgcccgatggtggacaagacgagccccaactacacgtggttcgtgcgcctcggagaccgcttcatagacgccaaagtgcccaccctaaagctgacgacgcaccttatagcatacattgtggatgtccctatatgccacattgaccagtnaccaatattactatatataaagacaagttattttaaatggaaaatttgtaataatttatttcacaatctatatctaccattatcatttttatacactttttgttactggttggagttaaataaaattaccgagataaacttatttga

SEQ ID NO: 25335 - DNA, 4836 bp, Oryza sativa
  unsure (1)..(4836): unsure at all n locations
cgttcgtactctatccaagcatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacagccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccgacgtgagacgaagaggccccagtaacgaagatcccggctgcaaatcctgctggacaaggaccatcagtttcatacatgtatttaatagtattaataaaaagtaaagtaccgtgtgggcgagggatcgacgctccgtgagaggaagagctagcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatgtctgggctgaactgtaccatgcgaaaccggtgctgtaggtcgcactgctccgaagctagggacgctcgaaggcaaacgaggtcctgcgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgcgaggccgtggttgtaccggaccagctggaggtacgacgtccacggcgttgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgttgtacacgtggagcccaaagtgcgcctgctagctgtccccgtcgagtcaacctgtgaagagaggtaaattatatggctcgatgaagtaagtatcataaaaatttagaaatgaacaatccgaactcacaagtggtcggcagggaggacggtcggctgcacgttgcccggaaacacctgcctaagtccgaactgtctcatcacacgctgcgggcagtgaggctcaacgaaaatgtcgaacaccatcggtaggatggtgagccagtaagcttggtcgcgtgtgcacaaggacgaaagtcctagcggtgctctcacagcgacagcctattatgtgaaccgctcccagatgacgtcgctaggctggagaccgacaagctggaccacgaaatccagatgagctcctttgagatggacgtgagcgctaacacgctgcattaaacatgatcggaattagacatgttatgtgaagaaaaaaaagaagacgactgataaacttataatgcagcgaagttgcactaaccccacgtgacaccagtaagtccccatcgtgggaccgtcctctggccactgcgcgctgcgtccaaccccgtagggtgcgctgtccaccactagtcgacctatggcaaacctctcggctgcccaaagctgaagcaacatagggcagccagcgatgatcgctcccgcgtcagtcttcgtgcacgcctcacagagggcacggtacgtggctgctagcacagcagaaccccagctccattgcagcacgtcctgtggctgagcatccgcgatggaccgtgcgtagtggaccagccggaagtccacagcgtgcccgtgggtgctagtgaacatcacccacccgaacaaccacaacatgtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaacaacaccgtccacgggaccaactggtgctcccgccagcagtagcccgagcaggtacgacacgtcctgcagtgtcggagccatctcccccagggaaggtggaacgtgtgcgtctcaggtctccagcggtctaccagagcggcaaggagtgaccggtctgcatcccaccgcttcgctgggtcacggtcaatacttctcctacccaccgttctccaagtgagcaatanccagcgacatacccagctgacgatcatgtctaacgcaaacgttgggcctcatacgcatcactgcaatgtgcactctctctaagaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttcctttatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccttgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaagaaccttctgttgcacgactcactacaactgatactgacattgtgtagacttcttggtatattctaaatcctctcaacaaccaactataaattgactgaaatgttttctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtatgttacattctccagatcaaactaaactacatcttacaattaacactactgtctatgtctcaattcatacaattatattctatgctctggatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagtagggcttcgccgctccccttctgctgccctctcctctctctctttcattttttttggatttttagtgaatataatgaaatttcagagaggggggactgggctttataggggggaggc

SEQ ID NO: 25336 - DNA, 19673 bp, Oryza sativa
aatcgccctcccagagggcggtaggcgactacttccgtcaattttcaaaatggaaaattatttttgtaaaacttttaataaaaaaaattaaaaataaaaaaaattcgccgatagaggtggccatgcgtggcccaggcggacggacgggcgcgcagcccatgtgtggctcgtgggcttttccggcccagcccatctaggccaggccaggccagttcgcttgctaacgcacaaacacggcggcgctggcaaagcggcgggtggtcgtcgcgcgtgagtccgtgacgttgacacgacgcgacgctacagtatggtttgcgaaagcatgcaattagcgcatgattatgttttgtaatggagtggttttaataatgcgaatagtaacaatatactccctccgtctcctaaatgtttgacgccgttgacttttttaaacatgtttgaccgttcgtcttattcaaaaaatttaagaaattattaattcttttcctatcatttaattcattgttaaatataattttatgtatatatatagttttacgtattttacaagagtttttgaataagacgaacgatcagccatgtttaaaaaaagttaacggcgtcaaatatttagggacgggggaagtatttaaaaccatagtactaccttcatcctactagaataaaagaaattttcgagttaaacgttattattaagaaagtagatagaattaaatgagcaaatattgtgattggtagataaataaatatatgtgagaaaattgaatggtgaaaggttgtgcttgattaggaaaagaatgttggtgaataaattactccctccgtcccataatataagggattttgactttttgcttgcactgtttgaccactcgtcttattaaaaaaaatttgtacaaatttaaaaaacgaaaagttgtgtttaaagttctttggataataaagtaagtcacaaataaaataaataataattctaaatttttttaaataagatgaacggttaaacagtacaagaaaaaagtcaaaatcccttatattatgagacggagggagtattatttttcaaaacaaattctgtgtgtaatagtggccgtgtttagttccaaaataattcttcaaacttccaacttttccatcacatcaaaactttcctacacacataaacttccaacttttccatcacatcgtttcaattttaaccaaacttccaattttgatgtgaactaaacacagccatttcggaaggggggagtagttataatagcatggatcaattaatcttaggctgtgttttgtaacatcctgaaaatgtgtcattttctaatattgcatcatactgattcttatgttcttaataactttctaaacctaggaaaatataattagcgggacctcctaaaactaacttgcataaaaacctctatgctatttaacatcttttgtgcttttcatttaaaaacatatttggtatttcttgttggaactctattttcgaatattaaactttctttcgactaaaactcttttattcaaatttagtttgaaaaccatttttactattatgaattatggtccaagaaatcctccaattttgcccttgaacctaaaccaaagtaattccaatctcattggaattaattgttagcccgtcctttgattttaaacccatcctttgattctcgatccaaatatccaaattcctccttttgatctagtcaccaatttaatctctgtggcttaatttcctcttcggcacaagaattgtattattttttttgactgaacacaagaattgtattattgcaaatattgtgaataattgctcttgtgctaagaaaattccaacttatactcttcattcaattttcccttttagctacaaatatacataataccaattttagaataggtatcctatttattgtcttcaactaattcccttctatatattcccaaaaatattttgaggaatattattaatttcccttcctatttaagtgcttccaaataaattccctcaaactccacctctaaatattgcacccaaataaattaggaaatctcttttgtgaattctttccgaattcaaattctttgcaaaacctagttatccaaatcaagtattcaaattagacttctttctttttgtcatcgggccaaaatttcctttccttcttcccttggcccatctctcccctcagcccaaataagccgaaccgccttcctcctgcaggtgcgcgcgcacgccgccgcaaactcccttccgtcgccgctaagaaaacgaagccggcgctgtctccttctcctccactccaccggcgtcgtgaccctccttgccgtcctcctccaaaccgacttccaccgcctataaatagccggccatccctccccttctcaacatataaaccaagcaatggcggaggacggaaaaaaaaacaaggtgtggctcatatggaataacgcgagagtgaaaacccaacaagaataaggaaataaacaatctcaattgcacgatatcggaaaaaaaacaaggtgtggctcatatggactagcgcgagagtgaaaacccaacaagaataaggaaacaaacaatatgaattacacgatatagtacgacaaaatattacgtcaataagcgtatgttaagcatggcagcaaccattgatcgtaatccattgtccatttgcaaacaagcataaataaaagagtatgcattgaagaatacttaaagtaatgaagtatttttattttgggaatacaagtaaacgctgaagtgcagcaagtgctaaacgctgctctctccctgcttggttgcttgccgcgcggtgccggtgccgttcccagccgcagcccgcaccagtgccgcccgcgcgcctcctgttgctgccgaccgtccaacagcatcggcaacgccacgcttaatgcatacgagtactgagtggcccagccgtccaatagcaacggcaacaccgtgctgcgcctgcgcccttacgctcgtggaggggtaccggcggccggagcgaggtatggcgagcgccagacctcgccataccgagcgctccgccactgaaaccaagctctctctctctctctctcttctcatgaccggccattgccgccactggccgatctcctcttccacagctctgcaagccaagtccttgcgccatcatgtttgcctcgacgaggtgaacccatttttcccttttcccctctcttttagccaccacaacaagccaccaccgccactccttttgttgccacggtcgagctcttgtcgtcgccgttccggccttctccttcactctctccgccagccaccgccctcccaggatgcgtggtgctcgggaacaccaccctccgccggcttcgccatcttccagccgccggaaaaccggcgcccctcctctccttctcctctgctgctcgtgctggaaagaggagaaaagaaggaagagacgagaggaagaagaaggagaaaaagaaaaagaaaagatactgacaggtgggcccctgcacagtactatttcgcattttctctatttaactcaaaatccaatctttagaagcccatctctcctaaaccgtagatccgattctagtgaaatttggacctaaattcatctaagttcaaactcttcattttcataccaaatttgctattttaagattttatttgaatttccttaatttattcaaataccatttgaataaatatttgatttaatcttataattgaatttacaacttaaacttatatttgcttttcaaatattttcttttatctccaaaataccctttagccactaaaaagccgccggttggaactttacgccttccatggggacgttcgcgcggtctacggacctcaacgtcggaccgttggttgtaaagcccggcaaaaaccaaacccaaggccgaagtgctgctcctggcaccccacgccttgatgcgtatagcggtcggagcttcactatcctctcgacctccattgcacgccgcacagttagctctcgagctctgtgtgatcctagccgctccgccgccactcacggttgtcggagtaacacttccaccccactaaacctgcatcacctcctattcttctagccgatatgttgtctatcgacaccggctagaaatgataccaaatctagtcgttatgctgtccaactctagcaacgactagcaaacacctaaaaccctagccgatatttatcctacctcgatatcggcctaaacaactaaaccctagccactattctacaaaagcccaaccttgacccatattatccacatacctatttaaccatatcaactatccagtatatttcctatcatccaaatcacgagagccttcacataaaatataagcaacattagttgcttgattccctttttaccttagcctccaaccctctagaacctccacttaaaatattagcccagtaatccctatgccctacaaaagagataggttataccttaaaccctagccctcttaagctgtttatcgttttcttattattttatggcttttattgaatttggttcttcctctttctcagtagagtttattgtcttttggatggcaaactttggtatttcgagaatcggataatcaggttgcctatcttggatttatttgcgttggagcaaggcaagttattattcctcccctttgagcataatgatcatatattcttatatatctattctatgcattagtcatacatgatttcaaatgcataacctgaacatagcaaattagatatgatagcttttgcttagcccttcctagttagactgcataaaatataatgaacttagattgggacagtacggtagaaatggttgatttccgggtggctagtactgttccaaccgacataagactgccaagtacatgtgaagaacatacgagtacgaccgcaattctcgtatgggcatagacctagctgattaagttatctagcaaaggtggtacctctgtgtagtggttcttatttaagtcctcgcgcaggaggcaaatttattccgcgaagggcaatattgtgatatttaccgtggcgcaggtaaatatttgtttgagataaattatgatgtcatatgacttgtttgtgaaccctgattgcgatgacatggtgtcatacaatcagatctctctaaagaccccggaaatgccagaactcctctcgctgctgataatgttacgttcagagcgtatggggattatagttcatggaacaggtaccactgatgttagtaaccgaaaagctttgtaatgacaaggctaatgtgtttggcacgtcatgtattgcgggtaaagcgtatatctactgcagtatgaatatcctcaaaactattcgagtagccgtgctcgcggttatcgggcattgggactcactatggcatcttggatagaaacctaattcgaaattttattaaatactgatgcatttaaaacattacaggttttctacttctacattctctgctttctgcaagtaaatctagctctatacagatattacccctcatgcattcattgttgaataatataatagcttgctgagtacgttgtactcacccttgcttcaacccctctttttcagagtctatttggagtttttgtcgaagctgggagttcaattacataagttagttccctttaaaactagtcttcaagtctagtataattagacggtttaattctatagtaaaacggcagaattgggtcatagtatagcttctgttgtaataggtagccacaaatttgtaaatgccctattattttatataaatatatctcctttggagtcttgaccaaatttatgcgataaagatccaaattgttgaacctgtatcaatctactgattcagggcttgatacagttaaatatgtcggtttctgaatcgttagttttgggacccgacatgtttagttcacactaaaattggaagtctggctgaaattggaacgatgtgatagaaaagttgaaagtttgtgtgtgtaggaaagttttgatgtgatggaaaagtttaaagtttgaagaaaaactttggaaggtcgtgtttagttcaccccaaactttcaactttctatcacatcacataacatccaaaactttattacacacataaactctttttttttctaaacttctaacttttcctaaacttttaatttttttcaggagctaaacacagccttagggcattaaagtcggaggatgagtccgacgacgctgacatgagctagcaaacgcatgagtgtttctgcctgtagcctgtaggctgtacggctgtgttcgtttgggatggttgggaaccaaactcctccgcacggaaaacggagcaatccattagcatatgattaattaagtattagctcatttttttaaaaaatggaacaatataatttttttaaacaacttttgtatagaaactttttacaaaaaatgcactaaaatagtagtttgaaaagcgtgcacgtaaaaaatgagaagggagagttgggaacaaggggaaacgaactgagccgtacccagctttggcgttggcgcaaacccattcgaccgcgttgctctcggttctgccaaagatgcggttaataatttactactctctctgtcttaaaaaaaagacaaaccctaagttaacgtgtccaacgtccatcttatataaaattcttttataattaatattttcattgttgttagatgataaaacatgattaatattttatgcgtgactcgtttttttaatattttttataattttttaaataagactaacgatcaaacgttagatacgaaaatttagggtttgtttttttaacggagggaggacattactccttggtgcagcctttgcagacgtgcagtatatcgattgacatctcttcatctacgctctccttgtttttcttcactgcagcagtacatggggccagtttagttccaaaaattttccccttcacccatcatatcgaatttttggacacatgtatggagcattaaatgtggacaaaaagaaaaaccaattgcacagtttagctataaatcgagagacgaatcttttgagcctaattaggccatgattagccataagtgctacagtaacctacatgtgctaatgacggcttaagtaggctcaaaagattcgtctcgcggtttccaggcgagttctgaaattagtttttttattcgtgtccgaaaaacccttccaacatccggtcaaacgtctgatgtgacacccaaaaatatttttttccccaactaaacacacccatgatgcagagctgcaggcgtgtcgcgtgttactgcccagcctagctcgatctgtagcacgtggccggcgttgcatgccgccgtactggttgcatcggtacatcctgactcctgagtcccttttttttttttttgagaaccacatcctgagtcctggaccttcacatgcatgctcacacgaaccgatcttttctcgttcaattcctccacgaaaaacttctcaaaagaagaaaataaagaaaaaaacaaacaaaatctgcatgatgttgaagcaccgcgggtgtactctacgtgttgcattgatatccgggtttatcgaatcgttttaaatggggttaccattatcctaggtttcggtggttaccatggtagccgtacggttatcgtgagatatactgtagttctataaactaagaagattattacacccgcggttttgtaaacctgccatggtcctcatcggtaaccctacagctttagttgatcagtcaaagttggcctttttagtttagcataatcagtcctaaaaagttgtccagaaagatcggatccactaccaatagctggtgcttatttagcccaataagctaaccgatgggtttagtgttgaatatcagtctcagcaacagcaaaccgatgaggtcccatgacttctcacactgctcctcttctgacattcacaagctctcattcaatttgtgcataatgggggtgcaagatatgtaaaaagaactgtactcctgctgctattttgtctgcataagtcataggctgttgccacctcgcagtgcgccgtttcatgatcatgaacatactgccgatgcgtgcacccggccccatgttccaacaatatcttgccctcggattttcacggaaaatttccaacgaaacggttgattaatttcgttcttttatatgaatcaactgcaaaaaggtgttcccaattaccataactaggggggccacacatttgcattatcatggacttaattatctctgtaatgtaactccgttttacttttgaatttttcctaattaaactaaaaataagtttaatcaagattataaaaaaagaaaaattggcaaaatctaaaacatcaaattagtctcattacaatttaacatgaacgcattccagtaaaatatttgttttgtatttaatttgtctcattacaatttaacataaacatattccaataaaatatttgttttgtgtttaaaatactactgtgttattttataatcttaatcatatagtaatttaaaatggagggagtaataatatataataataaagcactgatgagcatttgcttcgcacaacgcaacataccaaaacccaaattaattcattaattaactctgaccgatcgaaatcgatcacagcgcgcgtatatatatagtacaagcgaaaccaccaaaataatttggcaatacatatatcacgcgcccaattcagcacacctggcacgacgacgatacatacatgcatacatacaatcaattcaagcccaaattacccccaaaacgttacccattaattaattaactgcacgcactcaaatcatgattaatcgtagccgtacacgtactcatccccatccatccatccatccatcggacggccagcaagcatcgatcacagatctcgatgagatctcaggcgtcgcggtcgcggtggcactcgggcgacatggcggggtagcgttcgcggtcgtcgcagtagttgtagatggtgtgcgtcttgcggacccaggcgaggcggcggtactggtcggcgtcgaggtcgcggaactccggctggtcccaccaccgggcgccctgggtggcgcagtaccgggcctccgccgacgcctcgcagccatcgacgtggaagccccggtaggaggcgacgaacggcgcccgcgaccagtcggtcttctcccgcccgccgcgggtggcccagtcgtcggcgttccacaggctggagtagagcttcatcggctggttgaacgggtaccgcacgcccaggtccttgctgttcttgaacaccctgatcggcgtgtcgtccacgaagaacctgcatatattgatagatcgatacattcagatttcagaacgtacgtatgaagtttacaggattttcatgtgctccctccgtttcagattacaagttgctttgatttttattaaaatcaaactgctctcgtttcatcgtcgttttgacttcgatggaagttaaaatgttctaagtttaatcaagtttgtagaaaaaaaatagtaacattttcaacccaacacaaatatattatgaagatgtatttaaattgtagacttaataaaattaatttgctactgtaaatattactatatttgtttacaaacttgatcaaatttaaagtagtttgacttttaaacaacttataatatgaaacggatgaggtagattttagatctgtttgagatagctgtacattttttcataacattttgtgtgtataaattgatgggaaataattaacctgcacatgtatatatatacatttagaacgtatgaattttactggatttttatgtagattctagacccgactgagacagctaaaattggttcataaatgggtaatctataattttctataacaaaacttatgtgtataaataaatgagttaactactataaaaaaaattaaggaaatgttgcagaaatgtattacaagaaaaaaaaattatatagaaataaaaacttgcactggaaaatctgaaatttagaaatataatagggctatcataggattttactggaacacaggaaatacatagtattttcatcaagtagtagtaggagtagtaatttcagttaatactactactactagcttttaatttattgcggtttgctttcaataaactgttagcgcacagcggctatccgcttcttgttcgcactgtgcaacgctgtagcatcggcgcgtgtcagcgtgtgggccccaccgccgaccgacccatccctgcttttcatgttctttctgaactctgctggtcagggacgacatgtacacgcgcgccaaaatcaattgcacatgcgcgccaatctctcgtctcaccgtgcaggtaccttttgctttgctcatctttacggtggattcaaagcatcttagtactactgacaccgcactaattactcttactactttcatcccagtctaaggcaggattagacccatcctacctggctacattttgaggaaaaaaaaagagaaaatcattctgctaatgtaatactctcccgggctataatatactcatatactagtttcaaagttttttttcaaacttccaactttccatcacatcgaacctttcatacaacacacaaccttttagtcacatcgtctccaatttcaatcaaattttaaactttgggccaatctaaacacagcataattctacaactctatttgtcttaaaatatactgtctgtattttaatatataatacattttttataacgtttgactattcattttattcaaattttttatgcaaatatgaaaatatttatgtcatacttaaaatcacaataaaataaatgataattacataatttttttataagacgaatgatcaaacgttagataaaaaattaacgacattataaagatattataaaatattttaatactacgaatctcaaagtttaccagagttgatagttgtagattgtgcttccttatttttattttcttcggaaaatgagggagtacaatgcaagtaaataagtgggggtgttaatgaggggtaattagcgtacgcgatcatgtagaggttccagaggacggagtaggagtggtagtccttggtggggtcgaaccagaggtagatcctctgctcccggtcccccttcccgccggagaagacgttcgtctgcaggatgtacggctcccccgtcctgttccccaggaactcgaagtcgatctcgtcgtgctccgagttctgcgacgacagctgcaaattccccaatgcaaaaaaaccacacatcatcgatctccgatcaagaagcagaaggggaagaggatcagggagcaatggcggcggcgtacgtagaaggcggtgacggtgccggcggagtcgccggcgacgagcttgatgtgcatgctgaagtggccgaagaggtaggagccccgggtctggaagccggtgccggtggacttgtcgaggtagagctgcacctcgcgcccgccgtccacgtagtggatgtggtcctccgcccacgtcggcacgtagttcttctcgaacgccacgtccaccggcttccgcggcgccgccgcctcgccgccacccagcagcagcaccgacattgccaccaccatcgccgccgccgtcgtcgtcgccatgttggtggtgagtggtggttgtgtgtgctccgagcagaggagctcgcgagtatttataggggctctgctcttctcggcttccgttttctgattatcttttgctaattaataatccacctgttcctcttctagacgctacagtgaactgtgaagctaactagagcaagtttaatagtactgccaattgtaggctacaaatcaactatagtcaatttaatagttaatttatataatagttatcaataaacatgttatgcataattaatgtctgttcccacgtatgatacacacatgcatcttgtggtccgtgctgtagctggctataaatctatagcccgctgctcttatctcttttcttttatatgcttaaaatatgtttatagtcagcttatagtctactattgtacatgctcttagacgaagagtgtgtgatttgggataaaatttcttttaactttcttatttctcatcaacacgtttttcggtgtgttttaaaaaagtatataaatagaagttgtttagaaattcaaataaatcaatgttttcagtttgaaaaatatcctccaacggacacttgaggactgaaagaaatcttaaccattgatttatagttactacataagagagcttttttctcatattaatagttgctggtaatatacatagattagtaactactacagtaaagaccatggtgaaacatccgttaaataaaagttgttaattaagtactcgtgattagctagctgatgaccaagttgtaaccatgtaataacgggtgagtgagtgagtgacagagtgatcgagcaagttcatagcagctgctgcgccagctgcggccagaccaccacatgggtgcactgacgagcctgtgaggcgaaggttttgtcttgtgcgtcgtgtcaggttggcctagtggtgagatgcatgatgcatgggagcagtatcaagctgacgccatgggattatattgaatttaatctgaatcatgcattgcatacttttatattagatatatcagcacacaagttgggggcattcttgcagaggatgtttatgtaggcgtctcgaacatgaagttattaacaaaaagtgcttatatatatgtttcttgatagtgtgtgtatatatatactactactactaactacaccgtagtgtacgtgttgtgtgcgctgtcacaactcacaagaagcttctaagcacgcacgaacgcatcagcatcaatgctccatgaaatttgtggtacaagtgattagcgcagtagtatatattactgcatgagtgtgtttgtttggttggttaatctttcagtaattgaaaagtgatttgctcgcggggagtactagtatatatattggtggcagcttaattaagttgcaaaacttttttggtcagtcgctggccaaaatgttcctgtctggtagtatatcggcgatgaatggagctagctagctagctacaaccacacgctgtagtggtgtacagtaggtcagtagcagtgctacagtggaagcgcgtgtagtgaggccagttcagtgcagtgcagtgtgcaggcaggtcggtgaccggaccggacaggaatgaatgctgtggccgggggttcacatgggcggtgaactcgcatcgctatcaggagccgtccctacgtacgtgtaccgcccggggatacatcgagctaggccgtgtttacttcctccaaatttccaaatttccatcgcatcgaaaacttttctacacatataaactatcaactttttcttcaaactactaactttctcccaacttcctaacttttctaccatctaaacacagccatagtatatccaagtcctaatgcctcaacgctcgctacgtaccgacatgaacaacgtcgccgactgtccggtgattttgaggttctctaaaccttaaatttaaagtcgattttgaggttttcttttagaagtttattttttagcgtttgctttaaatggttaagaacaagtatgtaaaattttattcacaaattatttttcgtttacaaataggcttatttcatgaatatgccaaatgatggggctgctcagcttttccatcaagtctatttttcaatcttttcttccaaactatgataaacgatttacttataattttttttaccttggtttattttttttcagcttattagcggtagtttaactgatcaaaagttatataattctatatgacttaaaaggagataacaagtttaaggctaagctgataacgagcacgtaaaacaaggtgtgttattagcaaagtaattaattaagtattagcggttgctgcccgcggcggcgtcggccgcgccgatgctgcccgtggcggcgtcggctgcgccgttgcaatccgcgacgtcgtcgatggtgcagatgtgtcatgcaatggcgtggatgtgactcggatgatctcctcttcttcaaccttctccatcgagttaccaagacagcatgttcttcaccaccatcttcggattaagtctttggttggctggatttggggaaattcttcctctttgtctcttggcagcaataaccatgcagggtttatcgttcgggttgagcccagattggatttgcaatcttggtttacaggtttacagtccgagctcctcagattcaacgatgaactccgtggaaatattttgcggagtccggtgatgctcacaccaaaatctacggcttcgcaacaaacctctcgtatgtgtcgtttccgtggaggcagccgaaggggtttaccggttcgtcaagcagagtacacatcaatagaggcccttggatgcaatcgtcgcggcattgccgcagtaccctgtcgatttgctccttctttgctgcttagtttcattaggaagtttgcttcctattttcagttgatctctcttattaaagatggtacaactcttatgtttatcatggacgatgtatttgggaattcaattcccctaaatgctgtcgtttaataaagcgtgttatgttttaaaaaaaaagtattagctgttgcaaactcaaaaataattaatatgcatgatattaattcaaagaaacttttagatagacttttttagaaaaaaatacgccatttaatacttcaggaagcgtgctcatgagatacgaggggagatttttgccgactctgctgtgccgaacagagcatagggctcaaattcaaagactatagtgtctccggccggcaccaatgctaattattttgggcatcaatacgatcctcaagatatactatctccttcccatcgtcgctttgactttttctggaacatttgaccattcatttttttttaaaaatagtgtaaatataaaaaataataaatcaaatttaaagtacttttgataataaaacaaatcacaaacaaaataaataatagtttcaagtatttttttaataagacaaataatcaaacattacaaacaaaaacttaaagcgtcaagtaatatgggatggaagtagtagttttctacaactaactgtaactgtatgtacaaatttaacaaaaaatatagtgcatatgttaatttatattgtattccctcagtcccataatataagggattggatgtgacacattctagtatgtcacatctactcaaaatatcttatactcccttcatctacttttgatagtcatatttccaaatctgaaaattttatttttgataggcatatttcaatctaacaacttattatcttaatgactttcttggatttaatgcatgactcttcattcttccacacaagattggttgcatgagcatcgagaaatgtaaatattaatgaatcgcttgtttacgaggaatgactagtagcatatttaaatggatgataagtagaatcacttatccttggtctgtgtgtcaagatgaaatatgactatcaaaagtagatggagggagtattatgggacggagggagtatatatcttccttttcccttatgttagtttattttctgaaaccgaaagtaatattgtctctacgtgcgccgtagctagtaaacgtggcctcctactaaccgttgcaagcagaattaactaccagtgctaactgccaccaagaagagtataagccatgcgcccatgtgcaatagtttttggggccagagatgaacaaaaaaaaaagaagaaaaatgccggtttggtacaacatgccgaggcgcacgtatataacgttatggcatgaatggcgcggctgacgagcgaggatgtcggggagcatatttatttatttattaacccttagcatcgatattaagttaaacaaaagaagctaattaagcaaccctccattcacaaatactaagctagcactttaggatattgacattaaggacaccaacaatgtatatagatgaagtggtcaggtggtattagttgttgcaaaccccacacaatgtatatggatatggtaggaagtaggaaataaggtgggtcctacgagtaaaaggcaggagagaggagacagtagtaggatggagaatacatatgtttttttttatttcttatgggtggtctttatacctaagggtagcccatcataatgtcacctagaactactcctactgtgtataatacccaccctaaaggcttaagacccaccttatagcatacattgtggatgtcctaatatgccacattgaccagtaaccaataatactatatataaagacaagttattttaaatggaaattttgtaataatttatttcacaatatatatctagcattatcatttttatacacttttttgttactggttggagttaaataaaattgaccgagataaacttatttgaaggtggaaccaacgggtcattaaccaaatccaaaatgtccattatctacacgtagtactaactaatgaggcgatgccacatgctgagagcctcattggttggcttaataattaagccaaatcaaaagttgaaattttaattttcaaacttaattttatagttgattttaagatattttcaatgtaaatcttttccttggtttttaaatcgctacgaataaatatataaaaaaatttattcataaatcagtttttattctctaataaactttgtgacttattagggaatatgggcaatgagtaattacagttatctgcgacggtaacacagatacatggtcccagttaggggcgattgatgtgctgttggatgatgacgatagagaggtgtcaagatacgaattgaccggcacatgttgtcggtccggcaggccccatgttacccattggacctatgttttctcctcctcaaattttaatttctttctctccaaatcaccaaaccagactccatccgtccactatttttcatgcccaacattaactgtccatcttatttaattttttaaaaaacttaaaagtatactccctccgtcctaaaaaaagacaaaccctggtttccgtgtccaacgtttgaccgttcgtcttatttgaaaaaattatgaaaaaaattaaaaagacaagtcacgtataaagtattaatcatgttttatcatctaacaacaatgaaaatactaattataaaaaaaattcatataagacggacagtcaaacgttggcacgggaacccgcggtttgtcttttttaggacggagggagtaagtcacatataaagtactattcatattttatcatcttataacaataaaaatgctaatttaaataaaatttaaataaaacgaacgatcgaagttgtatacgaaaacttatggttgcacttataatgaaacggagggagtatctatcaatgtaactaacattatgtataaatataattaagcacatgcttgcatgtgttctctttgtttgttcgcgccgatggcgctatcagttcctcgttagggtaaatccacgtgcgtctgcctgagccgttggatcgaaaaggagttaagagtatgccacaactaattacatactccccaatgaataagaaaggctgtccaaatttaaatcaattgattatctgttaaaatcctacatgaactatgggtgtgtttagataatgggaaatgagaggtgggattgagattgggaaatgaatgaagggttaggattaaatgaaagggggagaatgaatggttaggatttaaagatgtctattggtgggtgggaaatcattttcctatcccatttgccaaacatggcctatatgatatagaatgacaatatcaatttcattgtttcctcttcgacttatcaaccgtaacaaaaaaattaaatcttaaaacaaaatcttagagttgattttaacgtttttctcatgctaagttgtttttcaggtttggctttcaatacactaagaaacatacatataaattacttattccattgcttatatgacatgtccgtacgcaatcagctgtgtcgagacatgtcgtctagaattaaatttcattttccttttatttatcgaagagagacgcaagaacatctccacatttccattagaatgaaaaacaatagttcagagcagagaattaaagttaataaaaatgtcaaaaaaaaattacacccgcttattacagtacattgattaaagtctttaaaagggccccacgcagcagtcaaaaggagatccatcatcatccagcaaacaacgcgatctaacctgtcctgcaaacacctgaaaaaagcagggggaatcctgcatatgcatgcatgcatcgctatcttcttactgttcatgcagcatccatccacttgcttggaataatcacatcattacatacagctagctaccattttttttttgttttttagtctgcatatttgtccaggataatccattcataatagcataccccatgtaaagccacatttgcatccatgcatagaagcttgtttcgtgaagaaaaaatgcatttgtttgtaccacagggaaaattgaatcaaagaaaaattttcaagagatcaaacctagcatcttgcttttttttttcttaatatggaattgaccatagtaatgtaggggctagctgtatggttgagtacttcaatttacccaagcttgctataatttttttttgactaactagcctaaggtttggttaacaaaattagagcgacactttagctagcatgactatacgtacttgccacacttgtttttatctcaatggcatatggggtctacatagtgaagaagaaatttggtcataagtgtggctatgaaccaaataggcatctagctcggttaaacttatgtaacttgaggtgtggtaaccttatacaagttatgtgtcaaaccaacagcccctactcatataaattttttttccatatgaaccaatggggcctctgggaaaaatactaagcaaattgaatgctccaaaaaatatttgccattcttgcatttcaaaatgaaccattaaactaaactttaaatggaagttcatctagcatcctagaaagaattataggaacaactgaacgaacaagcattgcatgaatattttgaaatgtggaaattttatagaattatcacaagattcagttcagttcctttaaaaatcttcaaaactcctccgtttcaaaccaaggccatagatccacatcttaaaaggaacattcacatcttaaaaggaactttgaatgggtagatcttctacgcatgatgctcgggagctgtcttatcccttgtatgtcaagttttaaaaccggccttagctatatatatttttaaagataatgaaaatactcccaccgtttcataatatagcaacttacttaattaggactggatgaaatattttatagtcttattcagattcattgtactattaaatatttcatttggttcggttattatattataaaacgaatgaaaataatttacttcctctgtttcatattataagattttctagtattgtttacattcatatatatgttgcctagatttattaacatatactctttccatccctaaatgtttgacgccattgacttttttaaacatgt

SEQ ID NO: 25337 - DNA, 1862 bp, Oryza sativa
gtttaaaaaagtcaacgacgctaaacatttagggaataagggagtatatgaatgtgggtagtgctagatcttataacctgaaacggtggaagtagtacagctctatcggtctatttgcccggaagcatcatgattcgatcgttgattgacatgatgttaataaaacggaagatcgaggttggttcgatcgatgcctcgatgggatgagcaggcaggtcccagcggccacgtgctcgcacgcacgtcatggtactaactgtacgctaatttggtatccaaatcatcaacagcgtcatggaccagtgatgcaggcagcttcatggctgcagcctgcaggcagatcatcaccactgatctatccaaccgagtgggcctaaggctgtgtttagatctaaagtttggatccaaacttcagtctttttccatcacatcaacctgttatacacacacaacttttcagtcatatcatctccaattacaatcaaaatccaaactttgcgctgaactaaacacagcctaaataaatctcttgatccatccgcatgaagatttttctagataataaaacaagaaaaagactatgcgcactaactttttcttactgaattcttaactgatgtcgtaataaaatccgcctttttctttcaagaacttacatgaccgatgtttgaaactaattaagataaaagattaagtaagtgtacgaaaaaataagaaagatattagcgtatgattaattaagttttaattattacaaatttaaaaaatatatttatttaatattttagagcgacttctatatacaaagtttctacacaatatgtattatttagcagtttcaagaacgtgttaatgaaaatcgaggtagaaatctacatctatttctattggttaacaaatagaaatataaatccaggaatcgaggatgcaaagactaataactccaacactttcaaattttttctattatttatcttaagtctatttgtaaatctaaatcccatatcggcatatatccgtatatatgttaatgaacccatcaccaatatatataagcatgatctcatgggcgcggtgccgatgcatgcatattccacaattcgatcatggttccatgcagcatatatatcattgatgccatttcattattgagtggatccatcgtcgatccatccatgatacatacgatgatgagaagttattagcagttaattctcatcatctcgtgatgccggtgcatggccagccaacgcataatgcaaatccccatccatcgatccatccatcaattgtgtccagccagctgggtcgtctctcaatcaccggacaactgctcatgggatcatcttatggctggaaaacaataagatcccccaacaaaaaccaaacaaaaaagaggaagaaaaactaatggctccggtgagtcggcaatgcacatcgatctcgtccagtctcacgagacaatgttcgatcaggtgtgagaatgacgagccagcgacagacagatcaaactagggatacatagttcccggagtagtagcctgccattctatcccgaatttgatcggtgagcatggatgcaagtttgatcgagacagtgtgaagttaagaatctaagttaattacagaaggaaagaaatgaccagtcggcaaatgatttttgcaacttgaataagtaaaatttgaccttatattcttgcgaaggtgatatatttcatattaatctatcttattattttatcaaaaaaatttaataactatttaaatttcatgtatgaaacgagagatgctttctcgagcaacaaaataattaatctctcccacatatatgtatcaatggggcatcgactaccgacatgaac

SEQ ID NO: 25338 - DNA, 1591 bp, Oryza sativa
tagaaaacttcgaaaggtggccacgcccattgcagccatggaagcggtgatccacgggcgccagccttgggaagggcttctacacggacacggtggcagcatgcgggctcgagaacagcggatccaccgtcggcaggatcgggagcaccaaatccgtcctcgtgcgtggtagagaggaggcggaaggagccacggcgaccacgaccacgacagtggcgtgcatgttctagagcattggatccgccgccagcgtgctcgggaagggcggatctgccaccggcaggctcgggagcgacagatccaccctcacgcatgatggagaggaggcatatggctgtagtggcgacgcctgacgacggcgacctagggttttggatttcttttattattattattattatttcaaagtatcattgcagtcgggcatccttatttggttgcctgcaaaaatcgggtctttaaaagtggtctccttaggacgctcatctgcaaaaatggtttctcacatgcggttgtgatgaccacatgtgaaaatgctgatttttgcatgtgaccgccgccgggccaccgcccgtccctgcgtcaccgtgcacgccttgcaactaagggcgtgtttggttgcctggaccgcacttggcccgcatctggcgtgcaacctgcaggttgtttggttgcttggacgggggactcagccaggcccagcagatgcaaaaaggcccgtcgagccaggctgggggaaacgaccaattcgagcttcgctgggcggcctggctcgtggcgtgcagcgacaaggcacgaggctgcacccgcgcatgcagacagaaagagatggggtcaccgcgcgctgccttgactcctcaagagcttctccctcttcctcattttttcacagtgaaaaaaaagctagggttttgggctactcgtcgtgaacctcaccgcgcccatcctccgtcgccaggcggatgtgagcgccggctccctccgtcgccgggggtgagcgccggctccctccttcgccggctgctcctctccccccgtcgccggctgctcgtcttcccttcttctccttttagcccccttcttccttacgccctctcctcttcagctctctgcgtcgagatcttaggtaagtgcaaggatggtattcctcttccctttccaacctccttcaatttcgtctccactctttctttgatttctttgtttggatggatgcacatctgcacatgtccccttcataaaaaagtagatctactaaaatgtgatgtattttaggttgatttgggtgcaaggaaatgttgcataggcctggattttgttatatatgtttgcaatgttatgtactgttggtatattttctagatgtagctgagcatgactaaaaatgtttttctttgtcgatctactcatcaatcatatttgtacacatgaatatttgttaaatcgattgtctcttagctcagatctgcactggttgtttgtgatttgctcattcaagtcagatctatgaccttgttagttgtgcatattactatgcctttttgttatgtccgagcaattttccttggtcgatgatgtgtttgtcactgga

SEQ ID NO: 25339 - DNA, 6837 bp, Oryza sativa
attcctgcagcccagtatgtgtggaagacactaaaaagtggaaaggtagcttatctcactgttatatctatttgatgaggaagtgcatatatgatcgtgttttaactgcaaatttattttctcgggaagtttgaaatgaaaactcagctttctaagagttaattgctaagcattttgtgttatattggatctctaatgatctgcatacagttttaccttattttttgttgaacatgaattgagaatttagaattactaaggtcacagcgcattcatttgtaggttgttcctggcttcggtcatggagttctacgtaagaccgatccacgatatacatgtcagagggagtttgctttgaagtacttgcctgaggatccacttttccaactggttagtctaaaatgtctgtccaactgcatggctctcttgcagtccaactatctcattgggattcttatcgatctatatcctgtcaggtctccaagttgtatgaagttgtgcctccaatcctcactgagcttggcaaggtaatgccactagattgatcatgattgctaccgttttatgtccatcttattggctaaaaagtgacaacattgtccatatttccaggtcaaaaacccatggcctaatgttgatgctcacagtggagttctgctgaaccactttggattatctgaagctcggtatgtttacctgtcctggttaaataatttagtaaccaaatttaatcttgaacccatgatggaatagtaaatgtacttcagaacgagtacttaataaaagcggccatctaattacgcaggtattacaccgtccttttcggagtttcgaggagcataggcataggatcccaggtatatttcttcccttcaactgtctacctctttcttcagatcttgtatcaaccaattctgacttgtgatacattatgtatgacagctcatttgggaccgtgctcttggtctgccgctcgaaagaccgaagagtgtcaccatggagtggctggaaaaccactgcaagaaggctgctgcttgaagctacacacgcctacaccgctgctgttaattcttctaacaattatcatcttggatgttaataactgaggataaactcgaaacgttcagccacattttaatatttttttcccaggccaataactagaggaagatgctctcgatcggctggtacatttttgtagccatcgctgttaggatgctcatatagttaatctgccattgggcaacaatgtgattagtttaagttgcttagagctttatcctttgatgaataactttttcgagccttctaagttagctcgagttaacataccagttgtggattatggcacatttcttcatttcctttctgttgttaaatttacaagtacgattcattttctttcgcctgcgccctacccactggttcatgtccagctatcagcattgtgatgtcctagtggtgcctagttggcttatgatttgctttgtgtcaaactaagtttactaagtgcaataatttacccatctttggctgagtgagtttgaatcagcttctatattttccgtagttttctcaatctactaggcgtaatatttcgcacaaaaaatttatatgtagaagtttttttagaaaagaaaataaatatatttttcaagtttgcaatggttaataatttattaatcactcaccaatgacctttaaatttatgaaacatagtgaaggcacattgaaacatgttgctatcacgtatgatacattgagtattaacgggctaaaatatatatttcttttcatcagaacataatcatgcgatattttgttgtgaagatttaattataacgaatacaacgtacgattagataaatagtttaggagaaaaattattttaaaggttattaaatccatgcatgagagaagagagagtaggagcaagtacgatcggatcgtaaatcggataagtagtttaggagaaaaaattatctgatcggatcgtaaatcggataagtagtttaggagaaaaattatttaaattgatactccccccgtcccaaaataagtacagttttacactattcacgtccaacgtttgaccgctcgtcttatttgaaatttttctatgattaacatttttgttgttagtagatgataaaacataaatagtactttatgtgtgactaactttttttaatatttttataaatttttcaaataagatggatagtcaaacctttaacacggattcctacgagaggattctcgtattgttgtggccctgcagacgaaccgggctttcggcccatcacagcctagtttgtttcgccatcaacaccgactttgactcgcaccacctgcaatgcatatccctcgcgttgcgccacggataaatttccaccgccttcgccttcgcgagatcggatcacggcggcgtcgaccgcatatcggcgctccccgacgacctcatccagcgcatcctccgcttcgcgccggccaacgaggccgcgtccaccgccctgctctcagcgcggtggcgctcgctctggcgctccaccggcgccgtcaacctcgccgtgcgcctccccgagcccgacgacgggcgccgccacggccaccgcgtcagccacgacgccgtctcctcctgccatgacgccttcgtccgctccgcgcaggcggcgctctccgccgccgccgccgcagccggaggccgaggccgccacgtcacgaggctcaccttggaccttcgggcggcgaccatggatgtgatcgacaggttcgtgcacacggagaggccgcttggtgcggacgcggcgcccgacacggacgtgtggctgcggctcagcgacgacgtcgagcgagaggcggacagatgggtgaagaggggagacgtggtccgcgacgtggtctcccacccggcggcgcgccgcgtggaggagctccgcatcagcgccagcgcgccggccgtcgacgacgacgacgacgacggcgaggtcgggcgtctcgtcggggtgttccacctggacctccgctacgtcccgtcggagaccctccgcgtgctggacctctcccggtgcagcggcctgcgcatgccgcccgccgtggaaaccccgcggctgacgacgctgcggctgcaggcctgcgccgtgaacgtgaacgacctgcagcgcgtcatcgacgccgcgccggcgctcgccaccgtgcacctcgactccgtctccttcgacgggatggagcacggctgctaccgcctccgcctcccggcggccaccaccgcgctcgtgctggcgaggtgcaggacggacgcggagccctaccgctaccggagaagcggccgcccactggggaccagctccgtcgagatcgacgcgccggggctccgatcgttcaggtacgcgggctacgcgcggcgcttctccctcgcctcgccgccggacatggcgcgtgccgacctccacttcttccacgacatgtacgcctccgcctccacgagccgcgacctcttctggcgcttcgtccgcagcttccgcggcatcaggtccctcaagctcaaggtgagcgacctcaagcacgtcgccgtcgccggcagggcgacgcgcgccgagctcctcgtcgcgttccccaacgtcgagcacctcgagctggaagggcaccacgaatccgcgagcgagacggccgccgcggtggccatcggcaacctgctccggtgctgccccgccgcgcgccacctcgcgctccacctcgccacggcgccgccgcgcgagcgcgactccgccatgaacggcaggtacggccgcgatctcctgcgagcgagacagcaagccgacctcgccgagtctctcgatcgcttcgctcgccgccgccgacgcaaacccaatcctccgccgccgccgccgccgccgacgccggtgaactccatggacgaacacctgagcatcgtaggattgagtggccgatccttcgcctgcttgaagaactcgctgagaagattcgtaatccagtttcggatggatcgacccaactgcattggcgtcaagctgatcaagttcttcgccgagaacgcgattcacctcgaagagatgcgcatcgacggtggaaatcagaggatgcacgatcacatcaaccacatggttgagggatggatctccgattcatcgtcagcgaaaaagagggcgaatcacgagagttcgcagggtatcgacgcgagtacgccacgctttagattattaccccttgagagacggtgaaattggattgtggtgttagcaagatgtggattgcaattcgataaactattgttaatttggattgtcgaatgttcttgaaattgtagatttggattgcaattcaataaaccattatttctttctaatttatctaagaaaaattataaattacccctgagctattggggtcgatcaaattacccctgagctattgtggtcgatcaaattaccccctaacccgaaaaccaaacattgttcaccttgaacttataatgcatgacaaattaccctggtttatcctaagtggcatacgcgtgaaatccagtcagcactttttttaaaaaaaaacaatgatgagacccacctatcatacctcatcttcccctcttcctctctctttctctctatctcttagggtgtgtttggttgctcgtatgtccctagcctggctcgtatccctcatccaaggtgccctcagcctggataggataatgcaattggctatgtttggttgtccgcatgggtttatcctggatgatatgagatgctgtttggttggttgtatgacaggatgttgtacaatagagatggtgtttggtttgttgattggaccttaggtctgggtgacctcttcttacatatggtaaagttacccccacgaagcacactaacaaaaattttctaagtctgactcttgtgggtgaccatggtgttactatttaagccaagttttcgaaaatctcgttaatttcatatatttgacaattttaaacaactagctgtcagtaatcatgtaattttttaacaagaaggaatcaatgtgaaaatcatgcatattttttaacaagaaggaatcaatgtgaaaatcatgcatgccggtaacctcagctacatatatacaagtattaaaacaaattgatccatctgtgttctctacctctgtacagccgtcgtcgatatcattagcatgtatatctgcgaatattctgaaaaaagtggtaaccatctagctatggaacataaaccataaatttagtcatccagattaaaaaacaaaatcaaagtgaccatctttcccaatctctaacatcaagggaaaaaaaagaacaagtgcagaccaaaaaatcatgcccaggcatgttaacaagttacatggatctgttaacattgatcacaaagagcagtcaagtgccaaacaaaaatctgttaacatggatcacaaagcgcacttaatatcagaattcacaatccatttgtacgcatcacaaatcatcacatttgttctaaatcagttgcacccttcacagcaagaaaaatggcaagtgcaaatagctagaccaagtttgtatctgtaagtcccagtggaggaacaaggataaaacaagtgcagaaggatgaaatttatcatgaagcatagatcatgcaacaataatatggtgatggatcctcctggtttcagtgaggatcaattggaccttgttctaactcatctgactaatgacaaggcagcaagccttgtgtacattcagaagaatgaggctcgccgtgctcgttgggttaagaagttcctagaacagcaccaccctgacagcatctaactatttagctaactattcaggagaggtgacaatggacaccatattttgtatgtaatgatgattaaggtggtagtggacaccatttgttcttttggtaggatagtactcactgcttaaggtggtagtgtgacaccaaattatttacattcggctatgtgatggttaaggtggtagtgggacatcaaattatgtatatttggctatgtggtggttaaggtggtagtggaggtccatcactgagttctccaaatcaggctgcacctccgtatgtgttgtagcgagtattgttgaagccacattgttcacagaatcagtcatgttggtgatgagagcaacttcaccttcagccaaagccggggttctcttcctcttcttatctggattagatcctccagtcggctcatcactagtaggcccaactccactagctcgagcagcagtcccaccaccttcaacaccaacaccacttggtccagcagcaatcacatccccaataatcccatcaagaggtccaagagcactgtcagccatgtctggagggttgccaagggcttcatttgagcccatggcaaatcttcctgtggcttgcccattgccaaagataatttgcatctgtgtatagttctctaaagggacattcagatactcagcatccttagcatggtcctatattatcagaatcattacagttaaagagagaattgaattgtactaatgccacgaattgaacaagtgctagttagacacaaaccttgatataaagcatgtagtgctcctcatctaggacaatcattgacagtgtatcatcccaaagagccccactgatgtctttgagcctagtaatacgcacccaccttgtgcgccatttgcgaagatggttgtacacttgggtcccactaatctcaaacccatagcggtcagagacagttctagcaacttggttaaggtggacttccttgaaacccttgtcagtcttaacaccttgcgctataagctcaaccatacgcctaagcataaag

SEQ ID NO: 25340 - DNA, 1166 bp, Oryza sativa
aaacatcttatagcgtgaaacagatgaggtattacctagttaatctcaaatttattagtatctcgatgatgatatttcacatggaccgatggactacatcaccggaatacaagagcaaagaacctgcatttgatgtttatgcaactttgttgaaagatactccctccgtttcacaatataagtcattttaacatttcccacattcatagtgatattaatgaatctagacatatatatctatctagattcattaataccaatatgaatgtgaaaaatgctaaaatgacttacattgtgaaacgaaggaagtaataaactgccaattcctgcacaggaactgtcagtaccaaacaaaaatggcatactaattaatttgccagggcagaagttttgaaacataaactggaaaaaaaaaacttaatcatttcatcatcgttcgataaggcacctaagaaggataagttatagaccatcaccaggaaagactaacaacacaagcgtataatgaggcacaaaaaaatggtagacaaccaaaaagaacataaggaataggtgctctgcaaattacagaccactacgatgaaatgatagacactagcaagtaaaatatcgaagaactgaaaagggcaatttgtttcttcgactacttaaggctaacagtacttccatctatggtcatgtattagcatatgccaaaaaaaaaaaaagcaccagagaatcctaagacaaagttacaaaagaattattcaaaattggggaggttggacaagttaaggatgctgacagtgagccacaagcaagcccacaagggagcacaaataagagtgacagtggtggccaaatgggccgcactgcacggacacggcccactcagacgtcaacccgagtaaaaatacttccctctcaaagaaacaaaagagtaaaatactcgttcatcttggcgcgcgaccaagaaagcagaattcgccgtcttcgtgcctctgtttggttaggttagaattggaggactgaacaaggtagtcagtctgtgtgtaactttgcactgatgattagtcagagtcttgttgttggctttagtcccacatcggtatttgatgacgggggagcacgacttaaaaggtgggggtggtcttcacccatcaaactagtcttttgggttgtgtagg

SEQ ID NO: 25341 - DNA, 24396 bp, Oryza sativa
  unsure (1)..(24396): unsure at all n locations
cgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggcctagctctcgtactcgccgtcgccgttcctgcacttgatcgccacctggagacctgaacatcaccaaacaattaatcaacgacggtgatatatcgatcgatcgagctgagtacgcaattaattagcgatgaacatattatcatcatcatcatgatatatatacccttgaaagcatcctgccccttcatgttcttgctggagcagtcgccgcacttggccaacccgacgacgatcgccgccgcctcgccgtccgcagcggcggtgacagccatcacgagggcagtgcagacgatggcggcgaagagtagtgctcgtgctacagctgccattgctgataaatcctcgcaaactctatgtagcaagaggctagagctgtgtgtggatgagtgaagaaaaagcaggctatgcatgtggtttatatagatcgataaaggctactagctgggagtgatctgaggtcagctaattatattacaacatgattagcaatttgcgccgaatttgcaggtttaaaatcattaacgccgtgcattttatttgatttgatcagacaccgatcgattaagagtagcagctagtagttcatggaggcactgtgaacattcacactgcatgcagtgctgactgttgatgcacttgccgccgattggtggtgtttaacaaggaaagttaagctttaatcgactggtactcctacagcgcacagtactactagcctgttttataaaaagggagaatagttctatagtataggacagctccaaccaaattgcatgattgatactatttttcagtaaatgagtaaatttcacaaaaactacagatactttgatcaaactattgcaaaactactgatttaaggtgttatatcataaaaactacagatttagtgttaagtttatcacaaaactacagatttaatttgaaatatatggtcacaaagctatagattaagtaacaaaattatcataaaactacaagtttagtgccaatttaatcacaaaactacaacatttatagctcaaacataatggtggtgctatagatttgacctcaaaattttgtagttttgtgataacttcaatgttaaatatataattaattacgtgatacttgaccttaaatatgtaggtttctgataaatttgatgctaaatctgtggttttgtgatagttcgatcaacatatccgccttataaacatatgattggaacacagtcgtgagtgtataagtgcggtgtatgtatttagtggtgactacgtgcatcttgtctgtataatggtagagaatatacttgttgacggtatataatagtttttttaaagtatagaagatgttggtatcaaagtatacgcgagattgccgtaaagtaaacgagagacagagatttttatattgattcaggccccgatgtgggtaatagccataatccagtttatatgaatatctctagaatgtatcaaactgattacaatgggggagcaagctagctaatctagcctaccaacaagcattcaccaagaattaatccaacgacttagaatcatcggctagctattgacttcctcctgattgatattcgatgtgacttgtggctatggcttatgattcgatgctctttgatctctcctaggggctatatatttatacggacaatcaatttcttgttaagtagaattcgaggagttcatatgggatacgagcaggtaagagttttgccagatcctgtagtcagcggtacacgagcataacccaagagtcttagcgatgagattgccgaagctttcaaaaacacttttggcatagatactagggttaaaaagcgtatagatcaaaaactctaccctgaccactattataatgctccatatcctcaagggtttagactgcctcattgtgtaagttcactggagaacatggctgatctactttagaggatatcgaccaatttatttgtcgggtcccaaaattaaaaacttggatccggctgagattaatgtatcaacccctggatcagtaaatattgatacataatatgcaactggttcttcattgcatacgttaaattttacaatactaaggttttacaagaataggtactcacataagtaagactattacatagaggttttatacattctgactagggaggtataacctctagggattttctatgttattggagtcatcgtagtaataatcataggagtcttcttcttgacccaaatctgaaaaaggggttataagagcaagggtgagtattcacaatacccggcaagttaccatggaaacatgttatgtgttggtatagagtagagttctttgcaaaagacaataataaacaatctggaagtattaaagcaagagtttgtaaatacatagactttaggtttctaaccagagtactatatgggtctcggtactcaattccatgagtacggccattcgaatagtttcatgaatattctactacagtagatgtacgctttactcgcagtccacgacttgccaatattcattagcttagtcatgacccagtattaggttattaacaattgtggtacctgttccatgaactctagtcctcatgcgctctgaacgtaacgttatcagcagcgagaggagttctggtgttcccggggtatttaagggggatctcgtatgacaccacgtcatctcgatcagggtttagaattataacataataatttatactcgagtatcatcgaccatttacttgtacatggtaatggtaaaaattgcccttcgtggctatagttgcctcttgctcgaggacttaaaaataagaaccacgatacagaggtaccacattgctaattaatataatgactaggtatgtccctattctagaaactatggtcgtacctgttcgttcgacataagtacctggtaataactatatcgatcgagacagtactagccacccgaaaatcatccaattcctacgtactgtcccaatctaagtatgaaatatttagaccagattgtaagcaaaataagcaatactaaattgtttgggtttctatggttgaattatgcatataaaatagagtattgaatagaaggctataaataaataatttgtaaaatataggcttaaatgatcaaaaggtagaatagtaacttgccttgctcgatgtcctgagattgactgatattatctaatatgtcagaggactcttcaagacctagggttaaacatataaaattcaaattcaaaaggaattcaaataaaatccaaaaataggaaaaataaaataaaatagaaaaatagcaaaagtagactcaaaagatagagaatgattttagaagaattttggtccaagtttcactggaattggatctatattttaaaagatatgagcttctaaagtttgaaaatcaaattaaatgtgaaatgatactgtgtgcgggtcccacctgtcagtctctttctctcttctcttcttcaacctctagccgttccccatttacggccggcggtgctagggttagcgatttcggcggtgatagagggggaaagggggttgcggccgaggaggggaggtagctagggttctccggcgacggcgagtggcggcggaggggttaatttgatgtgtgggtgggctaacggctagggcggcggtgacatggataggccgtgaaggtgatcggggtggtgagagttaggcatagcacggggagggttcctagagcatctacggggtacttagaaggatttaggtagcttgccgactttcggcaaggtgtggaagaacttgccgacgagcacctccattggcgacggacgagctcatgtcggcagcccagaaggtggcatggtaatgctggccgattgcgaatatggaatctagggagtacgtagatggttaaaatgaaagaactcaccgagataggctgagacgacggattgcggccggaaaaacttctcggcggtgagaaccagagcagagcaggggcgacagtgcttagctcggtgcgacgaggtgaaactcgacgcaaagcttcggttaggctccaatatgctagagcatggttgatattaggtgttctaaggattagttaggatggagagtggatggaggggcgtgaagtcaatcgcacacaaggtgttcgaccgacgggcggaagtggttgatggtatggtttggcaaagcagagcttcagggttgtggggttatggttgatgatgatcgatgatggacaaggaagggattggggtcctatttatagggccagaagaagtggatgagctcgggcgccatcaacgccattgatgagcttggaaattgagcacggcaggggtggcagggagctgtgagagggagggcaagatcaatttgagtggcgggaggccacgttcgaattcttactgacgaaggcttgacttgaccatgggtgaaaacgtctggcgacgtgttggcgccaatccgggctcgacgcgcggcagcggcgagggttaaaacggtcagcatggcggtggtcggtttgaattgtgataggggaaaccaccgcttatcttcaatccaacagtgcggcaagaattggcgcgattcaccccgggtagaagcgaattcggacttggcggcggctttggacgggcgtgcacagcgtcgagcggcggtaacttgcggcggaggtcatcctggcttcgtcttcatcacgattggtgcggtggcggtggtcttagggcgtcgaacgactagcggcgcgccaaggcggtcgggcacacgcgaacggccctgaagccgacgcgcggcggctcggcgtgcggcgatggaggatgccagggtggcgcaagtaaagggggtggaaaaggcaaagtgaaccacagttttggatgggttgtggtccccaaggatcaaacttagactttgcaaaggtttgggtagatgttgggctgagatagttgggctgggcatttcatcgaacaccttgagggcaatgaatagtgttttcagaaattttgaatatttttcctagaaaagaatgaatttaatctataagtttgaaagggtttcactagggtttagagtatagaaaattctcactaatgaaagggggtaaactaaagaaatatactaaagttcgaaatttgtgagaatttgctaaaattcactaagttttaggataaagggaataattagggtaagttaaaagagttctaaaggaataatacttgaaccaataaaaggattcaaataaaattttaaattgtactaatctagtcaaaaaccagcatgatgcagtcaaattttagtttaaaatttgaggatgttacattattatacaatgcgaagaagcctagctagtagtattttgaaacttaggcttttcccattgtctttatttggtgatgcatttacttgggtttatttcacttgcaccaactctattcatgattggtctgagttagaacaaaaatatcatgattacttctttaattagtggtgagtccgaattaaatttgtcgtacttaatatcggttaaaaaaagtataatgagcctacttttgatctacattagaagattttatatatacaagaaaccgatgttatagtttaacactttctgataaggtcttggtagatttgccttattctggtttacttgaatatttaaaagaaaagctagatggtcatactttcttagatgtaagccaattacttcaaatggctttgactcaagagagccaagttaaagaggccaaaatctcatagaaatttatgtctgattgttcccatgttaatatagtttatgaacaagaatctttgaacaatgagacagttgatgtatacatagacgaatgggtttggaactccaactctaaaccattcgtttgctccgttcttaagctggttagtcgtaagaatcgacaagaggaaataacgttcacttttgatgtggccaaatgcaattagaaacaaaggtagctcatccacctgcattaccttttcctatacagactgctgaattgcaagagaaggagattcccgatggcaaggagaagaccacattgaagacttcaatacttagggggcaaggtgacaatctggagatatcaaaatatgacaagcaaccaaggagatcaagttcatctaccaagcgagtatgcaccaccggcaactaacttctccttcttcatggtattacacttggagaccacattgaagacttcaatacttaggaggcaagatgacaatctggagatatcaaaatatgacaagcaaccaaggagatcaagttcatctaccaagtgagtatgcaccaccggcaacttacttctccttcttcatggtattacgcttggtttgcattatggagttttaatggtatgtggatgatgcctatttatataccatattatcatccattatgggcattgccggttgccacattgaccgattttaaataatcaaccacactcatctcatagccggttgagagaaaataatcagtcacaaaagaatccacacaagaaagtggcgaggcaagagtggaggctaaagaaaaacaaaatacaatctgaacaagaggggcctctcgtagctttcttacatcaccattaaacatttaagccttagaggcattcatggccggtattggtggatatcgcccttagatgatctcatgcatagtattttttggctcacaagtttgccgaaaagacaggggggcatgtgttgataatcaaatttggcagtagagtcgagttatagcaagtttgagccaaatttataaaatgccagagctttcccgcgaagactggtgtgaccgttattatgtggccggtcaaaccggacaatgcactgtgattagaccataggtatccaggcggttagaccttaatcacatagtccgagtccaatttaatttagatacttctcgtgttttcttgttttacaccaaaatttttgagtcctagttgatttatatgcctaattgcatatgaaaaaaccccaggaagcaagtccacccctcctataaatataagggggccaaggacggggggccctaatgggcgatcgatcgccaggcgatcgcctgggcgatcggatccagcccccctccccctatactccctcctctcccctattcctcctccccttctcctctttatactacagtagactacacaaatttttttgaaaaataaaagttagaaaaatttatgtatagaaatactatatataaaaaatttgaattcaaattcaaatttgaatcgagtatgtaaacttttgacttataaactttgggtctataaactttaggtgtataaactttagatgtatagaaatactatatatagaaaatatttgaattcaaattcaaatttgaataagatataattcaaattcaaatttgaatcgggtatataaactttaggtctataaacttactttaggtctaaagtttaaactttaggtgtataaactttagatgtatagaaatactatatatgaaaaatatttgaattcaaattcaaatttgaatcggatatttgaattcaaattcaaatttgaaacgggtatataaacttttgacttataaactttaggtctataaactttaggtgtataaactttagatgtatagaaatactatatatatataaatatttgaattcaaattcaaatttgaataggatgtataaacttttgacttataaatttttggtctctaaactttagatgtgtaaactttaggtgtataaatttactaaaataggaaagtaatgcggtgccaacaaaggaaacaaggtggagagatggagggaaggagggggggggggcgcaaaaactgatcgccctgagcgattaagggcgatcgctcgcccagtagcattcctggccaaggacgattgaaacaacaagcaaccaatcgtcaaaatcaatttatttatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgcagacgatggcggcgaagagtagtgctcgtgctacagctgccattgctgaatcaatcctagaaaactctattgctctttggactatgtggcaagaggctagagctgtgtgtgtcgatgagtgaagaaaaatcaggcatatgcatgtggtttatatagatcgataaaggctactagttgggagtgatctgaggtcagctaattatattacagtacaacatgattagcaatttgcgccgattttgcaggtttaaaatcattcacgccgtgcattttatttgatttgatcagacaccgatcgattaagagtagcagctagcagttcatggaggcactgtgaacattcacactgcatgcagtggtgactgttgatgctcttgccgccgattggtggtgtttaacaagcaaagttaagctttaatcgactggtactcctagagcgcacagtactactagcctgttttatgaaaagggagaatagttctgtagtataggacagttccaaccaaattgcatgattgatactatttgtaagtaaatgagtaaatttcacaaaaaactacaaatactttgatcaaactattgcaaaactattgatttaaggtattatatcataaaactaagtacatatagtgttaagtttatcacaaaactaaagatttgaaatatatggtcacaaagctatagattaagtaacaaaattattacaaaactacatgtttatagtgccaatttaatcacttcctcctgattgatattcgatgtgacttgtggctatggcttatgattcgatgctcttctctcctaggggctatatatttatatggacaatcaattttttgttaagtagaatttgaggagttcatatgggatatgaacaagtaagagtcttgtcagatcctgtagtcaatggcacatgagcataacccaagagtcttagcgatgagattgccgaagctttcaaaaatgctttcggcatagatactagggttaaaaggcgtatatatcaaaaactctatactggccactacgataatgttcaatatcctcaagggttttgattgcctcattgtgtaagttcactggagaacatggccggtctactttagaggatatcgaccagtttattattcaatgcgaagaagctagtgctagtagtattttgaaacttaggctttttcccattgtctttatttggtgatgcgcgcaattttttgggtttatttcacttgcaccaactgtattcatgattggtctgagttagaacaaaaatatcatgattacttctttaattagtggtgagaccgaattaaacttgtcgtacttaacctcggttaaacaaaagtataacgagcctacttttgaatacattagaagatttatatatataagaaactgatgttatagtttaacactttctgataaggtcttggtagatttggcttattctggtttacttgaatatttaaaagaaaagctagatggtcatactttcttagatgtaagccaattacttcaaaaggctttaactcaagagagccgagttaaagaggccaaaatctcgcaaaaagttaagtctgattgtgcccatgttaatatagttgatcaacaagaatctttgaacaaagagacagttgatgtatacatacacaaatgggttttgaactccaactctaaaccatccgtttgctccgctcttaagctggttagtcgtaagaatcagcaagaggaaataaagttcacgtttgatgtggccaaatgcaataggatttttgaataattactagtaaaagaagaaaattaaattgtcacatggccacgccataccttcacttgaagaatagagcggcgagcatattataagtgtcacaactccaattctcatgccacaaatgattgcaatgtattccatagacaagttcaatcggcaattgacgaatgacgattgacttttacaaagatgcaggtggatgagctaccttttcctatacagaccgttgaattgcaagagaaggagattcccgatggcaaggagaagaccacattgaagacttcaatactgtcggtgaaatgggcccgggggtacgcacagtagagggaagtatccttcccatctagtcgcgtggctacgtggcctcgcctccccccgcccctcgggtagcgctgaggtggccagagggacctcggggtgccacgtcgcactcctcgggctttcggggcgtgctaccccgaggccctcgcctgaccacctcgtggcggggagagcgggcggggcgaaagacactgctccgcgccttcaatgcgcggtgcaccaaccgccccaagcagcatttaatgcggcgtggagggatgtgcggcgccgctcgattgacccatgtgttggtatttcttacgtccacagataaatccgcaagcgcacggaatactgttgtagcacttcaccttcgggtgaccccaaaaagatatcgaactcagggaacgtgtgtaatttacctaaggctaagacgatccaatgacaacaactatagataggctaggcaagctagagaggactttctatgtgttttaattatctaagctaagttgaaggtaatttcctatttgttgcttcgggcaccgacccctgctggtctgccagcgtggttccggctatagctctatgatgtatccgaacgtggagaattattaggacgggattcagggctgttaccacttgtcgcctacctctgacaaatccgtgggatacacaacaaacaaaggtaatctctaacctagacaccacgtctaagttattaattactactctaatacttgtacatgaacttccttctttatccagagtcctagtactagagcacttagtatgaatactagataaagaacccgcaaagatgaaaatctatcttacttagacaaagtaattaaataatataagaaaggaacacgaatgcttactttatagaagaggttctccgaacccagagcagagtgtaccgacagctccggtactccccccgaattcctcctaggaagctacactcgtcgagatagaagtcggatgagcgccaaacttccgggcactcctccagagcttcccctcactctctaccttattataatgtacaaaagatacaatagagcctcttataattcagctcaaaattgtgtgtcttggaaatgagaatgtgacctccttatataggctccaaatgacggttaggggtatgggaaatgaccaaaacaccctgcaactgccttaggggagaaatccgagccgtccaggtgaaagcagatgatgggaagcgccaggattggtttgtccgaactggtgggttcggccaaacccaaaaactctcctcccggcctctccttcagccgggaggttgcttattgggcccccaacaacctgggctatgttttggcccaattctaaatggtttttattgacttattgggcctctaatccgtgtaaacgcgtcctgaatgcgcggaggtgcattttgtcacatgacggatgtgttttctcctcaaattacttgcatacacatatttcaccaatactagtggaaatgattagtaataatacctaccactaagttggataccatgttttatttcattatatgcaggtattgacggtccgatattatgatttaaggaccgtcaacaccatatcaatcgagcttgaccggcctgtgaccggtcacaggcgacgggacgggggcagtgcccccacgttccgccctgtgtcaggcggagtgggggcaggtatgccctgtcccatcggcacgcttccaggggcgccccacgcgcgtggtgagccgccgaagtcttcatacaataatagggaatgacagggatgtcccccgtgtcaggcgggggcggcgctgggccccacctggagccaggcgcccatgttgcttccagttgaagcaaaggatagcggtatgattagggccatgtgccccccctccgatggaggggtaggtgcaaacagtgcatgtggtatccccttggactataaaaggaggacctcgcccaccgagaaaggggacgactctcagagaacttgagctcggaggaagaacagctaggtttcccttagagctcaaaacctcatgtaaaaattcaccataatcccatacacaagagtagggtattacactcaataacggcccgaacctgtataatccttgatctcccacacagccacgagagcgatctagcgattagaccgcaagcggaagtaggcccttgatcatcgtgccatttcccccggccgaactcacaaaggggggggtctcacgaccacctgctagagaggatcattcctcgacaaatacttaggaggcaagacgacaatctggagatatcaaaatatggcaagcgaccaaggagatcaagttcatctaccaagcgagtatgcaccaccggcaacttacttctccttttccatggtattacgcttggtataaatgtattatagatttttaatggtatgtggatgatgcctttttatataccatattattatccattatgggcattgccagtttccacattgacccattttaaataatcaaccacactcatctcatagccggttgagagaaaagaatcagtcacaaaagaatccacacaagaaagtggtgaggcaagagtggaggccaaagaaaaacaaaatacaatctgaacaagagaggcctctcgtagctttcttacatcaccattaaacatttaagccttagaggaattcatggtcggtattggtggatatcgcccttagatgatctcatgcatagtatttttttggctcataagtttgccaaaaagacagggggggcatgtgttgataatcaaatttggtagtagggtcgagttatagcaagtttgagccaaatttaaaaaatgccagagctttcccgcgaaggctggtctaaccgtcattatgtggccggtcaaagcagacaatgcactgagattagaccattggtatccaggcggttagatcttaatcacatagtccaagtccaatttagatatttctcgtgttttcttgttttagaccgaaattttcaagtcttagttgatttatatgcctaaatgcatatggaaaaaccccaggaagcaagtccaccccttttataaatataagggggccaaggatgattgaaacaacaagcaatcaatcatgcatcaaaatcaatttatttatccaaaccctctatattctacatctctctccttcttgctacctatccaaattctaaatcctcaaatcctcgattacttgtcatctctcgtctctacggtattagaggacgtcctagttggcctgctgagcctagaacaaaccgacgcacgttcatcctgatggggtccttcgcgggtggtcgttgggcggcatctacccactccctatgatggcgcgtctccgagtgctgccgcgagttacacataacgtgctcaaggtgtggcattgcgattctacgtcaacatgaacaatcttataaatatttaaattacattatgtagaacacatgtcgcattacatgtgcgaataaatacagacacgacacacataagcactctgaaattatttatcacctgaaagccaatgcttatgcactgactccaagtctccaacacatacatcgatctgtaaaatcaaaggtgtttttgataattattctgtgatgaacaattgagcattagagattattggttttgttatttggaatttattcacgaagtggtttggagatgattggatttcacaggtgaatctacaggttatcattttatgtggaccggtcagaccgggcaggtgttgccggtcagaccagcggtgatcaagcggtcggaccggccagcccgcggtctgaccggccgacactgtgtcggtttcggtttcgggttgtttatttggatatccgagtttatttcatgattatgacttctagatggatattatacgtatgtaatactattgtttactgctaatgagtcaagttggagatagcttggtctcggaatatggtttctttgtctattccatgtgtaggtgactcgatgtctcgggagagtatttacggtgatggaccgggagttggcttggggataagacgacgtccgttgtggtcagagatcatgcgggatactaaggctagagttgatgcacgtggttgatggagattccatatggcatacgatggagttattgtgtgcgtatgggatgcggagtcgaaattggaaggagtccaaatttggtacgattggttatgtaaagtttctttcttgtactagagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgttgttggtgcactttgtaaacatagagagaattaataaagtcgtcattcactttaagagttcttcgatttgtgtttcaccgggtttcggcggtctaaccgacaactcaccggtggtcagaccagcggcattgcggcggtcagaccggcgggagcacggcggtcagaccgacggcggcgacagtaggcggcaggcgatcacggcggttagaccggtagatcaacaccggtcagaccgggggctacgcttcggtcagaccggctaatctacttcggtcagaccgatctccatcgatttcgagggtaacttttatttccgctaaaagttttcggtttttgggtataccaaccattcaccccctctggttggcttagttcttgtgattcgatcctacacgatcgatcgatctcacacagtcacactcctctcacatctcacaacttatatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgccggcgatgtggaggagtgcatcctcttgccagcgacgacgacgaaggtgttagccttgtcgccgccgttgtccgttgttgacgacagcggtacgatcttggacggctcctgcccggggcacggcgtgctgctcgtcgcgctgtgcagctgcgcgaagcagtcggcggcgccgtggaggtcgtcggcggcgaggggcacgctgaaggcgccgtcgccgtcgaggtcgccgacggccttgctctcgtactcgccatcgctgttcttgcacttgatcgccacctggagacctgaacatcaccaaacaattaatcaaggacggtgatatatcgatcgcaattaatcaatgatgaacatatcatcatcatcatcatcatcatgatatatatatacccttgaaagcatcctgcgccatcatgttcttcctggtgcactcgccgcacttggcctgaccgacgacgaccgccgccacctcgccgtccgcagcagcggcaactgccatcacggcggcgcagacgacggcggcgaagagtagtagtgttcgtgctacatgttgaaattgtatcttcagctgtggccccatcgtgatccattttgcagttgcaacggtgtggagaataagtcgccagcaggttgttagcaggcgcgggtgatgcggcgatctgggagttgaagaccgtgtcgtgtgcgtgagtttagcgcaggggagtgtgtgtgtagcgagtcagagaattgcggatcgtgggatggcacgatttttgcctcggattcgttctgttatgtatggagtataaatagtttatttagctcagttttacagttgtaagtttattattcagttgaatgaaaaacaaccagaaaattccccaaagattgtgcgatctagttcagagttctgaaacttctctgttcttcactctgctctgaatttctcctctcagttccttgtcactgttgctgtgttgtgccgtgccggacgcgtgcagtctgcgcgcaaggtgttcgatcagggaaatcttcgccaacacnnnnnnnnnnnnnnnnnnnncaatcctagcaattagcaaactctattgcccctcctccttactatgtgtggatgagtgaagaagaagcagaggccatgcatggtttatataggcgccagcatgcatagcatcatgtagatcgataaaggctacctgggagtgagctgagatcagctaattatattacatcatgattagaaatttgcgccgaatttgcaggttcaaaattaatgccgtaagtttgattttatcaggcagtaccgatcgattaagagtagtgcactgtgaacgtgcacactgcatgcagtgttcacccttgatgctcttgcttccaattggtggtgttaaacaagcaaaagttatgctttaatcgagtagtactcctacagtacacagtgctactagtccgttttattaaaaaggaggatagttctatactataggacagcttcaaccaaattgcattattgatactattgtgctttcttattactgtcttggttaatttggctcttggataattacctgtttaaatttatcagcatatactgcctactagtatttgcagaaatcgaagccagcataagtttaagtaaaatgttattgtgtcttcgtctattttaataacgtagtgtacgtgagtatatgagtgtggtgtcaccgactacacgtgcatcttgtctatgtaatggaaaaagaaaatctctttgcttccttaggctgaatccaccatggcagtccagcgcatattctagatgccaacctgtatgcatgacccgacatgagcatatgtcaactaggcctttttctttacctcttcacccaccttgcgtctctgcaacacacaacgccacgggctgagataaagacgagaatgctccagccagacgctagatctagcccaaaaaatgggtagcccatgtccaagccaccccatgaactcctccatgaactcttttgtacacaatgctatctttttatctgaattttaggtagtttcaaattgtatttctatatggactatttcttgtagttttaatttttattccgacttttagattgaattatatttatacatataattttatttcaatatttattttaaatttttaatccgaatttcatatttttcagcctaaaaggtatttctacgttgactcttgtcttaatttaatttttaaatacgaatttaagttttcttttcaaaattgcatttctacatgtacttcttttatccttttattattattccgaattacagatatttttaatctatacacttggactctatttttttcttttttattaatatgggaaattctaggtcatgagagtgaatatggtggcttttatattgttttattgagttaataatagatcgacagttacaggtgttcctttttctgttacttcatgaatatttcaataactagatgaaactctgcgcattactgcggaaatttagtatgataacaataaaaaaaataacgtgtaagataactagataacatcagattaagtaaattaatgtggtttacgataatttaaatttaaatagtatgtagaatggtgattcaaacgtaaaaagtaaggtggtatgactttatggaagaagaaaagtagggagatagtttgtaccgtagattaatcatctaaaggctaaaaacaattgatgtgatatgacttaattagaggaaaaaaagagaaagataatttgaaccatagattaatcatttaagcactaactaagtgaggatgaactatataagtatataggatatcataaaacataataaagatatacattgaaacatgatgtgaattcacataattatgttagattataatttaacatgtttgtatttgaaaagctcttaaattataaaaactataaagatatagcatgtttgcatgatgtttaaatgtgatgattgttagtgaatgatgatgtggtatcttgttaattagtggatgatgatgtggcatcttgttagtggatgatgatgtggcatctttgcatgttaagcttaagaagttagtgggggataactttatagtaagataggatatatttgacatttacagctagctctttttttcttttacttaatttaattttttttatagtaagataggatatatttgacatttacagctagctctttttttcttttacttaatttaatttaatctaataatatatttacatgttacagctaactggacaaaaaaaataagggctaaaaaggaatcgaagtctggacctatagagtgtcctcgctagtggaaaccactgcactagaacagcatattgttatttttagtgcaggatgctaaacaaatatttgggtgttagcgtaaacctcatcagcacaaaatcatttatttgtccccaaaacaactcacctaaaagaaatacttagcttcttcatagcacagcaatattttgtatatagtacaaacaactgaacaaataagtccatttgaacacacgacgaaaaaattcattgagaaaatagttagagaaatatatcaaggcagataacaaaattagtgataaaaaatacttcaaaagtgtatgaacatatcacacgatcgaaataacagacaaatcccattaaataatgaagtctatcacaacaaaactagcttgttgggtcatcctcatcactatctgatggttctgtacccatatcatatagatccctcggcctatatggttgtgcaacatgccatccttgtgcttttggttcctgcacatagaacacctgtgatacttgtgatgagaacacaaaaggatcatgctccatcttctctcccttatcttcctctgtcacctccttatcacaacaacaactcaagcccgctggtcaccgcgaacttgttctccttcgagcccgatgtaagtacttttttttttaactaacgtattagtattttttaactaacatatcatattcaatggataaagcactgtcgctatttagaggctcctactgtgtatatattaaatatatataattaaaaaagaaactgtatagatctcaatgcatgctgtctagccattctataatcggaaaaagtacgaattaccccttccccgaactatcgcgatcgtccgaattatccccttgaactcgaaaaccagacattttacaccctcaactactaaaaccgaacaaataacccccctactcaatctctggagtggttttgatcctacgtggcatacacgtgtcagccaagtcagcaatcctttaaaaaaattcggtggggcccacctgtcaatctctctcctgtattgctcaccttctctctcctcctggattcatcccctcccctcgctaaagcacgcagcggcggggcgagcggtggcggcgggcgcggctgagcgagcggaggtggctgcgggcgcggctgggtgagcggcggcggctgctgcgggcacaattgggcgagcgtcggcggcgacgacggcggctgcggatgctagcctcgccggcgagctccgccacgggcccccaccctggcaccaccgcccaccgtgtccacctccactatgccgacgtccacgtccgtcttggtccgcctcggtgcgtgggcgagcgcctcgtcgccgtcgccttcgtgcaccaccgggagcaacagcacggtcgtcgcctccgccaccacgggcacggcggggcgcgagacggcggcggaggcgctgtcagtgtcgtcgtcgtccatctcctccccggcgaccttcctccctgcacggtcgatctccagctccacacgcgccctcgcggactccgtctcgaccacctccaacgcgcgctccagctccgccacgtagttgttaacagtgaaatttggtaagcccggagtagtcatcggcgtagagtcagcatcggcttcgaagtcctgagattagccgatgagagttgtcaagtcgtcagttgtcggattcttgctatattcggttaaggaaattgatctactaaaggaagcttatccagaagagaccgagtttaaagagaatacggcatggtaagttatctattaattaggaatagtttgttagtttccttttatctttaggaaagtgtgtttagtgtcctataaggactttatcttttccttttatctttaggaaagtttctttcttgtccgacaaggacttatatcaacccatggatataaatatgtacacctggggtctatgtaatctgtcctcacgatcaatacaattcggcgcatcgccaccttttttacttctacttttgtttttacgttccggcggaacttggcacccgacgcggggctgcatcgtcttcgatctccggcgaagggataagtccaatgtttcaccggtccaggcaattgtatcgtttacgtcggcgtcaacagtagtcctcaccacctcgacgccacttgtcgccagtcctcgcgtgccgaccgcccgcgacgctgcaccccaccagccctcgcccgctgatggcccgcgctgccaactgtcgctggccctcgcgcgccgaccgcaacagccgcacgcgcttcaaaaacgagaaggtcacacacccctgttcccgcgctgaccgcccccaccgcctgtccccgcgccagccgcccctacacgccgccgcccaccgcccgtccccgcgctgcgctgctgctccccccttccctggagacgacggtgaggtacccctctcgagctccgtgtcaacggcggtgggcgacgagtcctcctcggggagggcacggcgggtgtcgtgcgcggcatgtcgtgctcgtcccccataaccaaaggcggctgtcgtgctcgtccctcatctccgcctcatgcttctgcggaggctcgccggcgcaccgacgtcgccgagcggcgggagcctcatgctccgtgcatcgatccgcctccgccaccggccaccatctcctccttctccagccgtagacgcaaagcaagagagagagaagggaagcagggggaatgggattggggagggattggtgtgaggaaagagatgacatgtgggactagatttttttaatgttttattttgctgaccagatgccacgttggcggccacatatgctgattccagttaaaaccgtccaaaacagtgctcggggggttatttgtccggttttagtagttgagggtgtaaaatgtatggttttcgagttcaggggggtaattcggacgaccgtgatagttcggggggggggggttaattcgtactttttcctttactagaaaaaatgcccgtgcgttgctacgggtaaaaactttttttatcctatacattatactccctttgttttggaccggatgcttctttgtttttggaccggacgttcattccttccttcttttcagctctagtcctagagcagtccgctacctctatctgctcggcctatctctcttcgcctcagcccacaagtggagctgtaggcctagctcgaacaatctcgtgcccgtaccatgacggagccaaacctcccatcaaatccggtaatctggtcgagctcgcatagtaccgtgtccgtatgatggcggagttgatcctctctgtcaaatgcggtcgaatctttctcgatctccaaaattattagagattttgatccacttgatcccctttttcgtttttttaccaaaatcgaagcaatccacaaaacttggggaaaaaaataatgaactgaaagggaaattcaaggggaaaatgacgagagtagtggagaatcgatttttgcaatcaattggatgaggaaacacataaagatgcaaatcgacatggcggcggcgctagggtttggcccgacgaaaaaaccgcaaaaaaaaaatagcgaaacatagttttcctttttacaatcgttttttgccgcactttttttttccgcctttttagtaggaataggaatcggtcagctttttttttttgccgcatttttttgccctgggattttttaattacaatcggacttttttatcatttttttattaacggacgaaggaaacatcttaaactctatatatatatatatatatatatatatatatatatatataaaagtagtagtagatccgtggtaactctattttgttctctagataaccaagacaaaatttgatttttgtctggatttacaaacttgaataggacttatatttctgaaaatcgtatgattgcttgtgattcaaatactccaagccattgtgatgataatctccatgtaaaaggggaaacatatgtatcttcagagagatcagtaaaaatatggcttcaacttgcatgcacgctacaaccggccagcggcaattaaccacaccggacacgatgtcagcatgcacgtcaagtatacagaacaaatgaccgttgaaccatgtgctgctagtttcacccactcaatcaaggagcactgttgcaaaagataccatgtggcatccatcccaaggtgcaaaaacttcaaaaatctagaaaaccgatatggtagctagggaagttattaattacattctccgtttcatattataagttattttgtttttttcttctagtcaaacttttttggtttgatcaaatttatagaaaagtataatattttaaacacaaaacaaacgtattatcaaaatatatttaatgttacatttatagtaaaactaattcgatattgtagatgttgctaatttttttctataaacttagtcaaacataaaaaaatgattagaaaaaagttaaaatgacttatagtatgaaatggagggatcagtataaattagtattcttgagcagaaggttggtcaaaaa

SEQ ID NO: 25342 - DNA, 12618 bp, Oryza sativa
attcctgcagcccaatctatctttcatgaataaccagaaaaatactttgtgtttttttaacatatgaataaaatgttgctactaattcactaccttccctgcacgctgcctcccatcattccttgctagcatggctcgttccccgtgttagagtataagtgaattactaccatctttctttgcaattgccccttcttaattagtttaagctcttattttgaattagttgttaatacttatatttaactccatatgttatcggagtgaagtcccaaaatcacaaagaccaaaaccattcgcttttgagtaaattttagaaagagtaaattgctcccacggtacaacaacttggcatgtggatgcgatataatgcaagaacttgaaaattgaacgtccaagtgcaacaacttgacaagtgggtgcgttctagtataagaacttaacaatttagtatttttgtacatcaacttggctaagcatatacaaggtgagtttttttcacgatgtcaatatgccattacatagtaatcatatggatattgccttataagcacatagtagtacaatttacatccaattacctttaagattttttttgttttcttcatcttatcaaatatcaaccgaaatataataatttctacatatagtttaattggctttcagttattagttattatgataaaaatataaatacacttatcaaatctgtgaaatatgcgctagtatattgtcaaaattagtacttaaaaattgaatttataaaaaaaatgctccaaataatcaagttgtagcataactttttaatttactgtatcaaaatcgtacctaccttgcaagttgttgcatttatacgatcacttataaagttcttatactaaattgcacctacctaccaaattattgcactagaacgttcatttctcaactcaagttattgcactaaattgcacccacctgccaagttgatgcaccatggatgcaatttactcttttagaaaacttcgtgttgtatggtcaaagttgtagaaaccatatgtattatgacacgcggcatctaacctcaagtattgttgttttcaaagtttcacaaaactccacccttatgcattttgagcatgaatttacttaaaattaaaaaacgtagagtgcaaatgaaaatttaattattaagttattgactagattgatagaagctttactgtactttcaaaattttatttagatatgctgaaatttattaagatttaaataaagatggggttttatgaaacatggagaccataaatcttgtggtgtgccacacatcataattaatacatatggtttccacaactttaatcatacaatatggagttttctgaaatttactctttagttttggacaagggaataaattaaacggtttcaaaagttgaggagtctgtaatacccgatattaaagttaaggggtatattttagactaatacaatcttggcggggttaaatggacttaaacctttttaatgtactctatgcattttaatcctttttgttgttttatcattttaggtttgttcaaagtctatgtaacttaaaatggaatggagggagtaatagttttatagatatatactactcagtactcgtaaaggaagtcgttttggacagcgatacggtctccaaaacataactttaactttttatttttataaaatatttattgaaaagtgatatatgtatacttttatgaaagtatttttcaagataaatctattcatataatttttacatcttcaaactcaacaacttaagggttattcatgatttatattcctaatgtttgacttaaatattgtccaaaacgacttcctttacgagtacggagggagtatatctcgttccaattccgtattataaacgattgatcacacgtggaatatatacccaaagataaaaaaagccagtagtaagttattttaagtttttatttgcaataggctaatatatgtagacaagtgcatatccaattatccatgcatatatatcagcgtatgcacgtacagtggatttgggttcaggttgatgtgatggattgcaagcatgcatgcgtgtagcgcacaagatgctggtgcatcttgcccacaggcccaggagacctacatgcatggcccatccatgtttcagcacgcgggcaggacaagacgtagcagtagcacttatagttggccgaaaggcccggggtccaatggctcggcccatagtatggggttttggcccagcctaaacatggcacggtccgactggcagtgtcgggcccttgcgtgggcctcttcctcggcacgatgggccagtttggcatggtccggtccaacaatcaaggagttaaatagatgagcgagccaaaataaacttattccggctatataaggtatatatggcacaaatagctgcggcgcaaaatagacttaatctagccaatggcccaaatagatgaggaacgcaaaatataatttttttccaaggttgagcacggtgggccttcatgcattcaggctggtccggcacagcacgagtcatattggatcgtgcctaggccgatggtacagcaagtgggaggggtacgacgtggcctgacgcacttctctactattataaaaattgaagatgtttttgccggtactttgatacgtcattcgtgttttagtcggtttttaagtttattcgcttttgagaatacaaaaggagttgtataagaaatctctttaaaaaaacttgcatgaaacttgagaaaatcagactcctaactgcgggtcatgattttataaaaaagaaaatcgagcaaaatcgcacaatgaattttaccttagttaaacctataacaataataagattaacataacttcacccattgcaacacacgggtatttttttatagtagataaaagaagctattttccctttcgtaaaatacttaaattatattatgtttaataatgttgcacagtgaaggaggaatagcttatatgcatacaatgcataatctaccctataattcaccaactcactcttacacctacattactcattcatcaaatccaatggctcatattcatctaactgtgatcgaacgtgccagatgagaccccctcccctccgcgctcctcccccacgcggtcacgcccacgcgcggacgcgccttctctctctctcgctaactcctgttctcacgcgcccccttctctctcgcgcaccgctattctcgcccgttcccctcacccatcgccgccgcgattcttgcccctcgccaatcgccgccgtacccaatcaccaaacactaccccaccgccggcatgcccctgcccctcgcctatcgccgccgcgccgccgctccaaatccccaaaccctaccccgcccccagcactacgggttacggatgccaccgcacctcctccattgagacgagccaccatggaggccaccgtctttgctccccaccaggtcgccatcctggcactgccagcggtggaggcggaggcggccggcgccgctgcaccgggaggatggctatgaatggcatgagatcgatatccaaggtcggggctgtaatgaggaggtacacccatggaccctgccggaccggtgtgtgcggtggatgcgggcaaggagggaatcgcgcagctggtcaaggaaagatcccatctctctctgttaatcccgatctcctcatgagattgctcttgaggagagggagtacgtccctgaacttgattccttgcatcagttcatcccttctgttgaggctttgagtggctggggcttttgatgctatgtgctcttggtttgactcgatttttgctttgttttggtgcatgcagcaagatcatagagttgagcaggaatggaccagaagctatggctcgctaactggcatattgaacaggtaaattcccatatgctagcagtaagttttcccctaaattatatcccggaaacttcaatgtttagttgccaactgaaatctgtgtaatgagttattattcgtttcacgcattttgttggtgaaacttgcttattgcctcttttttgttctgcaggagcacaaccttaggagggatagagtcagatcatggctctctgatgattttgtaaatcctgttaagtaacttttttattgatggcatatttagcatgctgctgatctgtccccaattttttttccatgaagctaaaatcattgcaacatcagtttgcttgctcgagacctataatcatagccaaaatatcagaattggaggtttggagatgctcctatagtggctggaaattcatctggtcacggctggtaagttgaattattttctattgtgatttgccatctccagattaccctgctccttgcaataaatcaatctcccatggtattagatttttttctactcttccatcaataaaaatgatggcacatgattgctggagctgtataggtgaacgtcggcacacatgttcatacttcataccggcacaggggacattgcagaaaaaaaaagagaagtagatttcaggttcgatcgccactgcaccccagggtctcacgcatcgatctgcacgcttatttgtagtcaaactaatgcagctccaaagttttgatttgatttgctagatttagaaatagcttaacaaattgttctgttcaggtgtctcagcttctgcctttgtttcaaatgtgtttagctgttaaggaaaataggttaggcttcacttccgagattatgcactagtttagaaattttttacgatatgatagtcccagtttctgcctttgttacaaattggctgcccttccatatgaaggaatcacaaagtcaaaacactgttagattgaatggaaaaatcatttaatttttcgaaattcttctatttgttattacatggccttaattctagcagctaaaatcaagatcatcttgcttatcttatttgtcttttcatttctaacaaagctaatctcaaccaaatactccttttttggtaggacagatcgtctttctcgtgcccaaatgccgtcctcggtcttgctacgcagcccctccaaccgtgcaagtttggatcctctcgatggcggaggacgtcaggcggtgggagatggatctgctccccccgccgagtgcgtaggtccggtcctttccattattttccctgctctctttcttgatccaatttgtggagaatttgttgcgtgctcgacattattacatgcaacctgttctgtatatctggaattcttaggtgctgtttgttcctttcgtgtgtgattatgcgttggattgtcttctacaaccgcaggagaagctaggctgagaatcgctggtgagtggcagggaagaggaacgtttaattgcttagagtttcttggatgggagattctagagagatcgcagcaggtttataaaatgctatgatctagatgaataggtttcctgactattgttgttcatttaaaattgaaccaaatatgctgaaactattcactgaaaaaaggtcaaacagaagaattctactgtcacactgcactttcaaaagtgtttgttgatactggattttattctctttatgttccttcagtattttttcttatatatcagaattaaatagtttacaagaatatgagtgagaattattctccttctccttctcctgaaccacatcatatcattcttaattttcctgaaatgttgcatgcatcctatggtttttttggactgctttccgtggtgcctagctcttggtgctgtgcaatattgatgatttatgcgtcctgtgtattcgcagggtataatgaaatttgatctgaacatatgaaatttgacaaatgcatttccatgatccgaaaagtttatctgcagatttaacatagtattcatgtccattttacctttttcaactcatttacacgaacaaaattgcagccatgtaaaagcctagcgctttcagttaaaataaataatttattatcatttgctattaaatgcttaatgcctatatatttgctttgctacatatttttgccttagtagaaaccgggatgtttttccaaatattttgggagttaaattactaatgctaagtgatgaatatatctttataagcgtgtgcctcgtggtaggcgaatacactgtcttcaatatggtgcttctcctgatatgcgttcgatagagaagtttatgtggcttcttgaggtgctctataaggaggaaggtgaccagtgaggagcagaagttgctgaatgtttccaggcgatgcatgttttgaaaaaatagcacctgtagaacgtgcaggtaatatttgtatatgtggtatagaaagttagataccatgagctattgtttgtgttttgaaaagtttcactcacagtgatgaaaatattgcagaactctattcatggccaattttgggaagttattaacagtgtaataacattcatgagaacaatacaaatctctctatcgttattttattcgtgaatcttaaatattaccttttgccttttacattatcaattatcaccgttgcgtttcaatcaaaattatcaccgttgcgttagcacggacatattattactagtgtattagatatgccaataaatggaggtactacacaagcacttctgcacgaacttaattttattctcacacacatcgatcgatcgatctcacacagtcacactctcctctcacatctcacaacttttattattctgcaccaacaagctgacctggaaattaatcatgcaagaaccaaaaggattaaccaagccatgaaatcaaacaaaaaagcaagtgtggatattgatggaatggatgaattaaaaattcagctgtgatatgccggccggagggctgggagccggcgccgcagctccgccaccgtttgccgcgccaccaccgttcgccggcgtcggcttggggccttggggtctgttgtagaaatagtcgaagaaggggcacaggaacgccgaggtgcactccgccgacgacgagtagtgcatcctcttgccggcgacggcgacgaaggtgttagccttattgccgccgttgtccgtcgttgatggcagcggcacgatcttggacggctcctgcccggggcacggcgcgctgctcgccgcgctgtgcagctgcgcgaagcagccggcggcgccgtggaggtcgtcggcggcgaggggcacgctgaaggcgccgtcgccgtcgaggtcgccgacggccttgctctcgtactcgccgtcgctgttcttgcacttgatcgccacctggagacctgaacatcaccaaacaattaatcaacgacggtgatatatcgatcgcaattaattatcgatgaacatattatcatcatcatgcatgatatatatacccttgaaagcatcctgcgccttgatgttcttcctggagcagccgccgcacttggccaagccgacgacgagcgccaccgccgcctcgccgtccgcagcggcggtgacagccatcacgagggcggcgcagacgacgacggcgccgaggactagtgctcgtgctacagctgccattgctgaatgaatcctagcaaactcctccttgatatttggagtatcttactgctgtgtcgatgagggaagaagcagcagaggccatgcatggtttatataggcgtcagttaatcatattacgttccctcgaaagaaaaagctaattatattacaacatgatcagcaatttgcgcccaatttgcaggtttaaaatcattaacgccgtacatttgatcgatttaagagtagtgcactgtgaacgtgcacattgcatatgcagtgtttcacccttgatgctctgttgtttcccatcggtggtgtgtgtttagcaagcaaagttatgctttaatcgagtagtactcctgcagagcatagtactactaatctgttttatagaaaaggataatagtataggacagcttcaaccaaattgcatgattaagattctattgttctttcttatatatattgtgtgggttaatttggctcttgaatcatttgatgtttaaatttgtcggcatatacatgcctactagtatttggcagaagggatcacatatatatttatcgataaattttcttccaacgatttaataaatataattttaatacaatcgtggtgtaatttccatcataactttcatgtaactacaatataacttgtatgtaacttttaaaaatcccttcgaaacatgctatttccataaaatggacatcataggagtgaatcctctcacatgtgcatgcactgtaattttttcgcttgcacgaatcttgaaacgaatctaacaatttaaaatgatgtaaaagttacattgtaattacatacaagttacaatgtaactacactacataacaattacatatgtcaaatttttttaaaaaatttatcgataaatatataacaaattatttgcagaaatagtagcctgcagaagtttaagtaaattgttgttgtttgtctccgtctcttttaccgtatgttaaaaaagaacatagtcatgagtgtgtgagtatgatgtgtgtgcatgtggtgacggtgcgcatcttatctatataatgggaaaaaaaatcccttccttcgatcgaatccacctaagcaacctagtacattccagctagcatatctgcctgcatgcacgactctgacataggatggacctgaagcttatggctcgtttgcttccttggctaatttcatttttctaatgagcaaagctggccaatggcatatgcaagatttctatataggtgatatatatatatatatatatatatatatatatatatatatatatgtatatatatatatatatgtatatatatgtatatatgtatatatgtatatatatatatatatgtatgtatatatatatgtatatatgtatgtatgtgtgtgtgtatatatatatatatatatctcatagatataacaagagttacaagtataaattgatcaaaggtgcatcataatatagtaataagcactggtggagaagtgttttttagtcccgtttgtaaccccccttagtcccggttttccaaccaggactacgaatccgggactaaagatattttttcttttttttctctctttttcattgtttttagtattgaatattgatttcacaccatcccctatcaagaaatcccaaatccaaatcatcacatatcacaaaacatccccaaattctcaaatatatcatctccaaatacatcacaaactcttaaaaaaattacatcacaagttctaaaaaaatacatcacagattcggatcacacacaaatcgaatacatcacaggataaatcataaattgtaaaaaaaaaaaaaagctggccggccacggccgcctcccatccgcgccggccggctgccgccgcgccgctgcgccggccgctggcccgcccgcgcgccctcttcttcgctagctgtgaatggaaggaaaaaaggaaagagaagaaggctaggagttagagataaggaaagagataagaagttagaaggaaaaaagagatagagtaaggagtttgttgtatggacgggaaaagaggatcggtactagggattatatagtatgctttgatttttattcccggttagtaacatcaatcagaactaaaaatagatttttagtcccggttggtgttactaaccgagactaaagattttagggccctgacacgtcctgacatggaatcaactaggactaaagatgaactttagtcccggttagagttatgaaccgggactcaagatgatttttagtcccggttggtaacaacaactgggactaaagatctttctctcataaaccgggactaaaaatgaaaaatcatttttagtcccggtttttaatggaaccgggactattgtggatttgggtcgaccgaccaaagatggtttctctaccagtgactgggagttgttttttatgttacccggatacgaggatatatacggatacgcgatacggggatacggcatttttcaagaaacatatatacggggatacgtctatatatgtaataaaaaattaaaaactaataaactctcttaacatattgtgaaaaccaatgcattcacagaaaaattaataaacttgcggactgctacctgctgattattcacagaaaaatcaatgtgctttctcctatacccgctcttgtctgccagactgccacaatccaccgaggcttcttttcattattatctagcagctgcactagttcttcgagggtaggatgttaggaaacgataggcaaataaacgataaaaaacaacagatcaatcacagaagacactagatttaacgtggaaaaccctcccaaagcaggagaaaaaaaactgcgggcgccagccagcaaaatatcttcattatatcggggtgaagttacgacgctaaatggtggcttacaggaggtatatatatgaaggtgaaaccttaaaaggataacgaatagtgaagatatttttcactccggcccaagcctccggcttcaaacggcctccgcttcgctccagcagaagctggcctttattatgtgcaaacaaatttggatcacaactcaacataggagcattggatgcatggatgcactagctctgaaacttagatttcagatccatcggatgactgctaaatgaatcactgcagtggagctacattcatcggcgttggtggtagcagcgcgctgttcatcggcattggtggcggcggcgctacaagcctgtaatcgtgtggggatgctgtgcctcgagcgagagcacaaggaagacggtcttggccccggcggccaggcagggcatgatgcacgatgggtgcgggtgttgtgtctggcggcggcagccctgcgcttggaaagggattcggaggtgggcgtaaaacgtatcagcgacgtatcagggtttgttttatttatttggaaattacgaaattgttggatacgtatcccgtacgtatcggcacatatggaaacgtatccatatctgttcacgtatctgatatggatatgccacttgactgccatatccaggtattctaggttgttttttctcttttcacatgtgtatatatgtattgggctaggatttttttgggtggtcctgggaccacccctagatctgcaaatggagctggtattttagctcgttacgggtaacgtgccagctcgaactggaatgtgtgttttacgagctagagtagcccacagctcagcaagtcacaacccatattcttataaggccctagaacatcaaaagcctagctcttgatccccttttgaccccttctcactctcatggtttcctattgtgtccaaggcaagaaggttcttgactattccagctagtattgtatcatcagagtccacttttagcattggatgaagaattcttgattattacaggagttttttgaagcgagacatggttcatgctttggtttatgcatcaagttggataagaacctcaaaaaatgacaatactgcaccttcttgtgtatgtaatatattgtaatgcttattttttgcttatctttgtcaagtctttgtataaattgcttattttggactggttttacatggagaagatggagattatgacattgaaatagtggagttcccccattgtgtggtggcaagaaactagtaagtataagtatagtttatattcaatgtaggcacttagcaacttagattaacaatgtacagctagtaagtttcttattttgacccaatatattatactctgcaatctgtattccactttcgatatgaaacatttcaaaaaagcaaaagagaaagaaatccaacatatcactttactaatttctctacatgcaggttaaaagcagtggcggattcaaaaattttcatgagcctgggcaagtctaacaacaaatgaggtatatacaagcctatataatttgatcatagataacttcaatatgaacatttgttttaaaagtttgtgttgagcgagtttgcgattgtactagttgcattgtactgccttgccggtgactaagaaaagtgattactaaggtaattaggcactggtgaattgatgcgtgcagctggtggagcccaggccattgtctgtgcaagctgggcttgcacaaggctccgcacacttacaagggaaggggtgcatggggggtgggagaaagtgaagctgcttctaaacttcactctattttagcttcagtcaagctacttgtatttatgtgtaattgtgctggatgaaaaatgatggacatgtgccctttctgccttgcaattttactagttattctaaatcactagtatagatccttctatttgtgacgggctctaatatgcttagaaatagcaggccgtcacaaggaagtcatctcaatcgggccgaaaagtgcccgattgagatatggtcgcacagacatattagatgggcataaaatttaagcccgtcacggatgacacctatcagtgacgggccgtagtttaggcccgattgagataacattccatatcttcatctgtgacgggcaccaactttaggcccgattgaaataacattccatatctcaaacgggcct

SEQ ID NO: 25343 - DNA, 20112 bp, Oryza sativa
tgaccatcatccgtgacgtgcaccaacttgaggcccgtttgagataacaactaggcccgtcacaaggcccgtcacagatgactcattagtgacgggctatatacttaatctctatcgggcattaactaaagcccgtcaccgatgactatttttctatttttcatatgaaatgtttatatttgtaagttgactatagcaaaataattaagtgtagtataataattcattttatgagtcaaaataattttacgggtagtaaatgatttcaaatggaaaaaatttcaacaacaaagttatataacttatcaagatttacaacttttagtttggtcatttttcaatataatattttttttgaacagtttgaatttgaatttaaaaatatgacaacttcaaacaacattttcaaatactaaatgatttcaattgaaaaagtcatcaacaacaaagttgaataactcatcaatacctaaaacttttatttttgttatttcttcatccgacaaaatgttagtaatattattcacaaattttacatatatgtgttatagtttataaaagaatcagataagagatatgtcaattttgtgaacaatgttactatcactttgttgtatgaagaaatgaccaaaataaaagttttagatcctgatgagttattcaactttgttgttgatgactttttaagttgatatcatatagtatttgaaaatgctgtttgaagttgtcatattttcaaattcaaattcaaatggttcaaaaaatgttatatagaaaaatgaccaaaataaaagttatagattttgatgagttatacacctttgttgttgatggctttttcagttgaagtcgttcactgatctaaaattctatttgaacttttcaaactttgaatttcaaatttcaaattgtttaaatagagtcagatggagaaatgaccaaaataaaaattttgcacctcgatgagttttacaactttggttttggtgacttttccatttgaaatcatttaataaccccaatttgatatcctggcatagggcttaataggattaatagaatactcataccaataagttacaactacttttccggaagccaatctccaaagaactttgatgttaagcttgcttgaactttgatgttaagcttgcttggtctggaacaatttggggatgggtgaccgacctttgatgttaagcgtgcttagtctagagcaatttcgggatgggtgaccgaccgagaagtttgcacttcccacgagtgagggctagccaaaaataaaatgtatttatttttggattatactcatctgtaacgggcattaactatcatctgtgatgggctataattagtgcccgtcatagataagggtcatctgtgatgggcgctagttgtggcccgattgagataggtcatctgtgacgggctatagtttgactggtcgtctgggtcaaagctatcggtgacgggctttacttaggtcccgattgagatagattcatccgtaacggccgtttgcccgattgagataactcttcacatcagtgacttctagcctgtgacggacgtcatgcccgattgagaaggggcttaccgcccgattgagatgagggtatccgttctagtgaatgttgatgtattgaagtatgaattattatatgtaattgtgctcgatgaaaaatgatggacatgtgccctttctgctttgcagttttactagttatgctaaatgttgatgtattgaagtatggattattataatgaacctatgtactttaattacaacctattgttgatcagttcgaagttggaatataggttgatcagttcgaagttggaaacctggaacctgtgtggttgtgttcaatcatggacttttggtaaattatttatccaaatgatgtgtaacaactgtctctacagaaccacgcagtctaggccatccgatggatggacgacccacttacacataccacctcacttacggttccgttattgtttcgtgtaaaggggtaaacccgagagtgatatggctagagcgacaaacccttataagttggttttacccttactaaactagtaatgtggtagtaatgtggtagtaaacatacacatagctctcatggataacatagggtatatcctaattggccctgtatgtcacatacttctcccctcagaggacccgatgtccccatcaatccaacctacctatgtgaatttaggtgcagttttttaaataattatatacaagttatatgaaagttataatgtagttatagtattgttacggtgtaattgtatgtaaccacaatgtaactatatcctaactattgtataattgtaatgtagttacactatacctggtaaaaaaaatgtagttacactataactatgaatctctatataattaacttgtatgtgaatttacatgtttttttaatacttatagacaagttatatgaaagttataatatagttatagtattgttatggtgtaactgtgtttcaattatatgttatagatacatttgaaactttttcacttaaaaaacttgtgtcccttctttcaacaaccacttagatacggctggtttttgccataattcttttatttattagtataattttgatctcataatttacaagatcattattatactaataaatagaaacatatggttaaaggcgtatctcttaaagagatattaaatatctataacataattttttttgtttgtagaaaacaaactagcctaacatcacatctatatgtacagacaaaacctggtaatatatataataatggtccaaaagccaaatgaaaacaaacagattaagaacaattcaatcatgcagtactttggctgtgcaggcagcaagctattactatttccctttttcataaaaacaaactagtactacagtactagctttgcattcacctaactagagacaggcgagtacttaattaaagctttacctttgcttgctaaacaccaccaatgggaagcattacgtacacagtgcccgtgtgcatgcatgctactcttcttaatcgatcgatgcagctaagctggttcctgatcaaaatcatcaaataatgtacggcgttaattaattcattttaaaccagcaaattcggcgccaaatgctaattgtgtactagtatccagcttctgctcgatcgatcttcgtctgcatgatcatatataaacgcatggttgatctgcttcttgctcatccactgatcagcaacgagtagaagcggtagagtttgctaggatcgattcagcaatggcagcggtagcacgagcactagtcctcggcgccgtcgtcgtctgcgccgccgtcgtgatggctgtcaccgccgcggcggacggcgaggcggcggcggcggtcgtcgtcggcttggccaagtgcggtggctgctccaggaagaacatgaaggcgcaggatgctttcaagggtatatatatcataatgatgatgataaattgataatatgttcatcgataattaattgcgatcgatatatcaccgtcgtcgattaattgtttggtgatgttcaggtctccaggtggcgatcaagtgcaggaacggcgacggcgagtacgagagcaaggccgtcggcgacctcgacggcgacggcgccttcagcgtgcccctcgccgccgacgacctccacggcgccgccgactgctttgcgcagctgcacagcgcggagagcagcacgccgtgccccgggcaggagccgtccaagatcgtgccgctgtcgtcaacaacggacaacggcggtgataaggctaacaccttcgtcgccgtcgccggcaagaggatgcgctactcgtcgtcggcggagtgcaactcggcgttcctgtgccccttcttcgactacttccacaagagaccccaaggccccaagccgacgccgttgccgaagccgacgccggcgaacggtggtggcgcggcgaacggtggcggagctgcggcgccgtctcccagccctccggccggcatatcacagctgaattaattaattcgtccattccatcaatatcgacacttgcttttttgtttgatttcatggcatggttaattcttttggttcttgcatggttgatttcccaggtcagcttgttggtgcagaataaatgaaagttgtgagatgtgagaggagtactgtgactgtgtgagagatcgatcgatggatttatgtgagaacgatgtatgtgttgtatctctattgtttggcatatctaatgtgttattcgttgtatgcatgtaagctattgactgtgctttcgtccacttcgcacatacaaaaagttgaaattaaactcggtattgctagtcaatgggcatctatccttataaactactactccagctagtttggtgaggtggcgtattattgcttgctacagtgctgctaattgctttgctcgatgtactgctgctgctcactaattggcccaagctagcccaaagcctggctactctatttgttagggagtaaagtacactttgactccctcaagtataggtaatccgatttgtattcctaaaacacaatagcagacgtcttgactctttacctattaaaactagtgtaatttaactccctcgataattttgagagccgttattgctgacgtggcatgttgacctagtccaacaaattaagttagcatgtggggcccacatgtcagtgacccttctatttcttctcttcctttaccactcctctccctctccaatatttcctctcggtggcagaatgccaacagtgcagtggtgggatgtagtagggcgacggaaggtggtagatgagcggtagtactccaagcaccactccccgacgagccactactaccaactctaccaccagagctcgccgccagcaaggttgcgccgtcatggagctcgacgctgaggcacctacggcggtcgaggacatggagcgggaggcgaaaggaaggaggggtgatacaggtgcttctcatccacctactagtgagtcccgactctcttccttgacccatcctcaatcctcatcaccggcgttgttcatctccgcttagctagcatgagcaccgtcagccctgccgcatcttcactgtgctctcccctttcttttccgccaccgttcctataagcactactagaaaaatgatttttcatgcggttggcatattattttagccggcggccatacgcgaaaaccgacagcaaaaatatatcgaggagtggggagccatggaccgccagcgaaaaccgactttcgttggcggccacgctaagaggtccgccataaaaaaaactctatttttcgaggcggacctcttaggtgtccgccagcgaaaacgtgattttcggcaggtagcgaagaccgcttcaaaaaaaattgaggccaataaaaatccaccgcccgcgctgagtactccgtccttatccttctcctcccccttctcctccctcccttctcccttctcctccctccctaccgccggctcccgtcgccacagctccgccgcctcactgctcaacggggagggcctcgggagcggcggcggggcacggcctccacctctccgccgcgggccacgcgacgacgagggaggccggatccggccgccgcgacgacgggggaggccggatcagcctcctcgacgacggggcaggccggcgggcgacgacgacgaaggggcctgacggcggcggttgggggaggccggatccgcctcctcgacgacgggggaggccggcgggcgacgacgacgaaggggcctggaggtggcggctgggggaggcctgatccgtagctgccacgacaggggaggccggatccggccgccgcgacgacgggggtggccggatctgctgccgacaccgacacggcggcgggggagggggcggcggggagcggatccggcgcctcctccctccccacggcggcagtgaggtggcgacgacaagagaccggcgacggcacgaattttttttttttgcatgtttcctgatgaatgttgtgatgtttgatttgtgtacatttgttctgtgcatgttgtgatgtttgatctgtgtacatttgtgctaatgataattttgtattgtgtttgaatttggaaatgagtagccaaatggatttttgctggcctttgctttgtgacgactgcaaattccgccagcgaaaatccaaaatggccgccactaaaaagttttcgtagtagtgtagtaaagtcatagcaatgacgaggagcgtggccactccatgacgctctctatcttttccttcccgagccacgtgggcgcccggtggcaaattaaagcttggcccaagcggtgaggcggtgcgtgcagaggaggcacttggcgatgtctgccatccatctccttcattgatgtcgccttgcttttgctagctgccatctgttgaaaagacggtggggaatcctatcggcttctcctaactgccgcataagggaggagtggagaaataaacagagaagagcgaaggaggaaaaggaagggacaactggcgggcctcacatgcggacttagtcggttagactaggttaatgtgccacatgagaaaaactactctcaaaaccaagtgaaattacaccaattttaatagttggggtgttaagatatctaatattacattttaaggatacaaattagattggacctatatttagggagtcaaagtggacttgtttcattcgctgccctacaactgctactgcatgcacgttagctagcttctcaacacaaagcaacccaagacccgattatcttaacgtggcccaactcctgctcttcttccttttcttttctcaattatttcagggtcacatagtacctctccatttaaaaaaaccacccctcccaacatcagtgttttttttagcgaaaatcggtccactaggaaaagccgaataatttctatactgatactagtataataggagtcatatcctcctctttccctcaccatagtatatacctcctcctagtgtacgaactcggcgattaggagcgatggccgctttgatttgtggagaaggagatttaaggagaggagaatgagtgattttttttggaagagtttggggcttctgtttgggaccaaaagctcaacatgcattgagacacatcaccctttaaaacttaaccattggatcatttttgaaacgcacatgtagttcatgacatccgttggattgtttagaacagaaatgactatctcttcctgtaactgagaaattaaagtctttacttatttctattcatgactttaatatgttagcttttcatgcatgtgtcaatttatttgataaccatagtccacaaaggttaagacattcattacaaatgtatcatactattgttataggttcaatttgaattggtaaaatatattattgtgattagaatggcaccaacaatatttaacaatgttctcataatattaaagcgttagcgtaactatttatataggattggaagtagtacgggacaactgttgggctataatttcccttttttttaaaatatatcagggagtaattatatttatggcgcccataaatatatatataggctaatgttacaaacaaattcccattttttcccctcagctttgggctgaattccaccgaggcagcccagcccactccagaacgccagccagcctgcctgccacatggggcccatttctcagatcacctcgtccacctcgcgcctctccaacgccgccgccgccgccaccgccaaccgccgcacaccatggccctcgcgtgtgcgtctcatttgcgccgcctcggagccggagctccggcgagatccttccacgcgcatccgtaccaaggtgggtataccccctccccgattttcttccgtgctttcttttcttggtgattgaattggatttggagcgtgattcctgcgcggcagccaaggtcggcgtggtggagttcctgaacggggtcgggaagggggtggagacgcacgccgccaaggtggaggaggcggtcggcggcgacctccagagcctcctccacgcccgcactctgcggctcaagaagctcggcatcccctgcaagcaggtaatctccttcagtcgagcctcttggttcatctctgtatgtgcagattgagcaacggattgtgattatgctagtttcctctgctattcagcatttcggaatgtgattatatgttttggttagatttcgttgtatgatgctgccgttattagatgtcgtcgttatttttgtttcatagaagcgaactgatccatatgtgtgcttataacaatggctcgttgtattatgcctacatttttgtttgagaaattgttggatgcatgattaaattttgagcaaatttcacagaatcatatgctttgtgttccaagttgcacaaaaaccacaggggtttcggcactcggcacttaacaactataagtgtcgctttctcaggaatgtttttgttatttcatctgagtggatttcaacttatttttagttaacagattagctaatgctatgtaattcggcatgctttgaggttaacgttttctgatggtaattttgtctgtgtgttatctaactcttggctttgaacgaatcagtattgtactaggttgcttatttctctctagactgctctggataagcatttgaccatggaaacccttatgttttaaaactaaacttttttcttttgattaataagctatgtcagtgttaatgttttttctaaaggaatatagataagtgttatgtggataattttcttttgtttggtcaagtttcagcatccaagtagtgaaagttaagtaattctggcatagtctcatactttgaacttgaagggaacttacctctctgatctgagatgttgatatattacccttttgttattgggaatgacttcaagtgaattactcaacagcgagatgtggtattccgaaccatgtttttcgtagagcgatacatttttacttaattaagctatgaaattaatcaattttttaatgcttttttagatgccttagtgaatttgacaatgctaaggtgtctagaatttgatgtgcaaaataacacaaattttccttcaagacaattgtaatatttggatgccaagaaagttccatggttttgcattgtacttaggctggattcttggttgtgaaatatacaatttgagttttacatgatattctgaagtgaacacacatgtggcttatgacctgcatgctgaaggaaatattcagttccttttgttaagtaatgggaacctgatcccattttgcagacaatgtgaagacattggctaactagtaactgtatacaaatttggagatgagttagacatctccttgccatgtttgtctccctcccgatctctgtttttaccgtttcttattcttcctttcttccttgagtttcttctctctccaatttgtatttgtccagttaaggatgatcttggctgtctgctgttaatgcattgtttggaaacttactatgtttcctttagaaagcagtcaaatcaaatatagtacgtccctttttttaataccttaagccaatccctttgaattatttgctgccagcatattgagactggaatcttcattagcatgtcatgatgttttctaggaaatagaacacctttgtaggtttgtcggtaatattgcttctcctaacctacagcacaagcatatttttttattatttaaatctcaagtaaaactctgaacattgctactaatattgaggttgatcacccgcccaggaacttaaaaggtagggtgctcacctaagctagtcgatacttgtaacatggttgtggattaggctggtggaatcatcttgataacagtatctttatttatcaactattttttatctgttctgagttccttgttgaggtatgtgaaaataatttttaggggatctattaagttctcttatttctcttttatacttgtgatgcagaggaaattaattttgagtttcgctcacaagtatcgtcttggtctttggaagccccaagcagaatccaagaaaacacagtgaagttgatttgtattgaagtggaccactttgaaaactgtttgctatcattatacttacctgggaaaatgcaacgaaagttagtttctaatttcccctagaattattggtagtgctggacttgagaatttgtcagatattgagttgtagtgtaatagtagtttctattcagccgtctgaaaatgtgcctatgctttatagcaacccttgcatggaatctgaaagttccaatcttatgcctttttagtactttgttttaatgtttttcacttgtgcgaaaataataaagtttaagctagcaatatgtcctaccaatagtagatgctttttactgttaggttaaactattattatttgtgttaaggtatttcgtttcttgtttgtacatctcagtttgtcgggttgtaaaataccatgtggagtatggagagaaacattcaggctatatgatttttcccctcttcaacatgttttatgccgaagtgatagactttttctttttcctgttataagcggtgcacatttgcacatatgagcacagcccaataggattggcccaagggtttgaactgggctacggttgggttgggttgagtggtgggctggttagctacgctattacaccctctacctctgtaaggctcaggggagaatagctaatatggtccctaaagtttcgctcctaggtcattttagtccttaatctttcatattgtctaaacaagtcctttaaatttgtcatgtgagctaatatagtccttggtcccaccaaaatcgccacatggacatgccatgtcaccttcctatgcaaaatctttatgatttgtccaatttacccttatgcataggaaaataaaaaacaaaaggaaaaagttaaaaaaaatatatggtatatgtaagagtaaaaatatacctcaaaagggtgaaaaaagaagtattttttttcctatggttatgtctaattcacccttatatttatttttctatgatatatgtaaggctaaattagacaattcatcatagattttgtatgaataatgacatggcatatccataggatgattttggtggatccaaggactattctaggccttatgacaaaggttaaggatttctttgaaccatttaaaaagttagagactaaactgatcctacagagaaagtttagtgataaagtagctattctccctaaggctcagcaagaaacaagaaacagcttagaacaatcctcatgtacagtataatcaggaaatatctaaacttttgggtttactagtaagtccttgtaggaagtgcatctagcaaaaatatcttgaatatgtattaatttagtggaaatttgttcaagttgaccttaaatcagctggattagaaaatttcatggaaattacgatttccccttttcgtcccaggaattgtacctcttatgcaattctggaagttaatagggccaagttgagtctttgtatagcaacgtacgaccatagtaattaaacacatcctagtgcataatattagaatgtctttaattcggttctagattgggtgaatactaatttatgggatcttattacgaagtggaaagaacacaaatacacaaataaatatcatattaattaaattaattccaacaaacaagcaaacgaatcctgagacaaatctacctgatactaacacacctgtattgactcaaacctcacaaatcaacctgaaaccttattcgatcgacccaagaaactcaaaatcaactaacacaaagctgtctgcgctactccaaccttgacaacaatatatcataatggcattaagctaacgcagagcagaaatttaaaaagaatcataataatgtgtgagctcgatcgacggctcaattagttcctcgccggcgggtggtacgggctcggtgttccgtacgtcggcgtcggcttagggtgcggcggctggtcggggtgcggcttgggcgctggcttggtcgacggtgcggcgggcgccggcttgttgtggtggaagtggtcgaagaagtgcttcttgatgggctcgcagatggtcgccgacgcgcacaccggcgacacatagtgggtcttgccggcgacggcgacgaaggtgcgctccgacagctgcatgaccctcgacggctcctgccccgggcacgccgcgttgttatgcgccgcgctgtggagttgcgccacgcagtcggccccgcggaggtcggcggcgagcggcacacggaaagcgccggcgccgtcgagcttcccggctgccttcgtctcgtactcgccgtcggcgccgttcttgcacttgatcgccacacggagacctgcgcgcaaatatatatataaatctcacttaatgtacagtttactcctctattcaatgaaattggcagcttgccttttctaaaaaaaaaaacaatggcaaatcaaataagataggtaggctgtattgatttaataatcctaagctgaatttaataaactaacaatagaacaaacaaataatcctaagctgaatcaaacagggccttaataagctaacaattgaacaatgatagaagatgcattgcttagcgggacaaattgatattatatattattatttgaaaatgtttagaatactaagaaaatagtgataatcaaacagggccttaataagctaacaatagaacaatgatagaagatgcattgattagagggacaaattgatattatatattattatttgaaaatgtttggaatactaagaaaatagtgagaaaacctgcgttcaaatggattcgaaccagcacgcttctcctggcagctccctgccagctgagatatgtgctgtcctcgatattatatattatatattattataaatgtactttcttcttccttaacgtagtgtagttttgatataagaatttgtccataaaagagtataatattacattggtccactagatctttttaatactattatatatatttttctcttttttaaccattgacccaataaaactccctcctaattattttctcaccccttctcgttttttccctgtattaataaaaggacataataatcttataacttttccttaagatgtgtgtgtttgactagttaaaattatacttatctagacatggagtgagtaataaataatttagaataagttacctaggtaatgctaagtaatgctgatgtataattttttcaaaagaaattacaattttaaaaacatggcacgaataattcgtacataaaaaataatccgaaaaagaacggggacacgatctaatcatcacgcacccttgaaggcggccttggccttcatgttcttcctggtgcagtcgccgcacttggcgaggccgacgacgaccgacgccgcctcgccatgggcggcgaccgccatgaggactgcgaggagagctagcactctacctgctgcagccattgctggactgtgtggagagatggaaagagtagctatctgatcgagctaggtgagtgaggtgatggatgaagaagatggtttggagatgcatgggtttatataggcttcatcgatcgatcgatcgatcgcctgctagctgcaactgtgtgcatggatgttgataaattgaattgatgatacagctcacttgatctgcgggcggtgaaaggtacagagtacgtagatctgtagatcgatggagctgccaactttcgcgccgaattcactgcttgtcatcaatgctggatccgtggatcgtagtgaattatagtgagtaaaattaaaattatgaagcgaaaaattctccagtttcttcttgtactagaacgaaagcatatggaatgtggttcttctctgacatgataggcagctagcttgactttagggagatgtacagtcgatcagtgtactggtcagggttcgcaaatcacactttggtgggtcccggtagaattgtggctaattaagctaatctttgatttttcctttttagaaacatactataaacacaagatgcgcacacacactctctcatttgagaaaacgaaccgacataacttaaaattgacgaagtttcaatagacacctcacaatcaacgagtacgatgtcacgtacaaataaaattcgggtggattgattacactataaagaacataaccaattgagttatactcaccccataatctttgaatttagccaaaagttattacgagtaaatttagctaaaatatgttcaaatctcaatttcaaaaatattatttatttgcttcgaactttcaaaaattttgggatttggtccccccgaaattgccaactgtaccattggtgagactaattgatagcacaataatgacggatacgtacgtacgtatacatcagaagatcagtacaggtagattactttaattcgtctacacaaagaaatatttcttttatggcgaatgaaacctaatatctttagtaataaaaagggcgtaaattatgctcacgatataagatttaatagctacgtgcgatccatcaaaaacttttttaaaaaaagcgtactgatataataacttgactagtgcgatgataaaatgtggtacaaaattattttgcatacgtaagaattcaacctcggcaaggaagcacgtgcaatggttccctttggcagagctatacaggaatgcacaacttacctatcgaaataaatgtactcactagactggtccatatcatctctgacaggctcaaatggtcatttgtgatgggtactatcctcgttagagataagtggttagtggtaagtccacctcacctctgacaggtgaaggcccatcaccggtaactatctcctaaacagctcctaagttctggcccgtcattggatgctatctctcaaacgactcttttaagttctagcccgtatttggtaactatatctcaaacggctcctaagttctagccgatggccaccctgagcttgggggccgccggatctggctgcccaaagcacgggagccaccgcgaagatggagattatggcggatgttatgaaaataaatgcacaacggagacacgaattttacatggaaaaacccttgcgggagaaaaccacgggcgccgaccggcaatgatcactatagaggaattggatacaaacgcaggggatacattgcgctgtcacaccctctccgtgcagcttacaagggatatatataggagaaatctaggagtcctagtggggaaagacttagagtcatactaggaaactaatcctataaaggagagtcctattagataactaatccgaatatattgtgggtccaaaattcggatcacatatttaacaatctccaccttgatacgaatttcccttgttgcataaaaatcttcaatctccaaacaacctcatgatgataaaatcaatgtgcgccaaatagtcacttggactataatcataacacccttgatccagaagaggcattgggaatagatcctgaatctactagtataaaccggtgtgaacctagcagagacgcgaaactaatgcacaaacttcaaactcgccatgggaataacatcctgaatctgctggcattaatttatggaatcctagtagaaacgcgaaactgatgtgctcaaaacgaagtacttagatctccacatctccctataaccttctgatatactgggcaaacggacatagcaattccgccggaaatttgaccatctccacgtgatttggacagcaaccttgcagctccctctcgacgactttgcttgtgtgtcctgaaatatgtatgcgcagctgataaactggtcacgacagtattagctcctcctccatgaaagatgtgccaacttgcaacctcacttgccataacaagaatattacatctcaatccagaagcagtagatcaaacttcaaactcgccttaaaaataaaatcctgaatctgctggtacaatttgtcaaaccctagcagaaacgcgaaacactctgggtgcgtaaaacgaagttgatctccgtgcagaagctcctggtagactggcttgtgaatatagcaatctggaacgtgaatttgtgtccccctgaacagaaccaaaacaatgcaaggcttaaatccctggtgcgaagggcgtgtgcacgtaacaattccaacgtgaaatttaattcacatgaacagaaccgagaaggctgctgaaggcttggacttttctccttcctcgggatgcgtgcggaatagatcaatggcttcaaccctgctgctgcttctgattttctcctgcgttgcttgatggacgtgattcagatcgatgtgttggagcacctgcttaaatcgatctggtcgacaccgcttcgggtttgcttcaccggtgattcaatctcaccgaattgatttctgcgacgatgacgacgcgttgctgctgtggccgattctccgcgacgtgcgctgctgctccttccccggcggcatcgacgacgaggccaatcagatcgatactccgatccgaaaaatcacaccggtggctgtgtgattagtagatcgatccctaatgctataaaaatagatgcacaacggagacacgaattttatatggaaaaacccttgtgggaaaaaaccacgggcgccgaccagcaatgatcactatagaggaattggatacaaacgcaggggatacattgggttgtcgcaccctccccgtgcggcttacaagggatatatatatgagaaatctagaagtcctagtgggggaaagacttagagtcatactaggaaactaatcctataaaatagagtcctattagataactaatccaaatatattgtggatctaaaattcggatcacacatttaacagcggaggtggagaagacgaggtcggcgagctctcggccctccacccagcctcatccttcacccagtgcgcctccctcctcatctccccttctggtgatgatgagctaggcagatttggacttctcgccctccgcttcaatctttgtcttcccctccaccaccaagcagtgcagccttcaccccgagttcccgtaggtgccggcgcggcctccgaccctacgcacctgcaggctctggttttgtcccaaatctactgccgcctccaccttcgaccacgacctcccaccgatgccgacgccaatgccatcaccgccttcggctccgtgcacctgccggcaccgccttcgtaaacatcgtcatccgctaactccacaggatgatgacaggaagagagtgggctgagagttcgagagttcgagagagagatgagaggtcaagaaagagatcgaaagagaaagggtggagagagattaaaaatgaatttatcattggtggcttctattagtgacagggtgaaaaaaaacctttggagattgacttttcatctttaacgggttagatagacaacatgtatagagctgaaagttaaacttgccactaacggccatagtactaacctgtcacaggttacaggtcacttgtgacgagcctatatgcgggctcgtcagaggtgttgtctgtcgggcgcacatatagacccgtcacaaaaaccacttacctatgctgggctgcatgcatcctcactgtttttctttttgatgagggggggggggaggggattttagtcccggttcgcaacccaaaatattgggcccactgaatcttattgttttttaggttgactggattgtcacataagcgacatgtagattaaagtcgctctggattgagttagggggttatttgttcggtatgaaaagtttggggtgtagaatatttggttttgtagcttatggggtaattcatactagcttaatagttcaggaggtaattcatactttttccttgtataaaagcccaaataactaaataattaaataatgtctttataatgcaacataatttctgtgataaatatgaaaaatcgaattatgctcttatggttatgtaattaattaaggatttaaggaggtacggtttgtggtatctgtgggtcagtttatatatagatcgatcaggtcatattcttggatctattttctaccaaagtcatttatttgtacctttgtatttatatactctagttgtaacagccttttacatacctggtcaccttttcttgtggtggtcacatctccctagcctaaatcaataagctggcagacgcacaacgccacaagatcctcagtactatcacccacatgtatggatctactcctagcaaatggttttgaagttttttttacgcaatccatgcgtgtctgccgaaggaagatgagttctagccattaatcgatccctcaagggaatgatatgtgtattttctttctcaaatgtaatgcaaactgttacgatatttttttacaaaactagaaaggtagcccgcgcatatgcgcgggcattttatttaatatgcatgaaactttattacggatgtccatgtgtgggtggcttctatcaaaaatattcttttactttatcctaaactaaaattgaccttacttaatgtacttggaatgatggttatgatttttcttctaattaccctggcaacatataaattctgaactaaaattactttaaaccgtgtagtttttaattaataataaaattttgtgtcgaaacaatagatgtgtttactatgaatgtccatttttttttgttagattctgtttgaaattttagatatattcattttattagtcctatcaaaatgtttgaatatttctatttaagatgggttttgagcccagcaaaaaaatttagtattagataaattttgttcaattttcatttcatttcttttcatcttcatcttttattttttgtgggaaattccactctatgaggcatccttaaaatgctttgatatctacaatttgggatgaaaatataactgggtttatcctgcaacctggcacggggtaaagacatctgttctaaattatatctctctaattaagtaagaaaatttaaaatagaggtcgtagtattttttttggcaaattaccactaaattggagtgtcatgtaacaaaaacatgtttattgttctatgctagatgtcaggaattcacgatgtaccggagcaagttttacaaaaaaaaaagaaagaaatatacatgatcttttaattactatctaaaattgccctttatattcctatggaaacatcatggttgtttcgctgttaagattccaccaatgttcttagtacgatcggtatgttcaactgaccacgtgacttcatagagcacatatataatttagatgctatgattattttaagattatttatttatctctaaaaagatcatttattgataaaagcatcaacatcaaattgtatggatgaatagctcctatatacatgttgagcaaaaaatatttaagtcgatagaaagtcgttagatgtctaacgggatataggtaatgggtctaccagttttgtgaaaaattaaggtgcgatattttttatttttagtgagaaattttagtattttcttatacttagtggaggcctcaatatggatgcgggttgtagattgtaacttttttgttagcatttaaatatagtcaatatggttattaaattattgatttcacttaacaaataatgtgatagttcaaacatatcataagagacatatggtggctatacctaataggtggaggttcgtttgtggtcttctctttgcccactaagataattttaattttaattgtcaagaaataaaaaaaatatagaaaagtaacacaccgcacacgggggatgggaatggagagggagggttgggatgttttttttcttaaaaaaagattgatctaacaacctaaattaatgtgttccgatggtcgaatgttttatttttttctcggatttattaggattttctataatttaagcgggacaaatagtagcttagcatagcgtttatgtgctttaatgtctatagggatggagtggaagggaagaaagtttgggatgttgttttttcgaaaagaaaaaaaataataacgacgtaaaataatgtgtc

SEQ ID NO: 25344 - DNA, 3650 bp, Oryza sativa
gtaatcatggactgtgaaataaagttaaatttgagttgttttgttgataggtataagtatgaatcgaattattataactaggtatatactcacaatttgaaaattttaaaaaaattgagtgattttgtgcattagatagcatggtgcccgggcactatggtgccccatatgagtgcgtatatatatatcaggttgaatgctccatcaagcgaccattgatgatcctattcattgttaatttttcttccagttatattctgatttgcattcttggtctgggctatgatcaagtaacggtagtagcgtattggccgctggtgccgaaggaaccgatatcacatgcgagattatttaattatctccgaggacgaacataccctttctaattgattttcaaactgttaagcaccttctaatcttagacttatctttaaaattcgtgcagtttttttagtgggagagcgaagcgcatctcgataagaaaacagagaaatggcataaaaatcattacgtgcggggacggtgggaggatctaacggtgttaaataatgggtccaccgatttaaatgaaaatcaatggttagatttctctattttattagagtgccacgtggcgacttgagagtatttatagagtgccatgtggcggcttgagagtgtttgtagaaagtttaatggacttttagtatataataaatagatttggtactccctccttccatttatatatgaaattggttatatgacgttgcttagttcaaaccaatatcatatataagggcatgtacaatggttatcaatagtgctctcttagcgttgctaattagtaatacttgttaacatagaagaaagagaaagagggagagacaaacatcgttgttatgcataacaacgtcttaacaacgactcttaattactataatatggaaatatggttgcatgagggtaaaaaaatggaaagaatattaacaaaaggaatattttctgagttaatgattaaagccttgtcgtcttaactactgtaaagacacggtctctaaataatcttatattgtttaagagaccatactcgtctttactattgaatatgccctaaatggaaggagggagtatataatatagagggtagttatcgatctatcgcttcaccaaaattcaagttaactttgtcagttatatatttagtattttgccggtttgtttatattttacatgacaaagaaaggttagtttcttatgaaagtaaatactttacaaaagtgtctaagtatgcattcggataaagtggttgggatctcctcctctgtgcacgtaaaaccgggtagcttattaacgtatgactaattaattattaactagaaaaacttgtaaaatagataatttcaatggattaatatactatttagcaattcgaaaagcgtgctattgaaaaaagacggaataaaggatgagaacaggcctagtttctactacttcctaaggcggcctaaagcagttttatcttgtgtacatcgcgatagatataaccatgcatgaaagaaaacataaattcgcatgaattaacacacaatatcttgtctgtcagattcgctgtccatgttcatgaatttattatccatcaagatgtagcagtgcgtttttgttgtccttgatttccagctttgggatcatcggttcaaattgcctctaccctgttagctaggctgtgagtatatatagttagatcttacttgtttcgaatgtcataggtggttcttacctgtttctaatgaaatatatatataacgaagagggatctatttagacctgtctctaataaatacagagtatatattgtagttaccattccaatgcaaattagtttgaatctcccactcatctctcgcaaaaatcatattttaattaaactgctagccaaaaaattatcattcctcttctttttcttcctatttttcgtctccttgtctcctcgtctctcaacacttacatcgctttagtgaacacgcacatacattctagtgatcacccaagtagacatatctcgtgtggtttttcaaatgcaggctagctctcctacaatcttgcctagtgagatttggtgctcacttcatcagcctatgtgttagactctccaatataataatgggaccgataagttagcctcactttggatgcatcccccctttctcttccggtggcgagtacccaccccatctatatcagccattgcatgcatgagagccggtaaggccaactctagagccatcgcatagaaatataggaagctaggaggagggcggggtggctgcctctgtcaccgccgtagcacggaagctaggagagccgtctccggtgccaccacacgggagcagaggcgaggagaggaggggtggggtggctatatttgtctcatcatgctcctgctcttgcacacctgatgcagccaagatgggcatgcaatgcttataaaacgattttcacatgccccatgctcttctcacagggcgccccaaaagtaagttcaattgtgaggatggcttaggccgcctcaggattatcaaccgctatctattttgaaagacggggcattttatttccaccagcggtttttctatggattaaaaaaatcatttttagaggtgataaaaatggggtaatatttacaggttgttctcttatgaaaagaagacaggtagatatcgcaataacaaaatcaattaatgtgctacaccaaggacatgccacaaaaattttagagcaaaattaattttcgctatgaacttccaggtcaaaaaaattgatggtggactttgtccatgatcagcttggatgcgcaatcaggagcagaagaaaccaagcttgttttacctcaatgaggagtaggagtgaaaatttttaagcacattggaacacatttgcatggattaaaatatgaaaaatttgtgggccttaatttctaggagccttttcggtcacctacttcacactgcctcaacgacgtgcttgtatatatagtatggtggaggacccctatcatgtcccgtctttagaaatggattatcagcggaggctaattcaaatcatccgttcttaaactaaactcatggggttggtggtttgaattttcatccgtcggacgtacttttaaattcgtgataggagtggtaaaatttttttgtgctctagcttagggtctgtttggcatagctccagctccagatccacctcttctagagctagagtctagcctagctagagctaggtggagctaggtggagctctctcacaaaatgaactagagatgtggaagctgggtttagctaggcagctccacaactccactccagacccaactcctagagttaaatttagggcctgtttggcacagctccaactccagctctaccccttctggagctggagctcagccaaacagtttcagctccaccaaaactgggagtggagttgggtggagctctctcacaaaataaactagaattgttaggcagctccacaactccactccagacccaactcctagagctaaatttaggagttggaactgtccaaacagggccttaggagttgagctctacagctccaactcctaaatttaattccatgagttgagtctggagatggagttgtgg

SEQ ID NO: 25345 - DNA, 6679 bp, Oryza sativa
ttaaaaaacggagggagtatattatagttataatgtaattacattgtatacaatcgtattgtagttacgttcaaaagtttaaagagagttttttttaactgtatagctagtctccaattagggaaccacgttagacgatttgccaggatcagacagtattgtaccttacaattgagatcaaacaagttgcacatatattatgcacatccctgattatattaattacttgctgataccaaacaaatagacacacacacacaaattaaacttgtgagtaaaagctaatgcatcaaagaaaaccattattctgcagacaaactgacatgacaggaaatcatatgcaacaacaccaaacgtactaaccaaacgaaccatgcatgcatgcaaacttccattgcttaattcgccggagggctagggttgtggtactctggcgcaggctgcggcttgggctcgggcttaggctcaggcttgggtggcacgggcttcttgtggaagtggtcgaagaagtgcttctccttcttgtggatgtggtcgaggaatgggtgctccggctcaggcttgggcttgggtggctccggctttggctccggcttgggtggcaccggcttcttgtggaagtggtctatgatcttcttcttgattgggccgcagatggtcacggacgcgcacaacgccgatcggtagtgggtcttgccggcgacggcagcaaaggtgccctccgacattggcacgatcttggatggctcctggccggggcatggctcgttggtggcgctgtggagctgagcgatgcagtcggagctgtggaggtcggcgtcaagggggacgctgaaggcaccggtgccgtcgagctttccagtggccttgctctcgtactcgccgttgccgttcttgcacttaatcgccacctggaggtctgcacaaaagaattccaaataatattgtcaatcacttgtaatcaactgtatcttcctctcgatcgacgatgtaaatcagctcaatgatcaattccaaataaattgttacgtactcttgaaagcatcctcagctttcatgttcttccgggtgcagtcggcgcacttggccgtgccgacgaccaccgacgccgcctctccgccgacggcgaccgccatcaagacggcacaaacgccgaggagaactagtcctcgaggagcacctgccattgctgatcagctaatcctagatagctctgtgtagctaaatattgctgatgtgtagagatggatgaagtgaaaggtgaggcaacgcgtggtttatataggcatcgatgaatacaaacacagcttgcttgcattattgatacatcaatcgatggatcgaccagctagctatgagcaatgcaaaaagggccaatttggcgccgaatttgcagatgggcgaattaaggccgtccaaactgaatgatttgatcacgtacgtccaatatagtcgcctctgcagctttacctacgacatcataataatctatcgatcggttggtacgtatacgtaggatctacgcaccgctttatgcatgaatgaatcataacaataattaagtacaataatcgaactgggtcttaactccttgtaaactgcggttgacctctgtttcagcagtgagttacagtgatcggctacttattgcaacactttccaaatgtactgcattcatatcgtgctacattcgtccaaaagacaatatatatataagcaaattgtccctatatataatcatagcattcaaattttgttctgaaaagaatgtaattctaaattactactaccactactacaaagatagattctcctggacaccgcccccttttgttttcatgcggtctgtaagtggaaccgcacggaaaaatagggggaccggcgccgggttctcgcccgcatggaaaaatgcattttcccgtgcgggcgtcttaatccgaacgcacgggataattgtcattatcccgtgtggtcgacttaagatgaccgtatagaaaaatcgattttcgcatgcgggctttttaagtggaccacacaggaaaatacctcccacctttccctcccacccacttcaaatttttcacatcctctcccttcctttttcccttttattctccatcaaccacccccctctctctctaccttatctcctttctcagccttcccggcttcccacctcctccccaccttcccggcttcccctcctcctccccctcccctcctccgtcaacagcgggcgtcggtggcggccccttccactcgtcctccccctcccctactccccttcccctctgtcaggccgacgatggcggtggccgggtgaggcggcgaccgagcgaggtcctgagcagcgaggcggaggcgtcgtcgtccgttcgtctattcctccgtccaaagataaccatggtgggaccctcctcctggtcgtcatcctcgtcgtgcacgttgtcgctcgggtccctcgacgacgatgccgtcgtcacgtgcgtcatcaaggcagcggcggagagcaggtggcggcgagcgggtggcccctttccacggtcgtcgtcctcgtcgtgcctccctttccacggtacaccagcgaagcagcggtgagcgggcggcccctgcccggatttggcgcgactgtggcggcggcgggtgggctcgacggcgatgacggtggcgggctcggcgacggccgggtgcgtgcggtccggcgggcggcggcgattttcgctttttttaaaaaaaattttggttttttcggttctgtgcaggcggtataatttgaccacacgggataatcgattatctcgtgcggtccacttaacacgaccgcacgggaaattgattatcccgtgcggtagagctgcccgcacgcgaaaatattgatttttcaagacacttgggtgcagacgggcaaatcctctgcacgggaaaatcatttcgaccgcatggaaaaatgttttttgtagtagtgtacatccgtcccaaaatataaaggtggaattaaagtgagaagatttgaatggtgaaaaatcatgattgaagcagggtaaagtggaattaaagatgaaggatgcaatacatttagaaagtacaacatgccaatattgcaatacatttagaaagcacaaccacactattattacaaccacatgcaaaaaattacaaaatgataaaagggacctaacaaagctagaataactcaaacactaaacatcctattattggacggccaacaattatttaagataaaaaaagtgcacctttatgatggttgtattaccactatcagtattatcactagtagatcgaagtgagatctcaaaccttgatttatcattactacaattaataaaaaaattctagtaccaatagtggcagtagtataaatagatacgagaaccattaaattaaaaaagatgaaaggcctatattgatctgtactaagagtaagactattgtaaaacatctcgctgtctagcttcaaggctcacaccaattatcatatgctgcaactttctcaagctgaagaataacgttttcctcacaccaattatcatatgctgcaactttctcaagccgaagaacaacgttttcctttgggagggcataaaatcgttttctttttgttgggaggacgaacatgcggataattcaatttagggccaagagcctacatatatgtactgagatgggccaaggaagaaaaagagcctactattcgttaattgaaattttctttgctcggtacgtccacttgtatttcgctgatggtttttggctgtcaaggctagttgagttcatggtagtgcaagtcacgcgcactttacaaggacgaaaaaaagatgctatcacattactcctaattaatcacaatgcattcatgtggacaccgcatagaaaggtgtatgcatcctgcgtataggtaccaaccggctgaagaaccgcgtcgtacctaggcaacgtcgtgatcgaatgtgacaaggatccagattggacgtacgtgatcaaaatcattcagtttggacggccttaattcgtagcatctgcaaattcggcgccaacttacagccgctttgctgatcatcgaccgatcgatcggtcgagctgtattcaactattgatcgatcatcgatgatgatcgatgagcacgagaggctaagcctatataaatcgcgcgttacctgtctttctcttcatccattcagagttagcaagctcttctaattcatatatagaactcagaatggcaggtgctcctcgaggactagttctcctcggcgtttgcgccgtcctgatggtgctcgccgtcagtggcgaagcggcgtcggtcgtcatcggcacggccaagtgcgccgactgcacccggaagaacatgaaagccgaggatgctttcaagagtatgtagcagtttaccttacatgcagcttagctacgttatacttcctccgttcccaaataattttatttttcacacgttccacacataccaatgcaaaacaaaagaaaactagaattctaaaatcatttgtggatttctttgtgcagatctccaggtggcgatcaagtgcaagaacggcaatggcgagtacgagagcaaggccgctggaaagcttgacggctccggcgctttcagcgtccctctcgacaccgaccttcacagctctgactgcattgcccagctccacagcgcaaccaacgagccatgccccgggcaagagccatccaagatcgtgccattgtcggagggcacctttgtcaccgtcgctggcaagaccagctatccgtcggctttgtgtgcgtcggcgaccatctgcggccccatcaagaagaagatcatcgaccacttccataagaagccggtgccaccgaagccggatcccaagccagagccgcccaagccgaagccagagccagagcaccccatcctcgaccacttccacaagaaggagaaggacttctttgaccacttccacaagaagcccgtaccacccaagcctgagccaaagtcggaacccaagccacagcccaagccacagccagcgcctgagtaccacaaccctagcccaccagcgaagcactaaacattatctacgtttggtcttgtatgatttcgtgccatatcagtgtgtccgcagaataacgctttctacccccgtgtgagattatacattgaaatataatgtacttgctagctttcatccgcaggagttttttttttaaagtgtgaccgggttcatttattggatatcgcatgcatattagcagggcacgatgtgtactgtaatatctgcctgttgtttttatttctctacctaaatgaagttaaccacaaaggacaaacataaattcacatgaaatattgactctggattcgctgtgcacgtttatgaatttattggccatctagcgagaataagcagtgcgagtgtgctgtccttgatctccagccttaaatggggaaagcattgattcaaacgtactagcctacctgtaaattaaagtggcgtgcatggaatttaaatatattttaaattaattatatgctcatgcattaattatagctagaaaaatgggccaaaatcaattgttaataagtgaaaattattgcagttcgatcgggaaaaaatttaaaaactgggtgatttgatgatttttcactcttttgattgggaatttgaagatcgatttaccataacacatcattgactcaaagggtcatatgtgccatcaaatttgccgaaacagttctctcatatgatgggggatcactatcatacatactagacgacattctatgttttactacacgatatatagatgaataccaaatgaatatatgttaaatattataaaaatgataaatagatttggtttgagttgaaataatgggagaaatgataatttagcgagcttgtatatatgctgaggtttagaatgtaatgaattttagcatacttgcaagttgagttttatgtgtttaatgggacactatggtatgcttagtatgcttccttgttaagctttagttgctttcttgcttagtgggttgtaactatatacagaaggtatatatgtctgtgaagttgaaggcacacttcgatttcaattggaagatgacacattgacaaacaggcaacattacagtgcagaaaaaaaaatcaaattaacttcaatatgtgaattttgcaatttatgaatgtcttatcttccaaacgaaaaataaagtacatatgtattgaatttacttctttagttgtatgataggatctcgtctacacctgggaatttttgtgaatcgtttcaaaaggctgcccagagtctatgaagtagctaattaatttccacgatttcacacaaccagtggtttaattcacctgatattgcccaaattaataacatcaattaggatccttcaaattaaaataaatatatatacctgctgtcaaggaaagcctattcattaattcttttggtttaaatatttagtatatgttggaaattttctatcttttaagaactaagactagataacaagaattaaaaaaaggcaaaattggttatatagtatcgaaagttcacgtttttggttttatagcactgaaagataccggttcactttaatagcacctaaagttcaccctgttcctatttttaacactttcgtcaatcctcgatcgttttccgt

SEQ ID NO: 25346 - DNA, 7893 bp, Oryza sativa
gcagagaggattggacgtacgtgatcaaatcattcagtttggacggccttaattcgcccatctgcaaattcggcgccaaattggccctttttgctcatagctagctggtcgatccatcgattgatggatcaataatgcaagcaagctgtgtttgtattcatcgatgcctatataaaccgcgcgtttgcctcacctttcacttcatccatctctacacatcagcaatatttagctacacagagctagctaggattagctcagcaatggcaggtgctcctcgaggactagttctcctcggcgtttgtgccgtcttgatggcggtcgccgtcggcggtgaggcggcgtcggttgtcgtcggcacggccaagtgcgccgactgcacccggaagaacatgaaagctgaggatgctttcaagagtacgtattccctatgtagtttcgtattataagtcgttttgatttttttaaaagttaaatttctttaagttcatagaaaaatagtagcattttcaacctaaaacaaacatattattaaaaactttatcaaaatatatttaatattggatttaatgaagctaatttaatgtcttagatattgctattttatctataaatttagtcaaacttaaaaaaaataatttcaaagcgaattataatatgaaaaagaaatagtaatatttcacaatgcatgatgcaaactgcatcatctagagaaagatacagctggttacaagtgattcacaatactatttggaattttactatgcagacctccaagtggcgatcaagtgcaagaacaccaacggtgagtacgagagcaaggctgccggaaagctcgatggcaccggcgctttcagcgtccccctcgacgccgaccttgacagctccgactgcatcgctcagctccacagcgccaacaacgagccatgccctggtcaggagccatccaagatcgtgccaatgtcggagggcacctttgtcgccattgccggcaagacacactacccatcagcgttgtgcgcgtcagcgaccatctgcggtcccatcaagaagaagatcatagaccacttccacaagaagccggtgccacccaagccggagccgaagccggagccacccaagccgaagcctgagccggaacaccccttcctcgaccatatccacaagaaggagaagcacttcttcgaccacttccacaagaagccagtgccacctaagccagagccgaagccagagcccaagccagagcccaagccgcagcctgcgccggagtaccacaacccgagccctccggcaaagaactgatgaatatgatccgcactggacgtttgatcatgccgtcctgccccctgtcagattgtctgcataataacagtttgagatcgaagtcatgcattagctttcatcgacaggagttttaatttgtacttgtatctatttcttctctatcaaatgcagttatatatggtaagataatttatttatatttaatcagtactgttgtggcggactattcactgtatcagccaaagccattggatcgtaagaggttagcattggttaaagaaaaagttatttttatctgacaaactagtcccaatgacggaattttcctgatgttgatacgtcacgaataattttcgagacgtttttttgctttatcctagtgatttttggccatcataagtaatctagttgctggtagtatcttttaattcttagaatgtgcttggttgcggcttacaaaacgtgctacgtgcccaaaagcaaccaaaataatttggtgcttaattaacttttatttataagctatggctgaaacatagagaatgataaaaaaacatgtatactaatataaattgaatttttttaaattgagagttaaactgatgagttgccaagtacatacttcaatcatattattacccttataactatttgactaacaagtcttgcctgtctgtcgtaccccccattggtttccccctcagttcagttttaagagcgaaccaacctaagatgaataattcatgaaatatatgtacagtacgcgcacctatggattttcctagactagtatctcttatataagttctttttaataattttttagttttagttaaaatgaatgaaaaacaaaatcatctaatccagaaaatgtaaccaaaaaattgaacagcaaaaaaatcccccatgctagttattgtcctataatttggaatttgtcaagagttttatgtcttacacattgatctccagtcagttatacatgcatcctgatttcatgaacatttctagttcaactgtttaacagtgacatgcatggctaccagcagtagacatatgcatatgaaatagtagaacaaattccacagtaagacctttcacatttttttaataactctggtatggccagttgacattaacttcttccacaatttggcaactttttgtcaactctggtgattgatgcattcaccgaggtggccaagatctcattcttctggcattctgacatccatttcaatgctgtccacacttgctatccacaagtactggttcacctccctagctagccatctctaataccctcaccacccccccccaaaatcaaccaggcatcaagttgatcttctacatgacttccctatctactcccatgccaatcccatcgcatcaagaattcaaggtgacagtaaagtacttcctattataatcacagacaaattaactcagacaatccatacactgctcagcctaaaaaagaccagatacaggagtgaccacagtcaacagtgaaactctggaatctgaactatagttaattaattgggactattcaaccaattcaattctcacctgtcagatttttcactggacaaataaaaatgaccctaccaaatagcaattgggatattagaaaaatgggcccaactgatagtggcttgtacagcaaaaatttattaaattttcatgctgtgcctggttggatttctgctgacatcgcttcctaaatgaattgctagtatcagtagtaccaaatcaatctgaattaactgctagtcaccagtacaaaaaggtttttttctagacggcccaaaacctaatctcgtatgcggaaggtcggcctgtctgccgcaaatgatttgaaaaaaaatctgatttatacgtatgggatgtgcacctgcacgcgaaaatccaattttcgcgtgcggatgcttatgtcgttcacaagtaaaataaaaataaaaaaattaaaataaaaataaacataaccctagaatctaggcggcgtggcgcggatccggccatcgggcgcctgtggatcgagccattgcggggccggctcccgcgaatccggctgtcgtggggctggcagaggtggatccgtccaccgtcgtccaccgagccgcttgcccccgcgccctaggtgtcattcgccactgtcgtgtgccgcgctagctgccgcctgagcgctcaaggaagccggagccatccgccgtccaccgcaggccgtcgcggggccgatgcccgcggatccgtctgttgagggcccggtggcagcggatccggtagtcgcggggcccgcggaggcggatccgtccacgccgtccgccaaggtgccatccgtcaccactgtgcgctgcgcccgctagcgcccgccgccaccaccatgcgccgctaacaccgccgccgcttgccagtgagttagagaggagaggaggtgagagtgagaagagaggagagtataaggttgaaataatgaggagaggaagtgagaaaggatagggatgaaaaattttgaagtgttgaggagagaaatgaggaggtaactcagactttgggcggatccttaagaggctgtatgtgaaaatcgattttcgtatgttgttgcataagaggccccttaagttgtattgactgctatgtgtctacgggagttattttaaagatggcaatctatttcatggattgatagtcttactcaatatttcttatacttcctagatttttatatctagctcgtgggtgtgtttcgactgataggtgctctcattacggttctatcttgattcagttcactgagtttaattaatgaagctttcattatctaaaaatgtctagaagcattatctaccgtataattgttagggataatgacgttcaaaaacataaagacaacatctaactttacatgatgatatagtggtaactgttcaatacttgctgcacctagagagagagagagagtgacagtacagatgtatccatgtaaccaataatctagctacttctgcaggaaccaaccaagaattgctgcgtattggcagcttgcaatgaatgtcactcaatcaagcatgcagcaggagggttgctatcacctttccattgcattgccttaatcagattaatattgtgcagaaattaagcaaaaccacatgcagcctcgtgttaggtgaatttggcgccgaacggattgatgaaacagccaaacctcctcgagctcaactaattatatacccgattttaggctaatgtttactcttaattaagcaatgaacctagatgtaagaaattacgcgtgttcactcttagaattttatatgataatagtagaaataacaagatatgtagataggtagacaacataacttcatatgcttcatttatataaattttatctttgatcgactattaaaaaaaagctacaaacaattaatatggtgatgtttgatttaaaaaaaatgttaaaaatatagtcataattcgacatattttaataaaaaaacatgacagtaaacatgacatgtgaatgaaatgatgatccaatgtagtgctaaacattaatatgtaatagtaatagctagcatcatgcatgtagtaacatgtttagcaataaactgaatagagcattatatttgaagaccgctccagatttcagatgagtcattgttgatgtgttgcctctgttgtcgtcgctgttctctcctctacctctgttgctaatgttcccttctccactggcatcgttcttagtactgatcgacatgatccaagttatctatgtagaggaaagagaacgtgacgtataggatgcaaagccaagagcagtagcgtgaaaaagtgctccctaaaaacttgattgtccgtctacctatccaggtactcaggtggacagagttctggaggcgtgtcccaagtacccgtgcacgtaggctgcatagaaacagaagaatagagtgtgtcgtctcacggagaactagaggagagatctgcctatacttggaggataacgagagagagggagacgttatgggagggattaatttcgattgagtgctccgcccattacaacagaacaagtctccgtcagttatgtttttacacataaaaatgaaacatcctgaaggaatgcagccgttgtcgcctcgctctcttgctcgcacactctcctcggcctcctccacagccatggcctcccccggctcggcgtgactgcacgcacgcgtgtgcagtcccaccaccatatcaactgctaaatatgtgctctcagttaacagccaatttaagatgaggtctttttccattggtttccaaggtagtattaattaatcccatagcattaattgttggcctttggaattactaggtttaattttaggccgatatcatttaattctaacaattcccaccgaattttaaggctcatagaaaatgttctcagctttgtttttgtttgttataccagtgttttggttgagactgttaacttgaactttcacccagaaaaagaactacacctgaccacaactgattaatggattatgtcttgaattatcagtcttgttcagtcaggctttactcaattccttaactgatactaggctggcattagcatcccctctatttggagcatttaagtcatactattggcttttccataagtatctagagatcagccaaattttataggctgtgattagcagtcggactcatattggtgtgttccttctaagatgttttataggccaacatctctactttaagaaaaatcactcaatcacattaatgtatctccaacttgccatacagaccaggagagaactacatcaaagaaagaagcctttttaaggtctcttctcccagctacctaataggatgtttcgccaccctaatttaccagatctttgatcacataggacaggttaccactattgtgtagctcaagtatgtctcaagcccatctcactcgatgcattgtctgtcacaaacccgtatggctggtccatatagctcacctcctccaactccccattaagaaaagttgtttcaacgtccatctgatgaacgataagaccataagaggctaccagaacaaataatactcaaattgtggtcaagcgagcaactgatgaataagtgccgaaaaaaatcattgccttatttttgggtataacccttggccataagtcctgccttatacttttcaattgtaccatcaggcctaaactattttcttgagaactcatttgtatcctataggtttgcagtcgtatggacactcgacaacttcgcaagtaccattagacgtaattgagtccatctcactgcatagcgcttccttccaatagtcagcatcaggagatgaatataccgagatgaatatacctcttctatggttcttggagtatcatccacaaggtatacaatgtattcatcatcaaaagactttgcagtcctttatctcttactctttcgagtagctatagtgttatcctcctcaagatttttccacaggcgttgttcatcgtgttctatcggcacaaaagactcggggataaaataagttcttgactagaagtgctaggtacatatttctaggaaatccattctaaaaaattgtagcatctctaggctcaagaattgtaccaacaatcatatcaggtattccagaatttacaattaagaatctttatcccacgctgtggatagcataactaaggaatacacaatttatggtttttggtccaagtttgtgccttttgactataggcgcattgaccttagccaaacattcccatgtgcgcaagtatgagagattcgacattttcctttccagttcctcgaacggtgttacttctttattcttagtaggaatttattcagcacatgacacacggtcaatatagcctcaccccaccattccttggaaagccctgcaatgtctaacatgtcattcaccaaactcagttagagtgtgattctttctttcggcaaacccgtttgactaggaaaaaaagggagtcgttctctcatgaataattttagactcttcatagaaagaagtaaatttatttgaaaaatactctccacctcgatcagacctcaaccgtttaacttttctttcaagttggttttctacctcagccttatacattttcacgtaatgcaatgcatcatcttttgcaaaatctaatgcaattatctataagtgtcatgaagtatttctttttcccctttagtcaacacaccatacatttcgcacaaatcagaatgaccaatttctagcagtgccaaatttcttgtctctgatgccttgtaaggctaagtatggcatttggaaccttttaccaaagtgaatttcggaattaattaactcattgtagctaagcacaacatgcaactaaaattcacatgacagacgtgaatgccaaacattggactcatcatcattactcacatagttcacaacattattacatgcgtcatccaacattattacatgtgtcatccacagaaaagcggtacaaacctccgttgtcataacctttagcaacaaatgtttcatatttagacacgacacatttattggactcaaacagggctgcagga

SEQ ID NO: 25347 - DNA, 4776 bp, Oryza sativa
atcaacccaccacttaggtgaatgaaatacataacgaactgtaggtaaaaaattaccataccaagatgttactcctccatcgctaataaccatgtttgcagattttttgaccttgcgatcagggcaatacttggcccaatgacgacttaacacacacacacaaagcagttatcctttgcctttctcttgccttttttttttaaaattggttatagccttgggtttgatatcatatatgactttttttcataaaattagttgtagccttgttgtgggatgcttgagcattccttttctgcaccaaatgctaaaacctccctcaaactttttgtcgcggttgttctttgctatcaccttctcctcaacacccaaagaggcaatgagatcaataacactgaacacttgcctcatgtgttttagacaagtagcaaagtccaaccaatatgtcatctatcacaaacttgtctagcaactcgtagatgttgttctcaagttcctttggtagtgcctgaaactcatgagcttgttttactatagaacggtcatcgacgatcttatactcatagcaatgtttcatgacatacaactcactgccagtatcgaagactccgaacatggcctcaagtgcatcccacatatcctttcgtgaaggcatgtgcatgtacacttctactcttttgttggctaatacacttatctatgctccacggaacaagcaattcgcgaactcgaacttagcctcctccacaggggagagaccgtacgatcgtcttgccctatgaaacaaagaaatattgcatagccgtcaaccacaatagtgcacgtgccttctatctcttataatttgaaccatcaattgcatgaggtttaagtgatgcagcaaaggcaactaccaaaaagacctgtcaagtttttggattgttgaaaatataatcataatctctactatcataaaattgaagatatttttctggtattttggtaagtcatccgtgcttgagtcggttttaatttcttgtttcggttttaatctctactcctcaaaatccgtaatttaaaaaagggcgaaaaaaatcacacggaaaaagaaaacgcccataaaataacatgaaagataaacagggaaaaaaacgtccgattcgtaccggaacgaaaaaaaggcaaaaaatgctgggtaaaacaaaaaaaaccgaccataaaaaaatgcaggacattggcaaagtacttcagatataacatgtactactcactgtagttatgtggtacttctattcaattaatcatctctcagtacacattgcacaaagttataagttctcacccgtagtttacattaggaccagttcgattattgtacttgtaacgatgattcatgctgtcatgcatgcataaagcggtgcgtggatcctacgtatgccagccattaatggataggttattatcatttatattctcttcgtctcaggacaaaccaacttaagatataagatgctactcaactaaggtcctgtttgtttcagcttaaaattattgtaatctagactattaaatcagattactctaagcaggattataataagctgacataaaataagctacgagttgtttgtttctctagattattagagtcatctaagggtagtgggtcattagccacttaataatctggaaaaagctcctctagaggagattattggattatagtaatctggcttatagattataataatctagcataataatctacttgtttgttttagcttactcctaataatctagattataataatcctaagctgaatcaaacagggcctaagccaaccaaagggggtgaatggttggtataccaaaaaaccgaaacttttagcggaaataaaaatgacccccaaattcgacggagatcggtctgaccgcagttgtccagccggtctgaccgcgcctgtgccgtcggtccaaccggtgtagaacgatcggtctgaccgccctgagatcgcctttacgccgccggtctgaccgcctttacgccgctggtctgaccgccgtgatgccgccggtctgaccgccggtgtgtcgctagttagaccgccgaaatccggtgaaatacaaatcgaagaactcttaaagtgggtgactactttattgattctctctgtgtttacaaactcatactagaagtcctatacaacttaggaaaccctctagtacaagaaacaaactttacataaccactcataccaaatttggactcctttcaaattcgactccgcattccatacacacacaatacctccatcgtataccatatggaatcttcaccaaccatgtgtattgaactctagccgtagtatcccgtatgatctctgaccaccacggacgtcgtcttatccccaagccgactcttagtccatcaccgcaaatactctcctgccatccgagtcacctacacatagaacaaacaaagaaatcatattccgagaccaagctatctccaaccttgactcattagtagcaaacaacagtattacatacgtatagtatccatctagaagccataatcatgaaacaatcacggatatccaaacaaacaacccgaaaccgaaaccgacacagagtccgccggtcagaccgcgggctgcaccggtctgactgcgcgatacacgccggtctgaccggtagcacatgcctggtctgaccggacctattccagcagtacctgtagatttacctgtgaaatccaatcatctcctaaaccacttcgtgaataaattctaaatatcaaaaccaataatctccgatgccaattgttcatcacagaataacaatcaaaaacacctttaattttacagttacatagtctagtataacgaatctgaatatcatcatgtccagatttattgtattaagttataccatatcctttcacagatttactactgagtgatcagatcattcagtttggacggcatcaattcgcccatctacaaatacggcgccaacttggtctttttaatttgctcatagctggtagatcatagttggatcgatcaacaatgcaagctgtgtatattgatcgcctatataaaccacgcgttgcctcacctttcacttcatccatctctacacatcagcaatagctacacagagctaagctagggttagctcagcaatggcaggtgctcctcgaggactagttctcctcggcgtttgtgccgtcttgatggcggtcgccgtcggcggagaggcggcgtcggtcgtcgtcggcacggccaagtgcgccgactgcaccaggaagaacatgaaagctgaggatgctttcaagagtacgtaacaatttatctggaattcactgagctgatcagctatacaccatcaggatcagaaagatatagctaattacaagtgattgacaatattatttggaattcttttattcagacctccaggtggcgatcaagtgcaagaacggcaatggtgagtacgagagcaaggccaccggaaagctcgacggtaccggcgtcttcagcatccccctcgacgccgacctccacagctccgactgcgtcgcacagctccatggcgcgaccaacgagccatgccccggacaagagccatccaagatcgtgccaatgtcagagggcacctttatcgccgtcgccggccagacccactacccatcagcgttgtgcgcatcggcgaccatctgcggtcccatcaagaagaagatcatagaccacttccacaagaagccggtgccacccaagccagagccaaaaccggagccacccaagcccaagcctgagccggagcacccattcctcgaccacatccacaagaaggagaagcacttcttcgatcacttccacaagaagcccgtgccgcccaagccagagcccaagccggagcccaagccagagcccaagccgcagcctgcgcctgagtaccacaacccgagccctccggcgaagaattgatgaatatgatctgcattggatggacattagcatgtttgatcatgccgcagatgatgatcctgctcagcacaggagtgtaatttgtacttgattatcgggcatcagcagggatgtttgtactatttgcatatttttctctcccaaatgaaattatatatggtaaaataatttatttacatttagccagatttggtgggacgactgattattcaccatttagcattcaccttagcttgattcaagctactgggctcggccgagagaaacgtacggtacttgatcttacgataagtcatggcagcggtggcaagacggttgtgaccagaatttagggcctgcatggaaatctgaacttttttttttggtcaattaagtgtaaaataatatgtttaccatattggaacccagaaaagctgcttcgatacatggactaaaacacactaaatttaccgttgtactatttgggaaaactttttaagctacgggtgaacgccgaattgtttaatttatatcgactaaatgattataaaatctttttaaacaaatgacatgaatatattactctataaattaacatgctagtataaatttggcttctgcaaattgtaacaaaaataaaaataataaatttgactgcaaataaacgtatactaattaaagtttaatacgttatttttttataacttgcgcataagtcaaatttaaacttgcatatttgggaagtgatgcattacatattaatctacctttttatcaattttttcagaactatttagttgacatgtgatgaacaggtggacgttca

SEQ ID NO: 25348 - DNA, 1014 bp, Oryza sativa
gcccctggcgccgcggcgccaggggcgggcccaggtttttcaacttgggtattcgaaattgtaagagaaaaaattttctaacccaaggtctaatagttgtataatatgtaacggtataagcatgattttataaagtcataaatagatagaattgaccataaattgaatgcgttaagcatattagagtacattactaaactattattgacaaaacaaatcaaatttatagagcacataaaatggcaaaatgataaaaaaaatcttacaatttagagagaacttttcgtttcttgatattttgaaaatgattgatcatgtcttcattcttaacttgcaagaagaaatctctttcaatgaatgtaaccaagcaatcattcaaatattctggccccatcttgcttcttgcaatcattcaaataatcaatacacttcagttcagtctgaagaagcattcaaacaataatatcctcattagtcattcaagcattgaagcaatatcctcattcaagcattcaagcaatatcctcaatcctcataattcattaatcgatatcctagtatttcctcaccggctcaccgactcaccgttgctcggttgctgtcttgctgactgctgtcgaggatgggaggagacaagttgggcagctccgcagctgggcaagagccaggaggcgtcgaggcggcgtcggcgggcgggcggtgggccgcgccgccgcgggcgacggccgaagccgggctggcgccgtggcgcggcgacggtgcgtgcgtcggcctagcgagctggcggcggctggcgtggcggctgggaatgggaaggggatgggaagggaggtgaggagaagagatagggttagaaaggaagtgggcttttctttgctattgggccaatgggcctgaaatgctgggtggtgggagggttcagtttgggcttcttttgatttttgaatgggtataagtattttttttcttttttcctatatatacatatggaatatatacttcatatatgtattt

SEQ ID NO: 25349 - DNA, 4504 bp, Oryza sativa
gccccccttggcctagtcagcacgacgacgacaccctactgccacagtggcatgggcgcgacaccatggtggctggcgccgccatgtttggggacggcgccagccactctggtgcctaaaaaggaccattttcgatttaagtttttccaagggtccatttgtaaaataagtttacaaaaaggaccaaaatgtaaaaatttcaagtgagcaagtactcggtctttctattcttcccaaccacagaaccagtgtacttttggaagacgattactcgaaggagtaggttcataactgctgtcaaggatgtccgtggagtggagtcgccacgctgcgagcatcaagttatatagtttagctcactttaattttccgctacatatataagacttttaataatacttgtaagacgtgaatctgtgtatcaactttgtcatttgtgtaccttggccggtcatggacagggtttttatgcacattccgctttgggaattctggttcgtgaatttctaggcgtgacagtaggaaggctgctatttctgaaattttgatgaacaatgtgattcgacttgaattctatattgtttcatcaaattctgtggctccaagttgacgctttgttttgatgcatgttcatactcatctgttggatcagcaatgaaccttacttattcttctcccaaacagttcgactgtaggggaatatatatttcactggtacttttggataactcaaatttactggtgcattacagtcaagtttgtcaagcagactgaaataagggaggaaaaggttatactccatctgtttcaaaatatagtaacgggatacttgattagacaccagctagtactaggctactatattttgatgcctaatcgtatgaatgtgtatatacaaatgcgaactaaaattcgaaatgattttttattttgtttgcacctaaaaatcaaaaactggagattcatttttattggcaactctaaaaaaaccagccgtgaaaatatttattcacgggtgactgactttgctcctgtttaaatgattgattttcacgggttattggttataggcaggtggaaaaacatccatatatataaattatggaccacctaaacaaacggttttttatgtaccgatgagtgtcaaagtctaagtttagaatttaaactatttagatgggtcaaaaaaaaattcctaggagcgtttgcagcagaagttccaccaaatagggccccagcgtagactcgtagttgggacggatggccaaaacctccaatattgctgcaagacaaacttggctcatccccttaacatagaactgtaccattatattatattggcaaatcctttacatgtccagggtataaacattggggtaactcgtatgaatagtccctcaagggttatcattcatgaaaacaaaattttattaatcagagaaaatgattatcttttgattcttagaatctactagcttggtagtggttattataagccgtgatatgtgcctgaagcaaccaggctgcgttcggatgaggggttcccagcccctctctcccgtattccacgtgcatgcttttgaaactgctaaacgatgcgttttttaaaaaaagtttctgtacgaaagttgcttaacaaaatcatattgatccatttttgaaaaaaaaattagctaatacttaattaatcacgtgctaatggaccgctccgtttttcgtgcggaggatttggtttcccaactcatggtatcgaacacagcctaattttagggaggacatatatacctatatattcatagtggtttaaaaaggcaaggctaaaaaaaatctatactagtctaaaaattactaagttttagaaataaaagttggttgtaacctaaaacaattcgtgcaggtggtgcttgcctgtcatagcagagtaggcaccattggtttctctgcttgagcgcttggtatacattcacacacacaacccaagcccccaggaaaaaacattcatgtacggtttgccattttaagtgaaattatttttttcacagaaaactgcacatgagaaaaaccttaaaaatttaccaaataaagttcatgacaacattcacttccaataattttggcacaagtttttgagcactgccaaaggtgtgcatcccatctggtgggaggcacatcgcgcggcaagacaggcttgtagagggggagaggtggagagagaatatgagatgatgggaggcacatcgcgcggcagacaggcttgtagagggggagatgtggagagagaatatgagatggggtatagaggagtgaagggagagtagaggaagaagatgaaaatgacacgtgggtctcatgtgaggattgggaggcttaaatggtgggcagtttgtaccgagggcaatttgggtatttcaaaaaaagaaatttgtgtaacacgaacggcgatggcatttttaggacaagttggttcgtacgatgatatttttagaaagttatgttcatcaatggcattttttttgaagtaagacatttgtcaacggttttattggataaatttcataaaaccctatattatatattttgcgttcaatgtagaaagccaccgaattatggattgtagcacataaaacccgttatttaaattctaaattaatttcagcatatcttaaaaacaatatttttcatagcagtgaatagtaaaaccaacaaacctcaaacaagaattcaacaattaaaattttatatagactccatattttaaaaagttagtaaatgcatgttcatgagaattctggaattggctgggttgttcagtttaagaggggaagcaacttaacatggaaattcatgaaatatctacggcaggctcctaacacagcgtagaatcttatgtattttcctagacttctctctcttgtcctatagtttggagtttgtcaagttctactccatttatacagtacgcatcctaatttcatgaacattctaattcaacagagtgacatggattctaccagcaaacactaaacatatgcatacttatgaaatagtagaacaattttcacatttatttacattttttaaagacttctaatattttttcactaaggtggccaagatctcattcttctggcaattctgatatcaatttcaatgctctgtctgcacttactgttcatctacgagtaatggttcacctcccttagcgccatctaactaaacgagtactggttcacctcccttagctagccatcgaactaaactccacaacgaaccaagcatcaagttgatcctctacatgacttccctatctactcccatgccaatcatgcatcaagaattcaagcagacaataaaatttagattcttctgtaacaggtgaatgaaaatttagattttcgtggcacgcttttcaaactgttaaacttattcaaatccattttagttccgaatctatttccgaatccatttatatatcagttcgtacgtaaactatatatatgaaagttgttctaaagtatcatattaatccattttttaagtttgtaataattaaaacctaattagtcgcacgttattatcacctcgttttgcgtaaaacacttaatctttatcttcatattcatcttcatctttagaagattcaaacactgccaaaatataattcctattgcaatgacagacagattaactcagatgatccatatactgctcggcctatacattattcagaaaggtccagctacaggagtgaccacacttaaacagtgaaactatatatgagaatctgaactacagttgattaattgagactcttcagtcaattcaattctcacctgtcagatttttaactggataaataaaaatgactagtaattgggatgctataaaaaatgggcccaactggtagagctagtggcatgtacagcaacaatttattcaattttcacgcagtgacagattgcatttctgctgacataatggcatatacttcctccgtccctaaatatttgacgccgttgacatttttaaacatgtttgaccgttcgtcttatgaaaaaacttttgtgaaatatgtaaaactatatgtatacataaaagtatatttaaaaataaatcatatgataggaaaagaatcaataattacttaaattttttgaataagacgcactggtggagaaatgctttttagtcccggttcgtaaccccccttagttccggttttccaaccgggactacgaatccgggactaaagatcgctatctttagtcctggttcaaataaccgggactaaaaatcaatcccggttggtgttaccaaccgggactaaagtttttttcttgttttttttctgcttttaatattgaatattgatttcacaccatcccctcccatatcgaatcatcacatatcacagaacatctccaaatcctcaaatcctcaaacaaatcatctccaaatacatcacaaactcttaaaaaaaattacatcacagggttctaaaaaa

SEQ ID NO: 25350 - DNA, 10263 bp, Oryza sativa
  unsure (1)..(10263): unsure at all n locations
caaaaccctatcaacatcggctggtatcgccccatcggcttgtcagccaagcgactctttagtgatcaacatatttatctatcttgtcagttcaggatcaaactggctggcatgcccgcatatcatcaatatttaggacctgcactagagctaagcagatctcctaggccattgtgttcgtcgacttagttcgcgctaacacagatcagataccatcggccaagcgcggatttttttgtcaacaagacggaggagaaggtattgaccaagattgtaatggagatggatgtggcggtggagaccgtagttgcggaggagacagtggagatggtggagtccgaggattctcaagctacagcggtgggaatggatgccgctgctcacctgggaaacacgatgtagcgcttgcaccataatatgatggcgtgggatatctctcctagatttgtctacccatctcctatagggatgtccagctcaagatcgtcaaatccttagcagacccactccacctcgatctttgagtatcgaggtggatcgcgtcttgctggacttgtatggctatgccctccgccatcttcacgagaaacgaggttagttagtaacatatgcaccaattttcgcaagctacaaagcaggatgtgcaaactatgagcataccttgattgataggtccttgaagggaatatgcagctaacatggtgtctgttgcgtgatttcatccacggggcatggatttttcaatgatccctcagtttagggatttttcaaaatttggtgttagatccttcaggatatatctgttgtacaaatctttcttgaagcagttgagttgttgggccatcttttttagagtccaatcctttactttgttctgttctacttgagggatcgtgaagatctcgagcatggtggtccctaacatgtccttctctgtatttggaagatatgtttcttccacatcgtcgtgtgaccttgttttgagccaattccgtatactgatgggcacgtgagccctcacgacccaaccgctgtgtgacacaaacttccttgcggcatcttcgggggcaactggttcgtcgtctgctataactgctgttataatcgtctcccctcgaccttccttgcgagaccccattgtccgcgtaccctcttcgatccaatgtttgattggttgtcctgttgctcatcctcgtttccctcctcgtctacttcttcgctcctctcctcattcatgtattggtttgggtcctcgtttccctcctcatccacccagtattgacgcctactctcattgatctcgtccaagaggaactgttcgtcatcgcgaaatgccatatgttcctaacattaaataatacagaaaatgtaaattactacaaaaggtgcatggtatattgttatatctacattgtcaaatatgcatacacccatgggtttataatagataaaatcccttgtatgctctaaaaatttcatcattcccttttgtacccttgaatcatactcaatctcttctatacctccgaattttcaccttgaactcttctatacccctaccgttagttgttctttagttgactggttagtttgcttgaaaatgtccgttatgcccttggcttggttataggttagatgaaaaaaatgttaataggcttctggatggttggtctaacctagaaatgtccatgatgaagataaaaatctctcggcacaagtgcaccattggatccgtcctccaaccagaatcgatgtaaccagctatcccataaaacaaatcatttgcatttacctgcatcaacaagagagaaaaaacagaaaacacaaggggaaaaaaatcccaaatttctttcagcggcttgctgctccagatttcttctagctgcttgctaattgtttcagtcaacgaagcgggcgtgctgccctttccacgccggcaggatctggcatcattacagcaacaacttcatgcggatggtgggaaccaacaaggtgaagcagcagagatgacaatatccagcgagtcgtcatcctcgacggcaacttcgcaagatgctggaagaccacggcttgaagcagcagcaacatcaacggtgaaatcccgttgttgatgcggggctgacggcgacgtgcagtggtgcaggtgcgtcgtgcacctggagagcaacaagtcgatgcggggcccgacggcgatgctcgaccaccgcacgcacgacgaggcccgatggcgatgtgtaggcatgctgcaggatgacccagagatgtggccttgacagcgccaggcaggcacgacgcacgtaggggggaagaagagacggccgtgactttatgggcctggaagtagtggcgcagtttccgcaatgtcatgattacaacgtagagcagtctatgtatttgaggatatcagaccttggcgtcatggagggcctcgttgacatagtacaccgggtgttgtgctttatccctctcgacaacgatgacagtgctaacagaatagggtgtggcggcaatataaggaaataactcttccattggctgaggggcaacgactacaaggggttggacaagtaccacttgagcgcgatgaacgtgttctcggcatcctgtgtccactcgaatttgtccgggtttttaagtaaagcgaagaaaggttgtactcgttctcccatcctagccacgaatcgacttagtgccaccattcatcccgctagcttctgtacctccttgagtcttgtgggcgaattcatgttctcgattgccttgatcttctctaggtttgccttaatacctcgcttagagacaaggaaactaagcagcttccctgatggtactaaaaacgtccacttctccggatttaatttcagtcgatgtcgtcggagattgttgaatgtttccctcatgtcgtcaatcagcttgtcgcttgtctttgttttgaccacgacgtcgtcgacgtaggccaccacatttcggccgatcaggtcaccaagagccccttgaatctcgcgctggtacatgttgcctacactgattagctcgaagggcatcttggtataacaaaaaacatcgaaaggcatgatgaatgttgtcttctccttgtcctctttagccatactgatctggtgatagccggagtaagcgtcgagaaaactaaatagctcacaaccagctattgagtccactagttgatcaatgcggggtagagggaagtgatccttgtggcacgccttattgaggtcaatgaaatccacacacattctctacttgtcattggccttgcgaaacattactggatttgtgagccactctggatggagaacttctcggatgaaactgttgacgaaaaatccgtgcttggccaacggtgccggatctgtgttggcgcgaacttaaatcgacgaacacaacgacctaggagatctgctttactccagtgcaggtcagtttgatcctacaactgacaagatagataaatatattgatcaagaaagagccgatcggctgacaagccgatatagcaatgtgagctgatgtcgatacggttttgaacaatcggctatatatctaatgcatattttgatacttgaaaaaataatgatataaagacaatcggctgatgataatgtaataaaacaataatataatctagtagaaattaatcggctaataatgacatgataggataagcactgatccaaagattaaagcatacatcggctggaggtccgatgtcattaaatcgaaacgattagataaatagtgaaacatttgttgcgatcggctaaatctaacttgtatgtaatccttataagctgatgcaatgtctagataacttatcggctgaaaccccgatgaaacccttattggcaaccaaaaagcaggctagaaatcatggttctaagcatgacttagtaggtcaaacccaattgatgcagcactaagtatgaaaataaacatctagacaatcaagcctttgactgattttcaaggtggtagataccttagctaatctacatcctcctccaggtacgagaggtggttggtgtcctcgtggccttcgagagccacctatcgatgatgatgaagacaacgaaggataactataatcgggagtacgacctctggatctatgccaatgtccttgatttctccgagaaccgggggaacgtgaatctcgtcgtcgtctgttgttatcgtggtgttttcgacctcggccattgtcaccctgacttctccagccttgattgttctcgtccttgcagctttgccaatccagtcggtctcggtcctcatttagatagcttcatgattgccatcgctgttctgttatcgttgtggagaacaacgttggtgatggccgacgtccgtcttgttctcgtcattcccgtctccgcctgttcaagtggtcgcaaagatcacgattacctcggcaagtggggttttccaacttggtcttcttggcaatgcattatggggattacggcctgggtctaaactcaggtgttcgctagggacatcttcaacattgacattcccaactccatgttgctcttctccttgagatggggaacaagaaggacgctaggttgttggtccaattgtctccaagaaggaattgtttagattggctattgtagatcgtatctgtccaacctagtaatctgcttcagggaacatgactgggtccatgttggtatttcttaaccttatagagatataccgatgtaacacttcacccaggagtattctcaggtatcgatttccacagggaacgtctgtgtcggctcttcaccaggtacgtccaagtacataaagctaaggataagcaaaggatagagtggattcaccggtgagaaacagtgtctatggaaagcttaactttaatcctaatacgatacttcgggcactggccagcttactactcccagatatcgctctactacgtacctagttagggaggacttcagtgatcttgagggctgtcaccacctctacacccaccccacacctactgtgggatacggagcgattaataactacctagacacagcgtctaagcaattaataacttactttaatgttaggtacacactaaagcaatcactatattttgctggattatagtgaacgatgatctcgtacgctgattaggaactaaccaagagataattctcaccaagcaaaactaaattactcgaaagatatttctattataatcagagtagttaaacaaagcaaaagaaataagaagaggattaccgacaattccggaactcctctgacttcttctactctactctctctctaatctagtatacaataaagtacaatagagcctcttataattcagctcaagcttggagtgtgtgagtgaagtgaagatgtgaaatgtccattctaccctccaaccgccattagggagtcatctggactgtccctgccaagccgcatatcagacagctgtgggagtggttcggccgaacccatgtatggcccaataggcccacttttcggcctgttgctcctcctcagcctcccatatctatttcttcgagtggaaggaccatttgttgatgttttgtgtagttattggcccactcgttgtatggataggatttcacctccacttaagtctgattttcatcccaacttcggcggtttattacctgcaggcacatatgcaccaacactcgtggaatatgttagaaataaacctaatcactatgttggatactttattctttctgtttatgcaggtattgacggcataaatttggcatttaatagccgccaacaaactccccacacttagctctttgctcgtccttgagtaaaggttagagataaatttcagaataaaattatccaatatataatagaagcacataaattattcaaaactattcttgtacctgtgaacttcagcggtggctatcttactatcctgggtgattgataaatggaacagtcttgaatctggtcctcctcgtattctacttcagacttttgggggtttataaattttcccaaaccagcttttctcatcataatgacttaccctcgatcactcggatattttgtaatgtctgtggatccttaccaaggcatattttgctgaaattattccttattctaaaggctgtatgtgtggagtttggtaggcataattcggaacataccttcatcatatatattacaaaatcaaatacatggactcaagaagataatcgatcatactctcgaaacaaagatcgctaatttttgggtggaaagtgtatgatatgtgtggaaaaatggaaaataaagaaaatgcttctcctttatttatacctgcttctccaattttctccttcataattgtagagggggcatggccattttctttctttcttttttttccatgttgctctatatttttgaagagaaatatttttttaatagccatgcctttccctccttttctttttcttttccaaggatttttcttaggagaagaagggataaattgaatggagaatttattcatcaaagttggtttttctttttcagtggtagtcgaaatggatggaatggtgccaacttccagtgtagaagcttagcatcttatatggataacatagtggttgtgcaaccttgatcgagagagcatgagagacatctaacacgagtcacaaaaatttggtaaagctcaatataattacaggtagtcatacacatgcataaggttcatcattaatggcttggtgtatggccttgttgggtaggaataaagtcatatgaggagtaaggttccaaataaatttttgattttaaaaacaaatccccaattgtcatgagatagaacacaagaatttccttcatctcaactatatctcaattatcatctacttagatgcataaggttccctaacatagatagttgttcacaagtaacaagtctagtcaagaataaaatgtgtacaagatcaatcataggaaaattctattagttggaatttttatcttctcattaagcttgaacatattgtcattgaattttctgctcatgtactaggcatttgggggagaaaatgaggaagtagatgtgcaaacttgtcttccaggagaaaatgacaggaattggggctagtgtgggtttggtcgaaccaggtgttcggccgaaccactcggacgcccaatttacctgcatttttatgcagtgcttggaaatgttcagtggttcagagatgtggctgcagtttctgaatttgcatgtcaggagtccgaaaggtctccccccacacctattttcaacctacaactttatttggacacaaaaaatggaaatagaaaggcaaacattggggtaaacaccaatgtgccaaacttttattgaattaaaactgagataggtgccttattacattgagtaaggcaaaattgaaatgaaaataaactaatgcacctatcatgataaaatgagagggggaaggcctctagttagcacaataaagttcctccttccccatctccctaaaggcatgcttgaccttggaacataatgcacggctaagcaattgaaattcattcctaaggtcggctatttctctcctacgctccgtgtcacgttccctaagctcctcattctccctacggagtcgctagatcctcttggcttagtgaccgaaggttgaggggagttactaccctcaaacttcccggcctcccccttgatagccggcaaatatacttctactattatcatataaaacatctgcagcaatgcgtgagatcccgtgtagttaattactccatccattctttaatagatgacgacgttgatttttagacacatgtttatccatttgtcttattgaaaagttttgtggaaatgtgtaagatataaatcatgcttacactactaaaaggacacatgcaagtcagcattataggtgctggaatagctaaaaccagcgaaaaccggcacctatagtgttttccccaccttcgcaggctgaaagtacaaaaaatggtacgagtataagtgccagttgtagagaaaaacccttttttaaaaaaaaattgacacctttattatattataggtgtcggttaataaaaaatcacacctataatatactataggtgaaaaagacacccgaaaaaaccgagccaagtctggatactttttagctcacaggacgccgagagggggccttatcgactccccccccacctcgtctcgccctcctctcctcgacggcgccccccccctcacctccccatggtggcggcaccctcccctcaccttcccacgtcgacggcgtcgagcgcagctagatctgacctatgtggctcaagtgcgacgaccagatctttcttgcatttttttttgatgtggataatgattttttttttaaagttgattgtgcgattgtgttcaagttgatcgattcaggggtgattgggagctgcatcgagccaccttttttttattattcttgggacatagaaccaacacctttgatttctctcattagtaccacctactatgtgctggttttcccgatcggcacctgtgtggggggtttccaaccggcacctattcgcgtttctgtagtagtgttaaaagtatttttaatcataaaacaattcacaataaaacaaataagaattagcaactttttgagtaaaacaaatttaacgtccaaatttaacaactttttgaggtggtgtttgaatctcctgaagatgaagatgaagatgaagattaagtgtttcacgcaaaatgaggtggtaataacgtgtgattaattgagttttaattattataaacttgaaaaatagattaatctgatattttaaaacaactttcatatagaaagttttcgcacgaaatacaccgtttaacggtttgaaaagtgtgccacgagtatccaaaagttaatccaacttttgttggagaaaagaacagggatgtatttgaaaattttattaaaaaaaattatgggtttctatccaacatttgatcatccgtcttatttgaaaaatttataaaaaaagaataagttatacataaaatattattcatgttttacgatcaaataataataataatattaataaaaaaatttcaaataaaatgaacggtcaaatgttggtcacgaaaacatataaaatacttaagataggacggagggagtagtatactgcgacgacctgggttgtgccgtttttttatagtatagtttttcccaaagacattgatatggcaattcaaaaccgtaacagtcgcagtttgcatatagtacaattaataatgcagccatgcgggcaccaccaacgacgatttccgtcggcgaaatttgtcctaacgagctccgacgacgacttccacattgcagccgtaatttgccgaggtcttccacattgcagccgtacgtgccgacggcccgacgccacgtatgtagctttccgtttccaaactctgatcgcaacatatggccccgttcggtagtacttctagagtactgtttgattcacagtactgtttaattcagcttagggttattataatctgaattattagaaataagctaaaacaaaccgataacatattatgatagattattataatctataaagcaaattactataatctaatccactcaaaagatgctttttttattattgggtggctaacaactaacaaacagcttataatccaggaaaacaaacagctcacagcttattatatgtcggcctattataattcagcttatagtaatctggttcaataatctaaattacaacaatcttaagcttagacacgtgaaacgaggaaaccattgatgtttgattaattattttaaactcatgaaatgaatctatttgatattttaactctatttcaatgaaaataatttcacggatagtactgattattagtttgaaaagtgtgttaatgaaaactgtgacaaaatttgtatcttaataggaaaagaacatggcctatgtactctactttcacttcttgcatgtgtggtagctagctgcagtaaataattgactatactcgctcctctgttgcatattataagttgcatattataagttatttttattttttcatatcaaacatttttaaatttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25351 - DNA, 1184 bp, Oryza sativa
tattgtgtggggatgtcaatgcttaccgatataatctatactaaatactatatacggaatattttttctgcaatttgcaacaaggtatagttaattaggaaaaactgggtgatggttccttttttacttaaaataggacacttcttttttatataaaacgtcagtaacagcctgaccgattgaaaaaaaattacaattaattatggaaaattggggttacgttttctcattaaaatgagacacttctctatataaaacgttgataacgcactgaccgttcgaaaaaaaattgcaacaaggtgaccgtaaatctgcaactgacaactagatctctgcaaaactagagaacaaaaaaacatgtaagtggaaactaccgaagctcacacgagcacaatcccaagatcggtaaaacgaacatgatgattctttcacaagagctttgcagctagccttgattgatttacctcaggagaagagcgagcgagcatagcccacgaactcacaggagtcgcaggatgcgaccctcgggccttggccctgcgccgatccgatcccatcccatccgatcgccatgcctgccgagcgccgccgagcgccggccgcccgcttcctttcgttggacggtgggagcggcggctactggcgaggatgccggagttccaggagatcggcataggtgggccttcaacatgtgggcctaagcagtctgggctgggcaacgggtggacaagaatgaatgaagtgcattttgattccctacccagtggattcgtatccctgaagcgtaagaaatctttttcagaaattattttatggtgttttaacgctctcaactgaattttcatatatgatatgaacacgcttaagtaatgtcaagtatttttgaaatattttttcatatgatttctttgtgatgtttcattcgttggggcttaattatacagtggttgttgatgttgcagtcagtattttctaaatgttacatttttctccccttcaaaaaaaaatgttatatttttctaaaacattttagaaacttaattgaaacatttgagtaagtaatgaaacatttttataggtagtgaaacaatttcatgtaatataatattttatcaaaacataatcaagtgagatcttattataaatatttaatcgcagcgagaataatggtttaatcaaattat

SEQ ID NO: 25352 - DNA, 1534 bp, Oryza sativa
tttaaacatcatgcaagcattctatatcaactataattttatattgaattttagagctttaaaatgcatgaatgttaaattatcatcctacataattcttatcatatcttactataaagttatcccccactaactccttaagcttaacatgcaaagataccacatcatcatccactaacaagatgtcacatcatcatccactaattaacaagataccacatcatcatccactaacaatcatcacatttaaacatcatgcaatcatgctatatctttatagtttttataatttaagagcttttcaaatacaaacatgtgaaattatcatccaacataattcatataatgtttcaatgtatatctttattatgttttatgatatcctatatacttatatagttcatcctcacttagttagtgcttaaatgattaatctatggtccaaattatctttctctttttttcctctaattaagttatatcatatcaattgtttttagcctttagatgattaatctacggtccaaactatctccctacttttcttcttccataaagtcataccatcttactttttacgtttgaatcaccattttacatactatttaaatttaaattatcatagaccacattaatttacttaatctgatgttatctagctatcttacacatttttttttattgttatcatactaaattcccacagcaatgcgcggggtttcacctagtattactataaagttataatccactaaattctaaagctctacatgcaaagatgacacatcatcctccactaataattgttatatttaaacatcatgcaagcatgctatattatctataattttataattattgaattttagagctttaaaatgcaagaatgttaaatcatcatcccacacattctatatagttcatcctcacttaggtaatattaattttctcttctctcattaagccatattatcttaattgtttttacccttagatgattaatttatggtccaaattatctctctctttttcttctctcataaagccatagtgccttacttttacattgaatcatcattctatatactatttaaatttaaattatcataaaccatatcaagttatgtaagcttatgttatcatacacatacttattattatcatagtaaactctcacagtaacgtggggggtttcaccttgtaatatgagaaaaatacagaaggtgtgacaacatcatccgcaagagaatgccatgcatgatttttcgatatggaaggaagagaaagaggatagaagaactccgtttaccagaaggtataatagacagcttaatcatgtataccattctaggtaaaatctatagaatcgaatcatcaatgatacatatctgttatttcagataactagcacaacctgttgtaaaaccactgttcatgcccttgctaactcagattttctgaaccaaaagaactagtgtagatagctaaaccaaaaaaaaaaaaaaagcgttaaagaatgtgttacatacttaca

SEQ ID NO: 25353 - DNA, 7750 bp, Oryza sativa
ttgacgggtgtatcacaagggttctgcaacgaacagaaaaacgatggttagatggttcacaaaatcttctgagaaagaactaacaaaaacaagactgaaaatctacaagatctgtgacaactatagcatatatatatacttgccaaggactgcacataacattgaaaatgtcggaattcttgatggcatgcagaaacacatgaaactacagaaactaaattataatatttcaatatgtatataaagcagcctaaatctcctttcttagcacattgggaaacaaataaaagtaccaaaagattatggtaccatttctcatttagtagtacaaggtgatgcaattctccagtttcaatatattattctattttctgcacgtcaatctgttacatgtttattttcagggaaaagaacaaaggtgcatcgctaatactagttcataaaccagaaggatagctgatgacaaacaaagagaagcccatgcaaactaatgtcagtgctaaatgtccatgtccttcataaaactcaatgaagaattgaagatacaggcttttgtctaaactctaatatcgaggaaatatgtataaaaacaaaaaaaaatcctgtgtgacgaagcaattcaactattcaagcaatacaattttgcaaaaggaaaacaaaaaaaaggcatcatgagttgctagtcacttaccctttctccttgtgttgcctgcagctgccttccctgccttctcctggtggcacaaatcagacaatgacaatggagtcagtggtggggaagaagcatcactgccctccctgctatgcttagcctccaagagcttattcacagtgatgatgggcgtcctctggctgttggaaggtatggagtagctccttgccaaggccgcaggcggcctaagcagcggcgacgccgttcttgacgccttccgggaggcacgggccggcgtcggcgcgcgcttcgacaccagagggccgaagtagccgaccagaccagaaggccggacaggatccacattgggtggaggcagcggcagcaggtggagctcgctgatcttcagcgacgatgctggtggcaccggtgacatctttggggaaactttgggtgacacagacgacgacgacgcgtgccggacgtgcggcttggccgcaggcattgcaccagggtaagccatggtgggcgatggcctgtggtcagcctgagagaagggcttgccgcctgacccggccttgatcgggatcggacctgaccatgactccctcttcagcttcttcagatcatcggtgcttgatgatgacgacggcttggtagcggcgttgtgcatggcgccattgtagtcttttgtcagaggagacgagtgccacagattcgtcggggcatggggctttgtttcgaagaattgcgcggaatgatgcagcctgtgtgaacctgatggtacggggttgtcagcaccaactggggtagggagcctgtacgagtgtttggttgaggatggcctcatttgccgaagcctgtcagtttcatcaagcaaattgccagcaaaaagtggagctgaatgtgtagcgaactcgggcttcaattgcgggaacactatttcggcctctgcttgttttgcctcttcctgcttattatgagataccaatcagaatttcagaatataaatatatgtactagcattttgttaacttggtacaaaactggagatagaggggtagaggctggtgaaggtgcatcatacatatatatttttttcgcttgaataattgctctttgagtagtgatagatttgggtgtaaacactcatatcaaccaccacattgaaaaataatagtttttccaaactcagtgagtgcatcaaaataaaacgtagtgaaatttggataagagaaataactaactaacgaaatcatattagtcgacccagttagaacacttctaatatgagtattatggagtggcagcacacctgcttgttttctttgattggctttggtgaagtagtctgatcacttttatcaaactggacacaaaataaaagaacataaattagataaaaatataaaagacagatcatcagtattctcagtagaattttatgaataaaaatgaacagaaaataaagtgagcaaattccagagataatcagtgcaaactatagaaccttagtgagctgattagacaaagaaagcataaagagttgaagcttatgccagttcaaatgctaccattgatgctgatttataagatccatatattgtaaaaccaattaagaggaaaaagctgaaactaggctatatatgtatgaggtggttaagtagaagcactagatgagaggcagcagcattaaaagggctttttttattatttaatggaaatgttttacatccatggcctctgctgtaaggcacacaaacaaattaaaagacagtaaccaaatataaatggaacttacatccattgaacctctcgaagtaagaaaatcttggtctctatcgtttatttcatagtcgaaactcagttctccgtcatcactacaagaatcgtaagtactgtagccatcattgtcagaaccatcatcctctagaccgctgaagttatagtcaatgtgatgtttctcagatattgctttgacacgaggttcaagtgcttcgagacatttgagtcctttcctgaaaaaacttaactgaatatatatacagttaggttatgtggcactcaaatctcagggaaatagttaacagtttcattgagttacctgagcagcatgatggcgagcagcctgtgttaacaggctctggaattgcccttgctttaatgatttcaagcgaaatgtgaaaagtgctgaatcctcttggtattcaagaaaagaagcgtccagttgttctgtggagaatgattcggttttggaatgccttgaccctcctttgtcactataggatgccctcatggtttcatatgcgtccctgcagggaacagaataggattgttcaagatgcgtctcagtgagaaatgaccaaaaatgaaaatgaacttgaggtgtgtttgaaccttttcatgtcgcattgttgtttcatttcctgcgcaatgcaaacaaaatgtataagcatatcatgctacattgatgtaaacatattgtttttcctgtggttcacaggcaatcctaattaaccaactaatgagtagccaataaacaattggtataaagtggtagcagttgttgttttcaattataagaatacataactgagcaaagatttcagaggaaattttgtatatcaaacctctaaagtttgcagctccttaagaagagattcagatggggttgtgattgtgtggatgatatttgttcgctggatagccaatttaaaagcgtgtcagcaccaacagattgtaacgtggtaaaaaaatttaaataactataatgaattccaaattgttgttttaaaaattcacagtaacaacaaaagtaacttacgtatctatccgcagatttctgtagttcatattgggccttaccgagcatcatcaacactctgcctgaaggtaaaaaaataagcataaaaacgattacagtagtcaacaaaaggaaactttggactgaaggaagtacaagcatacatggttttcatagtggttagaatctagtaacgcgatgttttacaccatgaatttctatatggttaataatggacaactcaccactatcgtcgtcgtcgtcatttagcacaggttttgcaagtaagcaacttcccagttcctctaaagcctcagcaaactctgcacaatattacactatgatcaacttaagaaatgatgtatagacaaacatgctatcaactgttgacagaaaccatgttaagcattagaatttagaaacaggaggtaccatatacgccattcgttgtagcagctgctgctgaaatgaagccatcataacagttcctcatttcttccacatcctgagacaaacgcaaaaccatatttcagttatgaatgcaacaatgcaaaggaaatatttcccattaccaatagactagtactatttaattgctggccagcaataaattgtaggcagccacaatcctaagaaagggtagaagtaccaaatacagcaagctgaacccattagaaagcagaataaattataagctgcccagtaaaacatggatcacacagtcctcttagacatatatctgataaggcgaagtaaagggaaaaacagtttctgtcatatcactgtcattgaccaacagtaccagtaggctgttgagaacaacttctccagcttaatggcgcattacattgcaagtgcttctcagtgtcatcattcagatggcacaaaagatatcaagattagttgcattgcctgtcactctgtccaataattggtggaaagtcagaaattgcaactaagctggcgtacttcagaaactcctctctgttcatggttcaactcccaattcagcaccagagaccgacgcggaatcggaacggaatatctcgtgcgtgttcttggataagcgttcatactttatccagagttccagtcaagattacgtcgaacagctgaccgagattatattaaatataatcgattgctatcttcgcagcaactttctccgatggacgcgtcgtcctctcctatcgtagactttgaccagacatgacccgcgagcagaatggctcccgggcaaacacgtaaagggcaaaattgcagagaagttgcacgtcgttttcgtggaggttagcctaacaactactctactttgaacatccgatatactaatttaaacgaggctcctactgtttggatcagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgcacggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttaaatttggatgaattttattaaaccgtaccgcgcggtacgggtaaccgtacccccgcggtacgggcggtaaccgcggtaaccgcgcggtttccggcggttattcacaccctggtttggattaaataaaagtttagtccttctgcacgcttgaatcaacacggggcaagttcaaagctttgattattctaaacgaccaccaatgaccatcagaaaataattaaaaacgaaaattgatggatcaatttctatttaaacagttcgagctctgttcctccagccgcattgaataaccaaaatactactagtagtaaaatcattttgagcatccacacctaatcaataaacgagtgcaccaaccaaagaacagcgcactccacctggaaaacaacgcggggggtggctaaaaatcgcaatttcgcatagggctcctcccaagatccgattttgacgccgatttgatcacagaaatcccaaaaaaaaaaaaaaaacaggagatagatgggaggaggagaggaagaaatcaataaatcaatcaattaatcaataagtcgatggactcgcgcacctgggcggcgtcggcgagctcgtcgagcttggccggcgtcggctgcggctgcggctgccgcgacttcctctccctgtgctgctggtggtggccgaagcccttcagcctcagcaacggcgacttcatcgatcgatctctcttccctctcccctctctgatcgattactcctcctgtctaacaatccttataattttgtggggattaagcttatctaatcttttgctttgggcggcgatggtggaaatcgcaagaaaagaaaagggccttgatttcgcctctctctctctctcttgatctttcgttgttcctctatgaaaggtagactaaaaatggagggagattttatagttatagctgctgctgcttcttttataactttagcctaatggaaagatatagtggggcccccatgcccttggttgaccaaagaaaaagaagattagacaaaaagcagtcttggatttgatatagtagtataataataattgtagactgactgagagaaagcttagcttagaccggcaaatagtagtagtggtagcatcaaggagattttgctacgaatttttcttgatttgggttggtttttcgtcggagaaaagattaattttctactgtatttgttgttcccctttgcttttgaatttgatgatgacatctcgtcagatactaacagcggctgatgatacagtgatacttacctaaattaacactgaaacctgtggattattattttggtttagtaactatactactcctactttttgtttcagtcataccatatgaactaaataatgtctcacgctttgctgcgagatatatattgtataatggagaaatgatgaaatcatttagattgaaatattataaaaatgatttgagaatggttatttagcatgtgtatgtttaattttagaataaaataaattataaatataattactatatacttacatgttgagctttacgtgtttactggattgacgtggcatgcttgcgtgtaggttttagaagtactaataaatacaatgattgcatgttgagatttaggtatttagtgggtattagctttatagaaagaagatattaacattgaaacctgtggattattattttggtttagttaattacttctactagtttttatttcaagaaaattgcatgtgtaccctgaaagtttacctaatcttttctattcttctgagatttgctcgttcccttccatacttctaaatttcagttttgaccccttctatacccttttcgttagttgaccgttaaattcctacaataatatccatttttccatttggtatcaagaaaatataattttataaagtatattgatggagtgtataaatttatggtatgcgactattttatttatgagtttattttgtgggatattatttaacaaaaataatattttagtttcgcctccgtgaaggaaaaacaaaaaaaaatatctatgacaaagtttatttttagaaataaccaatataatatattttttaccattaaaaactgtatatatagcatattttgttacagtagtacaatatttttataagataaatctatttatgttcgaaataaataataaaaaattatttttatgtcatatataaaaataaattatcataaatattatttatgactttgttatgcaagatattatttatgataatttatttttttcatacaagataaaaattatttttgtaaataatatctcacaaaataaactcataatagttgtatataataaatttttatactccatcaatataaatcataaatttatattttctcaataccaaagggcaaaatggaatttatggtaggaatttaacggtcaactaacggaagaggtatagaatggatccaaactgaaatttaggggtatgaaaaagaatgagcaatctcatgggtatagaagagattggatgaacttttaaggtaaacaagga

SEQ ID NO: 25354 - DNA, 7516 bp, Oryza sativa
  unsure (1)..(7516): unsure at all n locations
tagacataatgtttgactaataaggagaatatttcaattgttcatccaactcagcaagattactcatactgtgccgctttggccttaagttaatttgcatgtaccatacaanctttgtatagaattaagtgaaatgaacgttttacaactttatgtattaaataattatattcatcttacaaattcatttactatcagtgtaatttattcatatatttttaaggagtgacaaaaataaaggaaaatatattaacatatgcccatgtgtacatttgtaggcataagtttggttcgtcatgcatggtttcacgagattggtccattattaaatttactattattctagcccaagattatagtgaaaatgatgaattacacattgaattgtgttcttgttagaaagacaaacataaaataattggagaagcaacattagtgttgtggggattcactgtttgcttccatctatttgagagtgggcacatttggggaagtatgagagtgttgtggtgcgtgcatacgtcttatgcataataaaaaataaataaaataatgcggtgaatttatacgtttgttgataaagatggataaactagtactatatgctgcaacactttgtttggtacgtacgaatataaaagcactcatttcatttgacaaaaaaatacctagaatattgcaaaattaagctaggctatctaatagtttcgagattcgtactgctacagtgattctacattatcatctatcccccaacccccttggttctttcctaacgctctttggatgtcatctgataatgcctagcgcaccgctgacgcctccccacccaacacgtcatcgctcggtcgaaagacgtcaacagcgtcggcgaggcctcctgaccagcctcctcctcaatctagtagcagcgaaggcctatcaagtgattccttgctaccggatccgccatctaggccaccgcttcctaccacttctttgctttgcctccgccgccaacgtcgactcgaccaccgccttcttccatcctcatggctttgacaccgacgcctctcatagccatcgctttaaatccgacaatctccctctacataccttcctaccatcatgtcaatccggggtcatggtcaaaccctaactctgggtcgtcgtcggttgccaaactagagaaaaagtatctagggttaccggatcacgaattgcaaaacacacaaatcatgagtttagaaatttacagatattttagccccaataatcgcaaagagttgcgaagaacaatctgagatgatctcgctcgccatacagcactttgtttggaaggcacgaaacatgcacgctagtcatgcatgcctgggaagaaaggaccatatgctgatctgcttcgttggaccgtgttaattccaaacgaccagcggttgctcagccacgaagaaattaaaccatcatacgtaagctatgatatattggtactaattaaacgacctaattagtatatatacttcttctttcatatcatgtcaaatccttagttttttaaccagtcttccgagtaataagactttctagcaattctatatgaatgcgaccaatgctagaaagttttataatatgaaacgaccaatcctagaaagtttataatataaaacggaggaagcaattactcgatcccttgatctcctcgatccctcgttgtaagcgaataagcgattagcgatcaaggtcagacgtgcggggttttgaccgtggaccgaagaacggcccaacaggtttaatttcgccggtcaaacggtggttagctagcgtatacattactagtatgtacgtgcatacatgtctcggcgtacatacgtacgtcgtcgtcgcaagtgcagcgccgccacacacagtgtgaactaacctacgtaagagctgacctggatgcatgggtttctgtgacgcaacacgtgtcttgtctgtgtgccagttgtcaaaatcaaccttaagggtgtgtcctgtcgtatcggaagagaaagtatatactacggccctgtttagttcacactaaacttccctcaaactcctaacttttcatcacatcacatcacatccaaaactttcctacttacataaacttcccacttttttttccaatctaccaactttctccaaacttctcccaatttcagaaactaaaacacaacctacgtatcatattggaggttttagatatatagtctatagttcaaggtggcccttcatcatatatctggtgacggagaggcacaaagttcaaggttaattaagctaataagagcttaaatattttcacaaattacaaagtatttttcaagattataatggggattatgaagctaggtgtggggcccaagctatagctgccccatgcatgtttctgcccctgattatattgttaaatgtgccacttaggttaaagctactgtacatggcattccttctcaatgcacagtggtttgaaggggaaaaaaaccaccatgatgatttatggaagagaactactggcataaccactactacacaaactagataggtattggttgggaacctagcatagatgtcaaattttccaaccggcacaaaggtgctggctccaaaaccggcacctttgaggtccaaaaatacaaacaaagaaaaaagctcgtagctgccgtcttcaccccaaaaaaagcggctcaatgcatcggctcaaagcatcgagcagctccccttcacccgatatcacccaacatttaattcatagaattaatcggcatcaagaactacccaaagaacatcaactcaaacacaaaacacaaagaacatggagaggatggatgacggcctccatggagaggatggagcagcagacgagcagcacatcgggtcccatcttgcatagctcgtcggcggtggcgaagaagcagatcccacagcacgtccgaaggcgccacccgccaccgccgcctcccctcccgccgtcgcccacaatcgcacgtcgctattgtcgcctcccctcccaacggatctggcagaggggaggggcgccgcctgcctcccaccgtcacctcccctcccgacagatctggcggaggggagggcttcacccgccaccacacgccactgcgcctgagagagagagagagagagagaaagagagagagagagagatgggagaggatgcggtggagaggataaggacatacaagagataaggaggagaggatatggatgacaaggtgcggtgtggtgcggttcgactccgctcaatataggggtgtcggttcttctttataacaggcacctatagttacttaaaggtgtcagttttttgtgtttttagtctacggagatggaaaaaggtctacatatgtcggttttcgcacttcaggcacctatagcgccgatctctatgtgccttttttagtagtgaacacaactccctccacaatagcttacgcatcaagtagtcttttcaagttgcttaaaaaaccgtatgtgtttttcatgagacatgtgcgcctctagaggccactctttaggctaaggtggcgacttggcttcaacataaaggtgcggggtgacttaccatgtcaccacacaatgtaattgtgcttatgttatagggacgccctctttgtttaggctaaacttattagcttaggcttttaagttagcttatcggcttatgatttataccaatggatttaatatcctaagtttagtggtggagtcgtacatctaccttatataagccaaaaaagcttctccaacttaggttttggcttaatagtgttagagtggcttaatagtgttagagtggcttatggcttaaaaaaagccaaacgaaaaagctgcttatttgtttagtattagactttttagcttataagttaagccttaaaaaaagagagaatatttcaagagagtagaagagctaatttttctcacctttgaatgcgtggacccttttgggattttggcagcttctagtatctaatcatgcggtcacgaaaaacctttttatgaataccaaggtgtgcctcgagagttgagaggatgtgctaaggtgagcatccgttttaaggctttttcggtttctcggatgttcggtttctgtatagtagaaaatcacaatatatagttgtgagaaaaaatgttgctttggtggtttattgtcaaagaggagcatgtctacagctaagccgagccactcccaagtcccaacaataatcaagtgcacgaccaaggttggatacttggtgttatgccactcacaagacaaaaccgcgaaagctatgtgtgccctgtctacatcaagcaggtgaaagacatctactctaaagatttaatcttgcatggtgtcggtttcttcagtaagtttgattcacactagaaaaaaggacatacgactacaaactaaatactgagttacatgaaaatagaaactgaggaaccaatcgaaaaaccaaaactttggttcggcattccgttcgtggtttgtttttgcccacatctactgctaccaatatgcgtaagagatactttggtcgtttgacactctagcttgatgaagagttggatgaattgtttttgaattcgattcaaaattataaatataaaatttatatatgtataaaaatttatatgtgcaaactttatatacacataggtacaaaacatatatgtataaattgtataaacttttttatgtgtaaagttttatatatagtctctctattccaaaaagaatcaaatcctagaggaaaaagtataccgaaggtccctcaacttgtcatcgagttacaaaatccattcgctttaggtccttcggtggttttgaacccggttttatccgacgtgatggctgagtcagcgtggaactcacgagggccccacatgtcagtgtggccacatcatctctcttttcccctcttctctcccttcctcatctctctctctctcccccttctctgctctgcaaggcaggcaatgcctcggcggcgggcgtcggcagtgatggcggctatgggcaacgtggcggcggtggggggaggagctgttggcgggcggcgggtggccgagctagagcaggaggctgacgcggaggaagacgagtgtgcagcggccggtgacgcgaacgacggcggcggtgtggagcggctgaggcggcggctcgcggccgaggggaggtggagaaaggccacgctggaggagctggagaaggataggtgcgcggcggccgacgaggccgagctggagcaggaggctgacgcagaggaagacgaatgcgcggcagccggtgacacgaacagtggcggcgcagaggagggcgacaacgtggagcgactgaggcggcggctcacggccgaggggagatggagggaggtcgcactggaggagctagagaaggagaggcgcgcggcggcgtcagcggccgccgagctggagcaggaggccgacgcggaggaagatgagtgcgcgacggccagtgatgcgaatggcggtgacatggaggagggcggcagcgtggagcggctgaggcggcggtttgtgacagaggagagacggagggaggtcgcgttggagcctggaggagctagagaaggagaggcgcgcggtggcgtccgcggccgacgaggctgagctggagtaggaggtcgacacggacgaagacgagtgtacgacggccagtgacgtgaatggcggcgatgcggaggagggccgcagtgtgcgcagttgaggtggtggctcgcggaagaggggaggtggagggaggtcgcggtggaggagatggagaaggagaggtgcacggcggcgacgggcggcagatgagaccatggtcaagatagcatgcttccgccgtccgcgcgccgcctgccgacatctccttcccccactgccgccgcgtcccccgtcatcgccatcaccgccgacgcacgccaccgaggctgccgatcttgcagagtagagaaggggggagagagacaaggaagagagaggctgatgaaccctgagctccactcgagacactcaaggctgttgttggcccgatctttcagtgagttgagataactacgatttgagagaaatattgacgacccgattacaaccgtactagacattgttgtcttgcgccttagcgatcgatacacctctccgtgggttgttgatcttgccggtgcagatcaacgttattcctgcaagcaaatcgaagaaacaagcaagaataagataaaaacaatctgaattgcagatatgaattgaatacaaatgataggttggggttctgtaacgagtaaatcggcgatataactgatcacgggattacacggcaaagtaacaaagctaaactttaatctaaataaaacccaagcaaccctgaaggggtatctagctacttataggggtgggagaacaaccaagaggatcctagggtcgtgctccaccagattggggcgcaccccacataggccccacttgggccggggtcccaaacgaaattacaaacccaaaggcccatgacaggtgatgcagcacattgtttcttcatctgcggatgacttggatggaatttggtgatgaggccggatccgttggaaagaggactccgagagctttccatcaagtattcatgggccgaaaacggaggtcgtatgtagattcggcggccatttgaagttagcagggtagcaggtggccgaatctgattccagcacttggaagacttgatcttaatatcatcttgttcttccatgatgtgagcaatggttatatctgtagtgaccatagtcacatcaaggggaaaatagagatgatgtggccacgctgacatgtgcgttccacgctgacttagccaccacgtcggataaaactgggttcaaaaccaccgaaggacctaaagcgaacggttttgtaagttgagggatgccatatatgttttataagttgagggatgtcatatattatctggttttacggttgggggatgatttcgtaactcgatggcaagttgagggaccttcggtgtaccttttccaatcctagctaccaatgtggatgaatgtatatattttgactgggccaacatgcatgttactagtgggctcaaggcccaggaaagaaagaagacacacctaggctgtgtgggcgcacgttgactcgctcttatcgcgtttagcaactcgcgcgttagacctccccccaaagaacttgactcttttccttcggaagtacaaactgataataaggaatgacaattgatttacttataattaaatgatgccaacccatagctaggattggatatgtatataattggtgcaaccgcgaataaatatcaaatgtctaaattgaaccccgtcagatgatcgagtgacaaacatgaataaacagttcattactttagcgaaaatacagcggtttagatacatatatatggtatacaacaaggtagttgccttctctatgtacagagcagatcactcaagaacaatgcatagttctcatccatggaaacggt

SEQ ID NO: 25355 - DNA, 7268 bp, Oryza sativa
agcactggtaaggattatgttgtccaagcagacttaggcccttgatttgcatctgttgtaaaccttaaaatgggagagtaattacaagtttgtaactgatatactatgaacctattatattctcttcctcatatcatcagattcataatttaacaataactcaaattctcacctcccctatagaaactcaacttaacagaaagccaatcgtgaatgcgacttggataagagcaaacgaataacaagaaacagatgacatgaaaaacatggggaactccaccagggcttgagcttctctggtttcgacaacctagaaagtatcgatttcttcttctcccttttcacggtgcagattagactaccgaacaatctagtactcgttgcagatcaatacaccgaatgctggcaatctcgacctatcaaccgctcgaattccacatctatcccttcgaatcgcaggtaaaggccacaataaaaagactgcaggggggcgagtacggcgggttctcaccggagggaggagacggccgcggcgccgcaggcctggcagtggaatggcgcgggggtgtcgcggaacatggtctgctgcaggggcacccccttgggcgcgccggcgtagatcgcgttcggcgggggcatccccgccgcgtaggggtccggcgcgtagtagtaaccgccctgggcccccgccgccgccggatggtacgggatgccgatcgccggctcgtcgccggccggcgcggggaacgccgccttggccgccatggtggtggtggtcgtcgtcggtgacggcggttgggttgggttgggttggtttgaatcttgacttgtctcgccgcggctgtcaggttgtgggctggaagcctggaaacggagaagatatttatatgtgtatgcgtttgtacaaggtctgaaaaaaaaatattttcgttggaaaattttataggattttatgtgtaatcgttcgtaatactccataaaactcttctagaaaatgtagttagtcaaaaacgtaacaaagcaaatgttgaagataggagaaattacgagaccttgtttattaccggcgcattccacacaatcgggctttttttttctaaaaatgctcgaaattactttaatccgggcgactggcgcaggggagcccgatctggcgctcccccgcgtgcccctcccccctccacatgcgtgaatgcaggccctaggtcccaccgcatcctctactttcacctgccattgaaaaaaatcctttggatacctcctattaagggaatttgttttattttttccaccaaaaatatttcatctagtgtattcacaatatttcactatgtatagttctaatgttacaaactgaaatactccattgcaaccaaaaaaacccacatattttggaaaccccctattaagggatttcattttattttttattccaccgaaaaatatttcacctagtgtacttataatatttcactatgtatggatcaaatattatagtgaactgaaatattctttcgctatttgctgaaacattgtttttatataaggtgaaacaacaccagatttaaacgggtgaaacattttcgatctacttagtgaaacaattccgatatacctggtgaaacatcgtgcaacatttaaaaaaaatcaataataagctattttttttcatcggaatatatccatatgtggccttgttttgaagatttaattgcaacgaatttaatggtgcaatcggatcatgatttagataaataatttaagagaaaaatcagtttaaaatagttttgcacgtaaaacaggtgctaacgtcagcgtccgatttttcgaagatttggatcgggcgaccaatccctagtcacctccagaaatgctacacatcacacgtataattttagaagagaaatcatatgaatttctagccttcaattcgcttaagccatgtcgagacggccaccttggcatggccaagagtcgaccggcctggcctatttcacgacagtcattctaatcgactttagatgaaattcaatgtttgtaatgttcatcaaagatgatataaggccatttccaacccaataactaggatagtgtccataacattaaataaactgctacctaaaatgaaaaatgatgtggcaaataaataaatgagaaaagataatgaaaccatgtctcgcatgagatatggtttctacacaacatttaagacattatgtgagataagtaacattaaatttaagtatggaatagtggtgtttgcattaaaagagtaatgtcagtttatgaaaactatgttagtgtcttgtgttggaaatagcctaagacatcaaatgagtccgctcactaaaggagtgctggtcgttgggaccacgtgtccaggcttggcccggcccatcctatttgcctggccgacctgcgcgccctttttccacaattatattatctagatacgacgatacagatacggatacgccatcttcctaataataaagatacggggatacgcgtatatatatataaataaaaataaaaaaaataaatcgtaaactaggcaattagcaatttagcatagcagagcatgccaacaccaagtcaccaaccattagattcatctcaccaaaatacaaataatataaggctaaaccagtgcatatgtaagtgcaagatttcaaatagtacgcaaatcacaaattaatagttcatcaacatgcatagtttcacacatcacaaccagttcacagagacggtagataacatcaacatcatcatagagctaattcaaatagaattgtttaggacttcaaatacaactcaataaatcaattgctgctttcatccattgtaactgaagtggctgaagcgccattatcatcttgtatatccaatgcaccaagatcttctagcactctctcaagatttggctcatcaagtgacagtgttgggccctctctaggcagcacccgacagtgctgcgccctctggaggcggtggcgctgtgcccagcggatggcgccgctgctaggcgatggcaaacagcggaggcacggccggtggacggaggaggtgcgacgcggcggcggcggggaatggcagtggcggaggatggtggcggtgctgtgctacgacgcaaggaagagagcgagctgagttggggttggggaagcagcgccgttgatgttctttggcttgctcagtgttcgatggttttgatcgatgattttagggttagaacgtatcgcgaccgtatcgggaattttttttattatctgaaaatcgtgaaaacaaccgatacgtacgagatacgtatcggggcatatccgatacttatccatatccgatatgaatacgtggcctgggaggcgtatccaggtaacatagccccacgacacccctctcgtgttagaagctccactttgtttatttttatttgctagaatgtcaggaatagtatactctagtttgtagaggagttcggttgggaatcggcaagattttgaaggaatgtctttgggacttcagtagtgattcttgtatcttacaagttatacatttaggctaacatatatttgctttatattttttagtatttattttccgcaattacattcactctttatttatgttacagagtatttctctaatcaacggattggtcactcatcatgtggaataaactagaagtctgtggtgtagagtttgcaggtttcttggttggatttagttcacctagctggatttgagagtgctctcttctaaccagcgggagtattttacgagtatacgacctagtccgctagatgtggtgccttggatgtatagttcaaggaaagggtagttagaaaaattgatggatgtaatcgtacaggtggtgatagcccaaggcgtccttaatagtcgtccacgttagttctagtgtgttggtgttagacatcaagaagggaaattccttgatagtgagaacatgcgccctgtgccttattagtacaagccatgctgagattttctcatgctgaaatacatctactccttagtctcctttgaaactcctaaattggataggttgggtccctaagtgtcatctgtagtttaacttcagtcatatcttttattagatcttacccccatctctaattagtgtagatttccttacacaagcaacatagaatgaagaaaacattttgtgccagcagtgtgtcctttggaaaatataaatacaataccctagaatactccgagataaagtactatattgataattccatgcacgtgcggaactattttgtgagagcataagaaattcaacaagcactttttcgcgtcgttgctaagaacgcaattggataaaactttcattctttgtacattgtcttgatgagtggaagtttattacttttctaagcgggtttgcatttcctcatgttttttgttgatctgaagacatgacatgtttatggtcaattttgatctcccaaaaaattgtcaaagttatcatgagttgttcatgaataagtgaaaaatatcattatcataaacacatctcatcatcataggccaaatcataggagaatatcctgttagttcttccttcaccgcctctaactcagcctccacggatcattatggccgagaggaaaattcaggactattccgatcctgttagcaaagtcccgcaaaggccgaccatcaatgtcaaggcagagaattttaagccaaagctgatgtttattgatatagggcatatttggcagggctccaactcctaaatttaactccaagagctaggtctagagtggagttgtggaacagccaaaatccagctcctccttcaagtttattttctgaaagcactccagctagctccactcccattttggatggagctgaaactgttttggctagctctatcaaacatgcccatagttgctcatagttcatgatgtgaccatgcctactgtgcatatatataaccattattcacattatgggttaactgaaggcattgagatcaactcgcccaaattctggaatccaaattgaccgcctctaacagcgttgatttcaaacagccactaaatgtgcatacgagctccattttgagtccatgagtacttggtgaaaagctcttgaagtactctttccaacgtatctagccccatctccaaattccaaatgaatcatccgcaattgaataaacaaggtgtggcaccacctgtcatgggcctttgggtttgtagcttcgtttggggccccagctcaagtcctcccacctctgtaaatagctatgtacccctttagtgtttctcaggttttgtttagattaaagtttagccattggtactttttcgggtaaagtcatgatcggttagatcgttgttttctcattacggaaccccaacttatcgtgtgtgtattcaattcatatttgtaatgtcagattgcatttatattgttcttgtttgtttcttcgatttgcttgtaggaatagggtcaatctgcagcagcaaaatcaacaatccacggatagatgtatcaatcgctaaggcacagcacaacaacgtctcgtacggttgtagtcggatcatcagcgtttctcccaaatcgaagtattatcatcaactcaccaaaagtcgggcctatcagagtcgtgagcatatcaagtgaagctcagggttttatcaatccattatgtagcaaaccattagtaatatggttgctcataatccattctatagcaaacctttgaagatgcaacggacacctccaacagttcttaaaggtttgcaacaccttcgcctattccccattctctggttgagaaggcaaagtggtgttctatccatttgatcaagaggctatctttatatggatgagatgctccaatatatttctttctatatacttgtccaccaaaaagccaaccgcactgtggaacaaaagattgggatttcaacagttgtatgatgagtcaattcccgatgcatgggagaatttccaatagtgcatccaagcctgcccgcatcacgacatggaacaccggcttctcatccagagtttctacaatgtggtagtgcatccacaacgtgggaactgttgtatttcttaatgtcacagataaattccgcaagtgcacggagaataccgatgtagcacttcaccgggagtattccaaggtattgaattcatagggaacgtgtgtgttcagctcctcgtcaggttcatccaaggacacgaagcagttgtaggcaaaggatagagaggatttttctagtgagaagcagtgtctacggaaagcttagtttaattctaacgtggtactttaggcactagctagttcgctgctaccagatgtcgctctactccgtacccggacagggaggacttaaagtgattctgagggctgttaccacctctacatccacctctaatgtactgtggggtacgtagcaaccactgaaaattaactacctaaacaccacgtttaagcaattaataactactctagtgtttataacttactaaagcaataactatattttaatggactatagtgaacaatgatcccatatgctgttaggaactaaccaagaataattctcacaaagtaaattgtaattaatcggaaagatatttctattgaactagagtaattaacaaggtacaaaaataaggataggattaccgacaactcctgaattcctctggcttcttctaccttactctctccccattctagtatacaataaagtacaatagagtctcttataattctgctcaagcttggagtgtgtgtgtgtaaagtgaaggagttaggtccttaaataggttggtatgatggttatagatatgcgaaatgtccaaaattccccgcaaccgccatcaagagagcatctggagcgtccatgccaaaccccagaaccaatggtggagatcagggttcggggcttggcccaactagcccaggatttggcctgggcctcctcctcagcttcctttatacatttctctggtagttgggctcaatttctggtgtttcgatggagtttaggagcccaactcttatgtggatataattccccttaattttagtctagatttcctcctaactttggcggtttattacctgcatctaaatatacaccaacactcgtggaatatgttagaattaagccctaccactatgttggatgtttgattatctaagttttatgcaagtattggcggcataaaatcggcattcaacaggcccccacaggaacctcgacata

SEQ ID NO: 25356 - DNA, 3122 bp, Oryza sativa
  unsure (1)..(3122): unsure at all n locations
tatttatgtatatgttgtcaatgttagaaagtatgacgctcatctagaaaacattttttaaagtaccattacctccatcataaaataaaaaaagaacttctaggattggacacgggtactgaggaagtaaggatattaattgagtgaatgttgaggttagatgagaaaagaaagtaggtgaagaatttgaatgtcagaactttgaatctgtatgttaaattgcaacttattttcattcatttgtatccatttttactgttaacatgtcacgaactccctatgttaacaaatataaacactctaaggatttaaaattaatttgtttcaaaatattaggattcttatagtactggtattttttttacttaaagtattgccagggctttgcctcgcagtgtaattttcatttaaaacaaaaatatttacaaattacaaggaagaaagaatagaaaaacattaggaattacaaaagttataaccgataaaaaaactatatgttttaaagggtccattctgcacatatgcagaagaacttctttcttgaacaggattctccatgatccaaaggaaggttgctcatttcgaaaatttttcccattcctttgcttccagatatgctaggcagcaacaaagaaaaatttcatgaaacctttttgcctaaactgcaggcgtgccgatacaatcatttgaaaaaaagttgagattggatcccacagaatgcccaaatactgctaacttctctgactgaatggacaaaagaggaaaacatgctctcttgtttccctaagattattaacacgaagttcacaagtgaagtcatcgttctcctttgtatagtgatgacgatcaagcatatctctggtgttcaatctatcattgaaaagaagccagacaaagactttttatcttcaaaacacatcgtattttccatatccaaacaaaaggtctaggtgtttgcacagtcatgaaagtgagcttgtaaaacttattagcagtgtatctatcagaattccatagaaaactccagtcatctcccttgctatcttgtaaattaagaaaggaaatctcttcctccaaattgagaaattcttcataagattgacttcttaaagccaaagggaaacaatcttccaaaggatgagaggacagctgctgcacggactactttttatccaaggccacactaaacagatttgagaaagtcaaacacctaacctcttcattccaaggatcatcccagaaaagagctgaagaacctgttctgacagtacatcttgaaattcctctgaaaatgtctgacaaagcaataatatctcgccaccagaaagagcctttattccaaatcatatgaggcaccttaatgccatagtaagaattccagattaattgaacccaaggcagatcttctcctttgtaaaacttcacaagatgcttcagtaaaagagctgtgttctgaactctcaaattaataattcccaaacctcctttcacctttggtctacacaccatttcccatgaagcaagggattttctagatgagcttgggttgtttcccctccatagacaatttttccttgcagtatcaatagctttggctacagaaacagacaactgtagggaacacatgtaataagttgggattgaagataagacatagataattaaagtgagcattccaccctgtggcaaaaaaaagagaactagctatcaatcttctctcaactctgtcgaccaaaggagcaaagtccacaactcttggcctagttgttcccatgggcaaacccaagtgggtgaaaggcattgtaccaatagagcacccaagtaagccaacaaagagcttagcattctcttgggggagattgattggatataagctcgaattatgataatgatagttcaccttgagtccaattgactgagcaaaagagttaagcaaagctttgaaacaaaatacttccctctaagatgctttaagaagaaccaaagtatcatcagcatactgaatcacaggaaaacccttgccatcttgttcattaattggtttggacagcagacgcagagaaaaggctctgttgataactctttgcaacagcttagcaccaagaacaaaaagcaagggggaaagggggtccccctgtctaactcctctcctacatttgaaagaatttccaggaacaccattgagcagaacagaagtatgagatggagaaaacaccatctgaacccattgcaaccacttgttattgaaacccatgctttgcatgatagaaaggagcacagagtgctcaatagaatcaaaggccttttcaaaatcaagcttcagcaggattatctccctcttggattgatgacactgatgaatatattcaaaagaccatgctaagcaatcttgtattgttttgcctctaataaaaccatattggttttcatgaacaagcttgagcataataccctggagacgatttgccatcaatttaattaaaattttcaaactgacccccaccagagagataggcctaaagtcattcacagtttctggaaggattttcttaggcactaaagtaatgtaagagctgttaagaggctgcaaatcagtagaaaaaagcatggaaatgggctgccagcctgtagaaatcttgagaaatgataggctaatatttctttagaaagaacccattaaacccatctgaaccaggggccttctctaggggaattatcttaattaagttgtcaacctcttgggtagagaactgatctaccagacaatccaaattaattggataagggattaaaggccattgagggagaagaagagatccccattctgttcttaaagctttggaagaaaagacttgccttttggtcatgcaaagaaaccacttgaccagattgatcataaatctgagagatggaattcaatctaaatctttttgtggcaatagactggaagaatttagtgttctcctctcctaacaacatccatctgtttgtacatctttttttttccagtatagcttcttgaattctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25357 - DNA, 1611 bp, Oryza sativa
atccaggttggtattggtccactaagttgattgttgtataaaagtagaagttccaatttttttagctttgagagccaactaggtatttttccagtcagtgcacaatcatttatgccaagaacctgaagattctcaagaccatgaattgtttcatcctgtgaatagtttcatgcatgaaattgcccccaattagcaaggtagtgaggttccttaagctcttgagtatatgaagtgcacctgtgatattggtaaagtagttgtacgaaagagatacaaaggtaagggatttcaacttttctgtctcctctggcaactgaccgtgaagcttattgaaagataaccgcaaccaagttaaattactgcatgagtagatacttgctggaattgtgccggtgaagtaattcgtgcaaagatctaaagttttcagatttggtaggttggagaagttaaccttagcaaggtctcctgtgaatttgttgctcacgaggacgatggctgctagatttgtgcaattggccaaggttgatggcagctccccagatatgtagttatggtccatgcgaagctcctccagtttcttgagctcgcctatagattctgggaccttgccactgaaactgttccccccaagatcaagaaaaactagattactgagctttatcacaagcttaattgttccttgcaaaccattgttaggaaaagagaggtactccatgatgtggcatggaagagatcatccgggagggccccactaatgttgttgtggccagctttgagcattctaagtgcagagcatttacctatcccagcggggatttcgccactgaattggttgtagcaaaggtcaagagcagcaaaggatagtgagctgatgcagaaagaggaaggtatgtgcccagtgaagctgttgttgcttgcattgatcgctactaggttgctcattttctcccatgtggtggatggaaatgctccagtaaacagattacttgagatattcagtacctggagtggccaatcagatgatgatgagtctacctcttgtagttccccgccgaggcggttgaagctgacatcgaggacaacgatgctgccagagaatatcagctctggcggaagcccaccggagagtgagttgtatgacaggttgagccgcgacaagctggtgagctcgctcagggatgacgagatgcgcccttcaaggcctcttgaggccagcaagatcttggttactgcaccatccacatcacagatgatcccttcccaggtacagcagtcggtcctattcctccatgacgcagcgaggccattatcatgtggcggtgacagctccgcgaggaaccggaggagggttagcctctcctgctcaatgcatgaaccgacgggaggacagatgaagctcagcggcagtagcacaagcgcaaggtgaaagaaattcatgcgaaaactgctggctttgtttgcatgaaagatgtgatttggcttcttggtcagtatttctgtcacaaactggcaggctactgagcatggtttgccaatataagctggtatcctgtgcaaaaaaaatacaatccttgagctatatattgtcgaataacattgctaaattccttg

SEQ ID NO: 25358 - DNA, 898 bp, Oryza sativa
caaaatgttatataccacatgatgcattccaagattaacaaataattttcacccaccccttttggtcagatcaatgaactttgttacattatgtgatacagaacatgtataacgaggaccagaagtcagccatctcaacagtaaaaaaaaaggtcaacgaaaagcctatataaattgacaaaactggacatgactgcgaggcaaatatcgctcagtcacaagatctcacaatcaaaaaccaaagaaacatctgatcatctccaaccaagtgattgccttatccctgagaaaatcaatcccagagaccttcctatcatggacacccagaagtacgacactgcagcactaactttggtgacaacagcccttatgaaaggcatggcaatatctgacatttctaataataggctgaaataatacctcctgcaacagaacagagtaaagttatgttcatcttgccccaagtcgcacagaaatgtttccatgaattattcatgaaaagaatggtagaaaaggaaattgcgaataccatccagccagagctctcaattctttcgtccttctcaccggaagagaaaatgagcttatgtgaacgtactctagaagagtaacggtggaaggctttccaaatccaagcctccaccagtttgtcacttcagcttgattatctgctggtttttcacaaagttttctggataaaacatataactcaaacctgtcctcgtacattgagacaactgactcaaaatactggtgcagccacccattaattgccaccttaaaaaaatttagcactggattatcaaatctggaagtaagaaaaaactggaatagagatgtttcctaaaaacttaaaaatattaaccaaaaagaggagagttcaaagtgcaaatatttg

SEQ ID NO: 25359 - DNA, 4115 bp, Oryza sativa
agtctttttactgcaagagaggggttaggcaaggagatcccttgtctcctcttctttttgttttaggggctgatctcttacagtctattattaatagtgcctatcaacacaatgtaatatttatgcctatcccaactcctgacaatgattttccaattgtgcaatatgctgatgatacgctactcttcttatctgcatcatcaaatgagcttttcagcttaaaggcaattttgaatacttttgcctcctcgacagggctgaagataaattttgagaagtcatgcctgattcctctcaatgtgcagcctgaaaaagtacagcacttatctaagatgtttggttgcatgattggtaccttgcgattcacttacttgggtttacccatgggtataaataggcccaaggtaattgatttcagccctcttgttgatagaattgaaagaaggttgtatgctacctcagctttgctatcttatggtgatagattaactatggtgaactcagtgctctcttctttgccaacttactacatgtgtactctctctttgccgaaaagtgtcattaactctattgatagagcaagtagacattgtttatggagaggatgagacataaattcaagtaagaagcctttagttctttgggatagggtttgccagcccaaatccaaggggggtttgggagtaatagaccttaaatttcagaacaatgctctgttgatgaaaaatcttcataagttctataataggcatcctgttccttgggtaaatctaatttggactacatattaccctgataaagttccacatgccttgtctttaaggggttctttttggtggaaagatgtcttgcagttcattgatattttcagaggcttatctaagtgtacagttggtgatggcaagacttgtttattttggactgacttttggaatgataatataatatcagtgtcttatcctagagctttctcctttgtaagaaactagaaagactcaatgctgcagacttctttaaaggatctatctcagatgttattccttcctttgtcagatctggcctatcaggagtatcttcaaattcaaatggcagaccctttggatcggctctctgatgagtatcataaatggtcctatatatggggcaatgacaggttctcttctcagaaaatttatgctacaaatttcatggatgtgcagtcccctgtatatctaaaatggatctggaagagtagctgcactatgaaggttaaggtttttggttggctccttctcattgatagattgaacactcgtgatatgcttgacagaaagttttatgctcctcaaggaagtgatttaacctgtgttctatgctcatttggagaaagagaaacccttgagcaccttttcttctcctgtcccttttgtactgatcgctgggagcaatttggtatagtctgaaatctctcctactcttttgagaatatgctaacacatgccaagaactcctatcaatcttcgcacttcctggaaaaggttctttatgcggcctggaatatttggaagtaacgaaataggttcatttttgagaatgttgtgccttctgttccttcctggatgtcgttcttaaagaatgatatgtcccttcttgtttttccgtctaagattagatgatagataagttttttttgttcctggctagacaatttgtaacttttgtaattctattttttaataaaatgttttaactgtgggggcttcccctacagtgttttcctaaaaaaaaaagaaaaggtctcggtgcttgacaacagattattatacttttattaacatattattatacgttattccccgcaaaaaaaacatattaacgtttttcactaaaaaaaaacttgcaactgttatttagcaatttcaaaaaaaaaatcttattaggaccagacctagttgaaaaattgtaaagaaacacttttatttcaacaaaaaacggattgaacttttacatccagaatacttttggtgcgactacgtggttatacctagacaccaggtacgtgcgaccacggcggcgaggtgaaatccgcagctcccccgccttgtcgtagctgagcccaaacacggtcacgtggagcacgcatccatcctccgcgcacagggcgtccgccatgtcgaggccacggcgaagcgcgcactcgacgaggcagaacacgccgtcgcccatgtacgcgagcgtggcgcccgagggatgccctacgtgcctcttggggtcctcgcgaagcagcgtctcctcggtgatcttggaaccgagcgcggcggccgatgccgcggcgccgcgagacgcgacgtcgcaggagcagaggcggccgtcgtcgtcgagcccgacccacgcgtccagatcgtcgacgtagtgtccctggccctggaacggcagcagccagtcgccgagcggcgtccacgctgccgcggccggacggcggcgggcgatgtcgagggcgtaggtgccctgcctccggcgttcgtcgtccccggcgcgccggttgtgcgccgacacgaagacggtgcggccgtccgggtgcacggcgtaggcggtgacgaacatggggtcgcggccggcgccggcgaacggcggcggcgacggcgaggggacgctctcccatgaccaccgctcggcccgcccggaaaacctgaacgagtcgcgcgcggggtagtcctcgtcccgggggcgcccgggccggaaacccatttttcccaaaaccgcccctttttgaggtagtgcttcgacgcgctgcgagggtccagcgcgtacagccgctggccgtggaccggcaccatgatgcccggcatcagcggcgccgtcgggcgagggccggcggccagcgacgacgtccccgtgtcgtacatgaagacgggagcatcctcaaggagagcatgcgtggcgatgacgatcttgctgccgaccgcggccacggccgggaaggagaggtccaccggcgcctctatgcggacggcggcgtgctcagggaggtggtggaacatggcggcgccggtgccggaatcggtgaactcgtcgacgtccagcttgtggatgacgtatcccatgtcccaatcaagcaccacgtagatgtgtttatcgtcgtccctccgacgtgaccttttactggacatggcggtgttgctgctgtgctgatcctgcaacgcccgctttgagctcaacatcgtatcttcctctgcctgcttcgcgcgcgcgagtaaacgaataatcggtggatttcggaataggatttataggcttcctcgccgacggattcgccgtgactaattccaattccgtttcggaagtccgagtggattgcaacattcccacacggcccgtttggttgggattccgagactggcccgcttcggagtcgctcccacccccggaaccggatcgtctgactttgcatagtaacgtcatgagcgtgcagttctacaatatccaccgtccattccatcctacggtcctgcttgctctatcctcgcactggtgcacaggcacccaagacggcaagacccaacgttaggcccacaaaatcagtggcactgtaaagtgggatttttggattagtcatgagaggctgttaattttggattagcactctcagttttggcaccgttgacagttggaggtcctactcttgctaaaaatcagttctatgcatattgcatatattgctcctatgtatatctataacttaatataaatattcgtatttttccggtcgtcacaccggtttttcgtcccgcttcgtcgcccctcatcccccaaaatcccaatccgaatccaatcaaacctcgtaaaaaaatcacaatcacaatcggagttcaatcacacaaatcatgatgcatgtacacatatatatccaaatataaaaaccaaaaattagatcgaagggagtcgccgccgccgctgtcgttgccgaaccaccaccgtcgccgtcgccgccgcagggacggctggctgccggcggctcccctcccgctggatccggtggtgggggagagcaccgccgacgccgtcgtcggtggtgggggaggactccgccgccgccgccgctcgcgggaggaagggcaccgtcgttctcgttagat

SEQ ID NO: 25360 - DNA, 2772 bp, Oryza sativa
ccacaaccgccgaatgtgccgcgggagggagcctaaagggggtggagggagccgccgcccccaccctcggatccgccgcggccaccaccaacccgccgccgccgacccgagagggagaggaggaggggggagggggggcgccgccccgccgccgccgctcacgggaggaggggtgccgctgccgctcgggggcgcggaggggagggcggcgaaggcgaagtgagatgggagggagggaaatgggctagggtttcggcggctgagagggagagggttttgtttccccactatcgacgctcggccgtccgatcaaaaccctagagatcggacggccggtgtcgtccgggccaaaatcggcccaagatggatcgagagtgaggcatcttttctggcccaagcctaggttgcggcctggggaagaaaagtgagcccgcgcatgcgcaaaaggccgtgggccaaccggcatgggccggaaataagtctattttaagtccctcgggctgaaaaaaagagaataagttcatttttagcgctcattttttcagaagcattacaattatagttattgaatgtgtttatttcgaagcaaacctaaaaggaagtatttcctttctttttccaattaaataattgttaaatgatgtttgtattaataaaattagcaattaagctctgaaaattccaatataatttcaaagagcgtaactaatcatggggaattttaaaaaaaattaaatttaaccatgtcattttatttctcatacttgctctacttgtaaatttatttaattatacacatatacctacttaaaaataccaaatatttcagagaatttgtattttaattaattgcatatttttctgatatgtacgcttcccgttgcaacgcacgggcacttttgctaaaccaaccaacacttttggtcaatatacacactccgtaatcacccggtgtaatgcacggacactttttctagtagaatatatatttccttaatgcaacttcatcgaccaactttgcaagtacctatatacgtatgttgttttttccttttttcttttaaaaaagttgtacgctcataacacatacacattcatttctataaacgtgtaaacttacgccctaactttatgagcacctcaaaaaaccataccggtatatatatatatatatgtatatatatatatgtatatatatatgtatatatgtatatatatatgtatatatatgtatatatgtatatatatgtatatgtatatatgtatatatatatgtatatatgtatatatatatatatatatatatatttatttatttatttatttgagatcaacaaagtctacgaaggtaattgctaaatgttggatgggctgtgccgccgtgagccctcttcgcgagaggctcctgcgtgcgcacgtggcccactaggcctggcaggttggtctgggctgcatgacagcgttatgggtcgggctattggatggggtgcagtgcaaacacgggattgctaattagcacagacgcgccattaacttaagtcgcgcgcatttttttttggcccacagctctgcggcccatgtcctcacgcacagcccatttccttttttcccgtggcaactgtcttttttcgcgtcgcgaagctgccacacctgcacaaaaatcaggaaaaaacgtgattagatgtgttgtaaatcaacgcgcctattagcggatcaccggatccgttccctgtccttcccacaacagtataggcgtgagatgatgtagaacacccgcgcccatccctttgccgtcaagaacattgcagaagtagacaattaatacagatatagggtggaactctctcttcattatagatcttatctggagtacaagccaaccattagccatagatgtcacaccctccccctgtatatataggggtcttagtaggagatagatcttatctctactccggttcggattggtccacaagaaaggatctttatctccccgggagataatattccataacactcccccttagacctatccgcgactaactcatgcctcgtcaaaactcctaccaaaacccagtgggaaaaaggctaggagaaagagtacatagttatcgctcatgcattgcacgttgttgcctcgttaaaaacctcatgtgaggaacaacagcttcactcactcaagggaaaaagagtacaacactaaggactacacggtccatactgtgggtcatgttctagggtgctctccccctgaacctagtaaacatcaaagtcttctcatcccaattctccggaaaagcttccgagaactaactgttgggagagactaggtgatcaatcctctagattattactcaacttgaattgctactcacatcacctcgccttaggagtctgtgagatagcccacttgtatttggtgtcggtcaataaagacagatctttctatgataggaccttagaaacaggtctaagtgatcatcatcgagtcaatgctccgggcatactctaagacatttcaatgtctcgcaaatgacaatcaacacatagcacatactccccctgatgacaacctttgtcacagaccatgttcccatagcataaaacatctctcagacgtatgcgtgggcaagaatccttcagatcctcaaaccattagtcttaaaagacttatctcatttcatcactaaaatgagaatagggaacatagagagtaatgcattccatcactatcatataccacaataccatactgttgtgcaacgcaatcta

SEQ ID NO: 25361 - DNA, 17337 bp, Oryza sativa
tgataatcgtgagatgcacatgtgctaacagaccccgtctgtttgatctcatcgggttcctcatttcaatcttatcaggtcataaatgggtcatcatccctccaagggattatacaatatggtgtgttcagacttactaattattttgtatctgagaggaaaattcatcaatgaggtctccccctcagagaaaattccgtcaatgtgattttctcccaacgggagatggtactcttaccggaatacccattggtacgagatttgcatgatggaacttcactaccgagtctattcaagacctcacggatttcctaaatccgttagctgcatatttaatttcatgccattttgccaatacctttatttagcggaacattcaacttacgtgggagaggtctcatctaggacctacttgaaccatcgcgcatcaccacctcattatattaataatgacccataaaaatccgaacaacgttcgcgattttcaattggctattcggttcaacctcaattacatttccatttgacccgatttgagcatcgtatgctcatgccatggactttttccggatccgggttctctcagagagaatcattagcaagaggcgacatagtgtcgacacatttattcccacttacacatttaaccagatctttgtcatttcccaaaacgatcgatccatggttgttccgtattcctagcaccatcatatgcgcgcatcgctaggaatgtcgtctccacgacgaccatcattatgaggtatatcaccttccaaaggtgaattctccaccaggagaatcagaggagtatgctcacatcttgtgagaactcttatgctttgactaagacccacggaccgtgttagcaggcgtccccgcagaacatgatcaaatgccataagtcttatgtggatacgatattattcccgggtctatccacatttaccacaatttggagcattactctatttaacaattatccaattgttcctcatatgattttgttggcaaaaactccgtgcaccaagcaaccaggagtatgaactaaacatacaagttcagctcatttagtgtgttcactcaaagaaatctccaggcattccaaaatgggcatttctctccccctaatgccgagatgtgtttcaatagcatactaccaatccccatatcgtggcataggattaaggaatttcacctcgatcacaaatgttctcccacgaatgtatgctacggtggtgatatatttgggaaatatttacgcactttaataggagagatttttcattatatgcagtgagcctggacatataccaatacagtggcatgaatattgtattcttccttcttccgaagggttatcctcaacctcctagttaggatatacaagtctgcaaaaaccaccattgctaccaaatgtatatgcaaccaacatgcaaatactttagccaaatgcactcgccatggattaatgctcacctagtgccattcaaactcacaatcgattctggatcgacgtgcattagacatcgcatgtcatatgcttaagaaggcaacctatggtggcaaaacgcattccgatgcgctcaacaaggagtatgatagcaaagtgcgcggccactagcctgctctgccaagcagatttttgtggtgcagagttgtgttaaagtccagctcgtctaatgcccaagtttgaccccaattactcataccaaactctagaattgggtcatagttaagtagcatgtattaggtacgatccacgagcgaattatcaaaccacatttgctaatgtcccctggacatagccatcgagagataatccatacctccgacaatggtaatattcacaataaaaccattatattcagacatatccacaaaaatagtggaatgtgtcggtgcaaccgtcgttggcataacgagctcaacgcatgcaacacgacgaacctttgcatggccggcacaagtccacacgcgaaaaacgccagtgtgcgacaaacatggtcatcaacccgtgggtgatcaaacaacacaacctgggagtagttatcgactacgagagcgcgataacacgcaatagtgcatagccaacatttgtctgaaatacagttacgtcgaactgtgtgagtggttgtaactcctcggattatacactaattgttcttctaaactaaagcattttatcaattccagcataaagataagctttagaatagaacaggaaagaccaagaactttatttatctgagaaatatcgatctaatgcaaagttccaaactaagcaaatgataaactgcttggcaacagtatagtcgaccaatgtcctcctaggacatgctctaaactagccatacaactcccgttgtcaaaacaactttattagacaaacactagcaacaattggtcaacaaccagaggtggccatttagcgctagatccacccgaggaccgagactgggtcaacacccaagtcaagctgttggcgctatggtgaagtgggaatcatacctattctcagcatctacccttgggtttattcctctagatttgccttctcttttccggtgtcctcgcaagacatcaggttccaaataatattgagaagatatgtgcacaccaagggcaaccatacgaacagtgtcattccaccacatggaaaacactttatatctttcaccgggctaggtgaaaaatatctcaaattattgaacctcgcaactccacgttgccagaaaattgaggtataatcgtttatctccaaatcagaaaagcgtgctctcaaccattgggaaagcaaaaaaatgtcgaccgtagtccgaccatactctgattgagatgttaagccattaggggaaaggcacaatgaatcccaaacacattgtctaattccacacatttcaacgactcagaatcccattcttgagtgtgatcatagggatagagtgatctacattaatgcccaaagccatacaatagtcattgaaggcctttacgtgaaatcacccacactatcatccgaatcgtttcatgcggttctcagagaacgcaacacgcaaacggatgatatgcgcagtgaaatcggcaaaagcatggatctcgtacaacaagtatacgtgactccatcttgtagacacatcgatatcaccatttatgtatggaggagtgtatcagtaaagagtggtcttatccatagccatggatatttaatttcccagaatttccatgcattaggtgattttctattatttacttggtcttatttggcattatattcccaatatttataccacacagaaaaccatcacacataaatgcatgaaaataaacccatcataatgcttccaaggggggattctacactatgtgaacacaatttatagaaacatcataacctagagaaccatctctagattatttagttggaattgcattaattttaaaagcaaagcaatgcttaaaaaacaccattacatggttatttacgagtccggagacccacatgcaaagccgaactatatagggcctaagcaacaagacatagacacacaaacaaaattaatataatctcttattaattacaaggttcaaactataaaattccattaaacagtgaactatagcgtaaaaacccaacactccaggggcttaaacgcaagttaccaataaaccgaaattaatcaggccgaattaccgttcaggccacgatcttatttgggctagcaagcacagtgtagcccaaaatgcctaatgggccgaatttcccaaactctaggcccatgaggatttccaggtttattatttttattaatttgtttgggttgtcttgttactgttgggctttattcggtcgggcggaggcagaccggcccagccggttcgcctaagtgaccgagagagggaaggggagggggggaattagggtttcccctttcccattcattgtccgcaacgacgtccaccgcccggcgcaccggcccctcaggcacggcggcggcattggaggccattgactgtcgactttgaagggatttagggcggtgcacggcgaggaggtcatcgacgacccatccactacaccgattggcaggacggctatgatgacatcactcctgtgtggcaatttggtgcggcggcggctcggtggcacacgacggagctccgcgtcgacccgcgcatcctcatgacggcggcgaggcgaactcaacgacggcaactgtgaccccaacaacggcaaccaaattgcatccggccatatcgtctcggcggaggttaatccggtagcagacagccgacgacccatcatcctcccaccacggctcgacggcagcgtcgatgggaggtcaacggcggcggcgcctcgcttcggcattaactccggcggcaacggcgatatgggtttagggctttttctgagacggcggtttcccgcgacggcattgacgtaaggccgacggcgtacccaacagcgacggcgaacgatggccaacatgtctctaagtccgactacacaggctgagaatatgtcaccgtattcccggtgtggcgtcatcaaaagaaagagagaaacagagatgcaagggaggcgggcgagacggccgattcggcccagccgaattaggtacgtctccagtccagggtttcccatcaattttaatgatttctctcacacggttttctctagttttcatcaaataaaatagatgcatatagatcaaaagcaggaaattaatctaccgctagatcaagagcaggatcaaaaatctactgcaagcaaagcatccataatatgataaaaacgagaaaatataatcaatctataaaaacagcatatcttaatagacacatgcctggatatatgtatctatgaattagtaaattagtttagaaaccaatcttactaattacccaggttcgcatgctcacaaaaatctttcacgtgcatgccgcctcctgctgcgtcgcaggtcgcctcaggaacggcgcggcgtcgatcggtatatcgcacgcatctgtacgtgcatgtgtacgacaacgatgacgacaggtcgtctcgcaagatacgctagctgcttagcacgcacagcacctggtgctcgtctcgcaaggaggcgcgacgatgattcagacctcgtcgaccggcggcatacatgtatgcaagcaaaacaaccatcaaccattaattaattaatttgtaatcagaaatcaatctactgatgtaagtgcatgtgtcgatgcatgcatgcagcatgcgtattggttgatttgccatcaatcttgtgcatggacgccaggagccaggtccatccatgcttgcgtgtggccagcacatgccatcgcgtggaggtgcggcgtccagtgtagccgcagccgcgtggcggatcgcgtggggacgaaccgacgaagaacgggccggtgcactaggagatcgagcaccgacactccctacgggcgcgctcgatcgtgcgagggcggcgggccggcggccacatcggacgacaggagtagtgcacgctgctcgcggcgtctccacggtttcccggctacctgctcggtttcccattgcgatgtctccgcagtcgcgtgatctcgcaaaggaaaccaggacaaaacaatagatcaatctgttgacaaaacaaaatcaacagattggaacgacaaaccggtgaacggagagctgctgataacgtgttgtaaaccaacgcgcctattagcggatcaccggatccgttccatatccctcccacaatagtataggcgtgagatgatgtagaacacctgcgcccatccctttgccctcaagaatattgcagaagtagacaatgaacacagatatagggtggagctctctcttcattatagatcttatctggagtacaagccaaccattagccatagatgtcacaccctccctctgtatatataggggtcttaggaggagatagatcttatctctactccggttcggattggtccacaagaaaggatctttatctccccaggagataatattccgtaacaacgtgaacctttacctgattagatccgataatcacggtcctatactttctttttttctcacgtaacattgtttttcttttttactaaagatttgaaacctatcaacttgaattttaaaaactttcaactacaaatttaaatttttaagtcaatttgaaaacatttaagtcagattttgaaaatttcaagtgggattttgaaaatttttgacttgatttttgaaatttttaggtcaaaatttaaaaactttcaacttttcatctcaaatttgaaaaactttcaacctagatttgaaaactttcaactcaaatttaaaaactttcaactcaaaatttgaaaactttcaacttttcatctcaaattttaaaaacttttaacctaggtttgaaaactttcagttcaaatttaaaaactttcaactcaaaatttgaaaattttcaactcaaatttgaaaactttcatcacaaaatttgaaaactttcaacacaaaatttgaaaactttcaattatacatttgcaaagaggtgcgtgaaagattaaaagaaaaataggaaaggaatggcgaaaaaaaaagaaaaacgcgtccggaggcgctaaaataaaaaaaaaaagtgtgaacagaaagaaaaaaaaggccgcgggaggaggcccagctagcgccccccgcgcaaacacgccagctccattccaggcgaggcggtgagcgcgtccgcgggagctggcaatgtcagccccagacatgtttttttttttgcgtttttgttttattttatttatttttaatgactttcaacttaaactttgaactcaaatttcaaaaactttcaacttaaattttaaaactttcatttgcaaattcaaaacttgagctaatgctaatcttgacctaaaagttttgaaatcttgatttgaaatttttctattctaagtcaaaagttttaaaatttgagtcgaaagttttcaacttgagtcaagagttttcaaatacaagttaaaacgtttcaatctagattgaaagtttataaatttgagtaaaaaactttcaaatcttaagtcaacagttttcaaatgcgagttgaaaagttttcaaatcttagcatcaaagttttcaaaatataagccgaaagcttttgaaatttgagtcaaaagtatttgaaatttgggttgaaatttttagaatttagttaattttatttttacttttcagtttaaaattgtaaacattttaggagaatttggtccttttttttttaaaaaaaagagttgttctcacttctcgtgtgggctttcttatgtgtgatttgcctgtggctggagaggaataggccatttgggtcacatctatgcaagtgtacaaaagctaccacatactctttttttttttttgataggaaccgaaactttattactgaggtggtccagccaaatcgctggtcaccaaacgctcaaggccaggtggagtaccggcccagctacaggggtctagtaaattacaacccaattttgccaactcatgcgctaccttattacattccctgagacagtaatgaaccgagaaagaaatgaaactgctagaaatgacattcttgatctccaaaatcacaccccccatggcggaaagattgaaagagttctcctggagtgcagatttcagcagcatcgagtctgtttcaagctcaatcttcatcatccccctttcacttgccgctcctacagccgctgcgcaagcaagaacctcagaatggaaagcatccatcaggtgattagctccgccagctccggcctgaaccaccactccattatgatcccagataacatatccccatccaccttgtttggtgctgcagtggaaagccccatccgaattgatcttcaggacatcaggaatgggttttctccattttgccgttctcctctccttcatcttttttttttttgaaaccgtattctcctctccttcatcttcccctctttccgattcaactttaaatattcctctcgctaaccttcattggatactgagccagctcggctcggctcgttctggctcggtatgttaacgagctgactcggctcggctcattatctcaacgagctaaaagcctaaaagtgcagctcagacttggctcgttagaaagctcgagctagctcgtttagctcgcgagcaaatggggacggaaagcgatttcgtcgcggccggcggctagcagtgcgcgtgaacaacaaggagaggggaggggactcacaagcataggacggggaagaaaacagcattgctcacgagcttgtccacccgtttcaagcgttttggaagtggatccagacagccatcaccgacgctggcgccggcatcagcttcggtttcgacggcttttggcggtacattcggtccttcttcgccagcgtcgtggccacgctcgccggcgcagctcacgagctcgtcgggtcgacggcaacaatggaagcatgcggccggccaacaggacctatgcatatgcgggcgggcggccggcatcagcacaagcgtgcgcaggcaagcgtccggtcggccgatgggcgagggagcgccgcgggatgggaaggacgacgacgcatcgctagcgctctaccgcgtacgcaagggaagcgcggcggcgctttgcggcggcgttgcgtaatttgctatgtgcttgttttggagaaagtacaccgaaggtccctcaacttgtcaccgagttagaaaacgctccaaccgcaaaaccagatattcggggtctcttaactaatcaaaaccggcaaaatgggtctttcggtgattttgaccctggttttaacctacttggcggttgaataggcgtaggacccacgtgagctccacatgtcagcgtggccaagtgagcctctccctctttcccctccattctcttctcccccccctctctctctcttctctcctcttctcttcttttggctagccggccggcagttgaggagcaggccactgggcgaggcggcggcggcggcggccggtcgcgaatggcgtcggcgacgctgtgtcgccgccgtcggtgaagcggccccgcgcggccgggcgccgcggcgttgggcgcggaggcggaggcgaggccgtctcgcttcgtttaagtccctgtctcgggcggcgaggaaggtgaggacgaggttgacgtcgaccgccgcggggtcatcgccctccgtcttggcggtggcgcgcgcctctcggagtcgctcgccgctcggcaccggcttcatcgacaacccgctcagcaccggcttcagcgccgcgccgtccctcgccgccatccccaccaaccagtccgtcggccaggcgtcgtagtgcaggcggcgacggggaaagagaaggcaggcggcggccggcgcgcgagagggcggcggcggtggggaaagagaaggcaggcggcggggagggaggggacagctatcgttgcacaatgtttttctggtgctggatctgctggaagacgcatgcgagtcattacttgacagcatcgttgcagagaatgcaaagcgtttctgctcgatctgaatgaagctatctggaggcaatgtaagcatcatttttccatgtaaccatgttcagtatctatctactatgttaccccgatacggggatacggacacggatacgcgacacggcgacacggggatacgacattttccaaaaattgaggatacggggatacgctaatatatatatatatataaattaaaaatacagaaaagtagtaaattgaacagggcaaaaatagattgtgaataagtgctagaccacaaatagtgcatagaccacaaattaatagttcaacggtacatccaaactcgcaatgaccatagaagttcacatccagcccacagggcacgggcacacaactagtttataaataacaagttcacagccacaaatagaataattaggatagaccgataaacttgttcagtactctaagttcaattcaataataactagataggtagatcaatttaattgctgcttgtatcaatcatggtaactgaagtggctgaaggttcagcatcagcagacagatccaatgcaccaagatcttctagcaccctctcaaggtcaggctcatcaagtgaaagagcagcttcttgaagaaaatcagcaccaccctcgaacatctcaaagctgtctcctccaacatcccacattcttgatggaccagtacagtactcttcagatttcctggaaagaagacgcaaattctggtgcacaaacaccaaatcttcagcacgtccagggtttagcctacaataaagcaattgtagtcactgatcagttccatgcatttcaaacatacaagaaatttactaagtaagagaaggaacagaacttgtttctcattgaattatggatcaaaccataggtgctccaatttctttcagcacaagatgatgatgttggttgtccaagtaattttagcgccaatttttttaactcaggggcagagttaccataaattccccaccattgctttgcatccaaatgagctctatccttgattgagtcaaaggaattaaacccatttccaaacagcgagaaatctgcaaactgctgcttgatcttccttaattcatcaccagcaaaataccttctgaagcatttgtttctcatttctgaaatttctgcatccatgtgaggagcttcacgggttggaacctcagccaaccagctttcgcagtagtacctacattttataaaaacaattaataggctaacaacgactacaaattatggaaacaaacatttaaaagtagaagcagaacattacttggggttcagtgagtgtgccaagcaatgcaggggggtattactttttgcccatcgagagtacaagatctcttgcacatgaaagaaaaaggaggaatgctcatttagttctttcccttcatgacgataaactatttttttcaccttatctatcattgaatcccacatctcataaaccaaatggaggcaaggtttgtcggtgtcagctgcacgaatcatggaatagataggatcagtgaaatctaggatatactgcaccttatcccaccacacatcatttagaaccttctctttgacttgctgtgcttgaacttgattgtcttccctaataagaattccatttttcactcactaccatcaagattagagattctttgatagcacggaacctctttaacattacaatggtagaagcaaatcttgtatcaacaatggcaagaaattttagcttactgaactcattgaacatggagagcctcattgagtggttcatgatgaagttttttatgaaagaagaatctgctgctacctcagtgatccactgaaattcttcataagcatccccacttgaactcttggctgcacatatgttcttcaaggccaggttcaaggtatggacaacacacggcgtccaaaaaatgtggctgtacctctgttcaactatcaacccagcagccctgcaattagctgcattgtcagtgataacctgtaccacattctttggtccaacatcctcaatgactgcaatcatcttctcagcaatatattccttcctcttaatttctccttcagtgttgattgctcttaaaaacattggcccatcttctgtcactgctagaaaattcaagagtgggcgcctttgagcatcagaccacccatcggacacaatgctcacaccttttacaggccatgtcgacttaaggggatttaacaaccgctcaacatgtgtcttctcttgaacaagaagagtagttcgtagcttgttgtaacttggaggggaatagcccccaagcgcattgttgcaagcaaacataaaagccttcctgaaatatgggtttcttgcaacattgaaaggaatgcctacagaccaaaccaaatgtccaaatattagtcacatttgtaacacaaatatgagaatgtatgagttaataaaacgtactaaactctagtctaacctgctgtgtagaacattctcgcaatcaaagcatcaaggttggaacgagtatctgaattgaagctagactcaatagctgaaacagcccttctcttccccctactcgcgccctctgctggcagtgggatgtccttaggcaagttcctttcagcaactgctgcagctctagccatttcatcatgaagttgactaagaacatcgattgttacctttggacagggagctacaccattagatcccaccttcaagagatgtgctttaactcttgagtagctcccatgcataatattaccacaaagcctgcatctaaaccttacattccctccctggcctttacctgttttctccattaactcaacatacctccacaatggcttgttttcattgtcattgggaggaatcacacggcaagcattcaagaggttgcttgcccttgctggaccactagttcctcttgataaatcagtagcagaattaggagccggactaccactaggatggctagatgcactagcactagcacttgagcttccagttcgataatccatgggatctaacaaaaaaaaagatagtacttatactaagaaaagatgaagggcattgcattcttgcagatccactaaaactctaaacgaaataagaagagcattgcagtattgctctgctgcagtgcatagaatgctaaaagaggggatttattattcacctcaacaagggaacgaacaggaaaacagatcggcgacgacagtgttgtgccgacgtcacagtaggaggcggcgaggcgcagcccagtgcgcggcgccggcgcagctcggcggcggcgacggttgacgaggcagcccggcagcagcgacggcactggagcacgtgaggggcgttggtggtgacgctgttgggccagcatcggaggtggagagcagcgtggcggtgccggcgcagcccgtcggcggcaatggctgatggggcggcggcggcgctggagcgttggggaagagaggcgagagtgagagttgagaggcggcgcaggctgggtggatatgctccccacgcgcgcgcgggttttggtaccggcggaatattagggttaaacgtatcgggaccgtatcagaacgtatcggaaacgtattaggaattattttatttattttaaaatcaggataaataccgatacgtcctggacacgtatccgcccgtgtccgatacatgtccgtatccgatcgcgtgtcggacacagacacgcgcctgctttgccgtatcagtgcttcatagtctatctatgccatttgattgcgattcagaaaaccagaaaacactcacatcagcatgcatgtacccatgttcatacaatgtcaggctgaagtcatacttatcctatcttactataaagttattcccactaactaattaagcttaacatataaagataccacatcattatccactaacaagatgtcacataatcatctactaattaataagatgccacatcatcatccgctaacaatcatcacatttaaacattatacaaacttgctatatctttatagtttttataatttaagagagcttttcaaatacaaacatgttaaattatcatccaacataattcacataatgtttcaatatatatctttattatgttttatgatatcctattacttatatagttcatcctcacttagttagtgcttaaatgattaaactatggtccaaattatctttctcgttttttcctctaattaagtcatcatatcaattgtttttatcctttagatgattaatctacggtccaaactatctccctagttttcttcttccataaaatcataccaacttactttttacgtttgaatcaccattctacatactatttaaatttaaattatcataaaccatattaatttacttaatctgatattatatagctatcttacacgttattttttttattattatcatactaaattcccgcagcaatgcgcggggtttaacctatctagtatctttcgtgtacaccatgatttacactgtaataaaatcaccaactcgaattagagaagctgaactgttttgttagtaacacattgcacatgcaggaagaagccaagccacccctcgctgaggagcagcgcgacctccgcgtcagcgacgacggcgaggtagtagtcgccgcctcgccggtaggctcgggggacgacgaatccgacgcgtacgtggcctcggcggtgtcccagtggatgcccacggccgtgtcggcggcggtggcgagggacctgctcccgcgcttcttgtgcagcacatgttgggcgcacctcgacgacggcgagagcgcgtcgtcgaaggcgacggcgaggcaggtggctccggcagcgttccgcgtccacgtgacccggatgaggagctccttcccggagtgcagcgaggcaccgtacaccgccgtggtcgccgcctgtagcttgcgatccagcgcgccgccgcacccagagtcaccggcggcggcagcggcggcggcggcggcgatgcctaccgagctgtcgccgaagcacgacagctcctgcgtcgcctccggctttggtttttcttccggcgagattagctgctgtttgctattgctgctgcaataaaagagagagctgacgtggcacgctgacacgtggggtccacgtgggttccacgatgactcagccgtcacgtaggctaaaaccgaggtcaaaaccaccgagagacctaaagcggacggttttgttagttgagggatgcccagtatctggttttgcggtttgaggacgattttgtatctcgatgacaagttgagagaccttggatgtactttttccgcttgttttagcctagcctagggtttggcatattaagggctgtggtgggcctcgtggatgattaagctgctactataggccttgtttgatgggctatccaccggtgggcttcagcttgttttggctcacgtgcagctcgagctggctcgttatgtctaacgagctaaaatgctggctcggctcgttacgaaatttaaacgagccgaaccaagtttatcacgagccgagcgagctaacgagtcacgagcttcctgtccacccctaatgacataggccaaatcagctgggtctgtggcttttcctccttccctttctccgcctccatagtatttaatatggactgcattgcactcaataggattccataaggtctcttaagttctacgttgcaaggacctttcaaattaatttgaattatttttggattttggctatctgtcagtaatccctttttgatattgtcttatggagattggaattcagtatccacatgtacagtttcaattatgatggtatcagtttgctgtatgcctttcttttcagtgagatttcagttctgtctgtatatgtgaatctgatcttgtgctgcaagaaaataatgcttcgttttgctaatactgcagctgaaggctacacacatgacacatgtgcatatttttgtacgagaaaaatgggcacaattgatacctgataattgcatgcattgatctataaatagcctattagtactggagcaaaataaaaaatgcataacatagaaggctgaagctcttatatgctctcacaagtgtatggtggcaaagaacacatgaattttggaagtgattttagaactcacagataatgttagatcaaagaacactttcatactatatatgagctcacatactgaacaattccacatgcacagcatgtcacatttaacaaaaaaacaataaggatctcgttactgcacaggttcaactaaaacacagctctgtttagctcattggctgttaacaatcagctactgtccacttctctcatcatttacaccatgcgtactcttaactggtttagctcacgcccgtcagaaatcagcagcaggtcacttcttctccttatcaatttacaccattgtatgctcaagttgtaagtcagcataatacgtggcaatgaacatcgcttcaaaaaattcatcaagaagcccagaaaattgttcgttgaccatattcccgaaatctttttcagagaagagtagtttcctgccctctaccaccttcgacatgaaatgctgataagtatttcttaccaatctcagcaaggagagaacatcatctccgtagatgattggtacgcccgtgatgggatctttccagtaaaaggtctcaatgaaataaacgttgtgaagatccatcgggctccaaccagagaatatcttgagacgttcaagcacaaaattgtatcctgctgggtctgttgttggcaatactagcagtttattgtacaatgatgtaaagacatgcatcatttggtgctcttccatcaaacagtagtgatagcatatcagatactgataagcagttggatctctcataatcatacttagccatctgtgaatatcttcaggaactggtaaagattcaaagagttcttcaatagtcttcacatattgataaaagtcaacctctgcattggcctttgtataggggtctaaatcatcagcttgaaactcatccatttcaatggtcatctcgtcacttatcagaaaatttctcaatgagaatcgaccagcgagtgagtttggctgactgtgcaacttgtaaagggacctaacacttcttcgtaacacaagtcgagtgctcattcttgtgatttcatatttccttgtccttccgcatccaggaggaatgatagtatctgttaacctcgttcttcttcttctagtatcaactaaagttgcaagagctgaggactgcagaattcagtaaattaggggtatgaccagattgattccaggacactatctactatcacgcccaaaccaggaactaagttgatgaaaatacactataagaaaaaaaaaatctaaaacagaaaactgagaatggaagatttcatatcaacaagaatatgccacaaagaaattaaaacttagtgaccgcattagtatcttactgaaaacacaagaacgatcataggcgaaaagaacaatatatgcagtagatgcacggatcataggcgaaaagaacaatatatgcagtagatgcacggtgatattattgaggagcaggcagataaaaactacaccctccatcccaaaatataacttttaaccttcaaaatttgtcccaaaataacaacttcacaagcattcctttcccaaccaatgacaaccctacatcattcaatttttccaccttcctccacttctcatccaaccccattaaattatacctactttcttaatgactgtatccaaccgtaaaaatccttatatgctgggacagaggtagtaataa

SEQ ID NO: 25362 - DNA, 2469 bp, Oryza sativa
agatattctgctgaacagctagctgtacaagaacttgtgcgtgcatgtacacagtattatctgatgatctacaccctgaatttcataattcatatacttccatatttcaacattgttgaatgttaaagggaatcaaaccttatgatccttgcgaagcgatgattttgacatgcttgctctaggattttgattggagcagccaggtcgctttctttttctacctgaacgctgtttacaagagaactggttaaaatcatatatctaaccagacttggtagcaatgtcgagaatcaatataacaatcaaacatttcattcaacctaggaaacaaggttgaattgggaattaatgtattctaaaaacaagggaatacatggcactattaaacaagaaacttttgattcgacaattgtttcaactcttcttaaccacactatgacttcaggggcaattataggcagcaacccagcaaaaggctgaatcttttagaccaaacaagtatggtcagtagtttgcatctacgaggcctgacttaagagaaaccatgtccggtgatacaaccccaaatacacatccagacaaaagtttcctataaacagtccgataacactgaaagctgctcatatatctagcttcaggatttcttaccaaaatatcgcactagtcataatatcggcggaaatttcctcatattttcgcagtaaaaaaaaattgtgaatgtacacaaactgacaaacatgtggtccagattctgattttcaacattataaaagattacaaggagtcaagtctggtgatccgcatgaaggtgacaattgtgattacattcttttttatggatttcaattggacaacacgttcaccttcatcttatatccaaaagttactccacaacaaaacgtgttaaaattaattcatattagcagacttaaacccaattgcagggaagtaaaaataaagatcaagcattttactaggaaacaaggaaatatgggatgtatggagtttttcaacaactgattggcaagaacacaaaactggtgcttctgcaatttgtctactcttgccaattatgcttcgggccttcatagccaattccgggtgccaaccagccaaagtttgaatcttttcgaccaaacaatagtgcgtgataagtgattttgcatgtaagtggtcctttatttagtgaaactgagcccagcaaagcaatctctattccttagtacacatctggatgaaacattcaatgaaaatgaaagctcatacagtaggaatgaaatcaccaataaatcccccacatttttactgtcgattaaaatgcatcacattaaacagaaaatcagattaacacgagcaggagcaactaagtctcaacaattccaacagtcccagtgtcaaattccatagaagatagaaagaagacctacaagtagttaggaagtatttcgcaatgcagaaagccaaatttgcccccctaatttgcccagtcgattttgattctattctaagatgtcacaacatttcaaccaagatttcttcactcaagtacagcaaaaatcagccaagactttcacactggtaaatacaaataaagaatgccaagatcctagttccacattctaatacacaagctgattccctaaaaaaaaaacttttttttactgtaaagcaaacagaagaactccccatgttcctaacacaaaagatggcacaagagttaacttatgatttactgtgcacacaagaaatattgctctgaacagctagctgtacaaaagcttgtgaatatatatatatatcatgtgatctatcatcctgacatttcataattcatacacttccattttcaacattattgaaggttaaaagcaatcaaaccttttgatcctcatgaggcggtgattttgaggtgcttgctctagtattttgattggagcggtccagatgcttttgttttctatcgaaaatctgtttacgagagaaccggttaaagccacacatcttaccagacttggcagtaaccgcagagaattgatataaagatttaataattcagactagcaaacaagttagatagggaatacatggtattgtaaaaaaaggggaatatatgcgacttttaaacaacagactagaatgcccagaccagccaagaatgataagtaaacgtctccttacctttctcctgtcatacgcaagaatgctacttgggattgggagtaacttctcctcatgtggatttgaactattaatagaactaggagggagtgggtagatgatgtcatagtgagactctatgcgcagcaaggtcacgcaaggagcgccgcggacaatgtagtgcgtactttcgcaagttccatcatgaacgttctccacttggacggtcaccctgagagcttctgcacaagcttttactgcagcagaggttgcgtacacacgaggagcaattacgtgcttcgagcaccactg

SEQ ID NO: 25363 - DNA, 5451 bp, Oryza sativa
  unsure (1)..(5451): unsure at all n locations
actcaagaatcttccccntgtcatgagatgaaaaaaggcgcatgttcagtcagtgagatgggatagtacatttagaaacaacactcttccggaattgcagaaaaccaaacatttcaaaacctgattattgatattgggtgctcctgcatgcgcttccatccctttattttctctatcagcctctcaaatgcctgcaagaatcaatgatacaataaatcataacataccgctggcatctagcacccagagagtttaaccagcgtgttacaatggcgcttacagaatgatgatcatcaataaaacatgactagcataacttgtcggacaagcttccatagttaaacatcaagtatggagataatcattagaaagaacatttgatgagatagtagtaaggaagacatttgtgatttaggatcaagatggccaaaccatgaagcagcatgtgtgcagcatttcagtcttgaacataagacacctataatatttgttcttccccattatattttatcactattaatgtccaactgcaaaatttcttgcaaggttgaatattgttcaatcaggaagttaacttcacaaatttataattagaattaatgtcaacagggtaaaagactgcgatgtcatgccactattgtgaaacaatggtgtgtatctcctgcaaatgataaaacaaaggaagtaaaatgatggatacagattggtttgtacaatacaaatttagattagaggaatcatccattacaagcatgtttatgtcagaaaaaccaatataggggaaaaagcaaatagggaagacaagagattactttgtgtttctgggaaaattcagaggcccattgaagattttcagctttggtagccaatgctctaacagcagcaagaaggcggtcttcctcacgtgtgcctatactatcaacaacttgctcctgtcatacattgtcaaaactaagagagttataataacattgaacatacatcctatgctagggaatagggaggtggacacttaccaggtaggaaaatatgaaactcctatagaaacattcctcatctctatgtactggcctaaattctgaatagtgatggctgagatactttaaacgcaaaccaacttccggttgctggaaagaattatcaatgttcctgaaataatgatttgcagcttctcccatgggaattttctgcatcccacacacaaatacacaaataagggaactcaactaaaaatggtatatgcataagaaaacaacataactagaataaaatatattttatgttttatatgctccacttttctggtgtttatattctctgaaaaatgcttagaaataattagaattatcacttcgtttttattgattggttgttgtaaagtcataaaagacggaatatatgcacaagatttcctaaattcagtagcaggcctattccagaagccatcacaatccaatcctttaattgcttgcaaaacataaccagatttaacttatgatttagtatgcatacaaaagagatattctgttgtacatgaacaattgaatgtacagtgtcatgtgatctatcatcctgacatttgataaatggtgcacttccgttttcaacattatctaaggttaaaggaatcaaaccttgtgatacacatgagcaggcagttttgatgtgcttgccccgcaattatgaaacgggtagttcactggttctccttttctatctgaaagctgtttacaagagaacaggttagcatcatatattctcaccagacttggcagcaatctcagagaattagtacaaagaataaacactacagactaggaaacaagggaatatatggaacatttaaaaaacaggctagcaagattggaaaactagtgctttgacaattttgtcaactcttttccaatcatgctatgggtattctgagaaaattctaggcagcaacccagcaagacacggaatcttttagaccaaacattagagtatgctcagtgagtttgcatatacaaggcctatgatttggagaaatcatgtccagttatgaatcccaaatacacaccaagacaatttttttcatatatcactgtcctaagactgaaagcacatacatgcagctgcaagatttcttaccaaattatcacattagtaataatatggtgtgacagttcctcatattttcgccgtaaaggaacttgtgaatatacactagatcatgaggtctaggattctgaccctaattttatatgcccattttcaacatcatcacaggttaaaaggagtcgaatctggtgatcctcataaagtgaggataggtacttttttttgtggaattttgattggacaatgcgttcaccttgctttcatgttcaaaagctattccacaacaagatcgattacaggatagtaatatcaggatcaaacatttcacactaagaaacaaggaataggggatacatgaaacttttcaattacagactagaaatgtcacaaaactggtgcttccacaattttcctactattgctgattacacttcgagccttcatagccaattttgggtagcaaccagccaaaggttgaatattttagacccaacggtagagtacaccaagtgatttcgcatgtaagttggtcaattatgtagagaaattgaacacggtaatgcaatgccaattccaaatacacatccggatgaaccattcaatgacaatgaaagctcataaattcagctttaggatttctgagcaaaaaatcacactagacatgacatcacccaataagtcccccacaattttacagtgtgattaaaagtgcatcacgttaaacatcaaattacattagatcaagcaggggcaactaataagtgtcgacaatttcgatagaagatagcaagaagacctaatagtagtcagaaagagtttattcccaatactggcaatacagaaagctgaattgccccccaacatttgcccagttgattcttttttttttctttcttttttttttggtcataaggcctagttgatttcaactctgttataggatgccacatcatttgaacccagagttctccgccccaggtacagtaaaatcaagaaatcaaagattgccaagatcctagctccacattgcaacacaagaatacaagatggcacaagaaccgcatctaaggaacaggatagcacgttcgcaacggtgaaagatgatcccaagatttcacacgaacgacaaaaatgcccagccccagaccaatcaagaatgacaagtaaacttctccttaccttctcctcggcgtcgccatgatacgcacgaatgctactcctgagaagcttcactttgggggaatcagatgtcctctcctccttccttcgtgcctgcaagaacccaagaaatgctcaagaacaaatccaaaatactccaaggtacccaacacaaacgccatgacagcacaaatgcaagatgggaaccattacctgttcccgatcatcagagactgtaaaagatccttctccgatctttctctttcctttgcggtccaccaatgcagcggcggcgctcaaaccgtcgatgccgcggcctccgcctccgggctgctcacgggcccgcccctgggtgaagcgctcggtgggcgagcgaggaggcgagcgcggcggccgcgccggcccagagacaacggcgccgccctgggctgcggtggcgcgggagctggactcctgggagtgggactcgcgtcgcccgcgcccggatcgggattcggtgatattcccggtgatattacattgagtcactgacattccgagaatgtcacggagaatgtcaccgaatcctagtcccccgcgcccatggatcggtttcgtcttttggtgggttcgacgcggacgccatccacgcggacgggaaaaacttgtgggaagggcggaggggctgatttgctagatcccaattatgagagggggcggaccagaaatgtgtggaggttgtttcttttaattcttgaaaggcaagaggcttatctataaaggtgaaagtagttctgattcgtgagatggagtagctgataggggtagggacctggcatttttccagtttaccccttttaattctaaaaaaaagtttgccccttttaggggaatttaactatttatcactattaggtttaggggctgtttggacagtactaaaaattattttttaagtccctgtcacaaaattattttttaagtccctgtcacattatatgtttgaacactaattagaagtaataaatatagactattagcaaaactcattccatgattagcctggactaattcccgagacgaatttattgagcctaattaatccatgattagcctatatgatgctaagtaaatatgtgctaattatgaattaattaggcttaaaaaattatcacgtgaattagctcttatttatataattagttttgtaagtagtctatagttaatattctaaattaaagtccaaacatccgatgtgacatggacttgaagtttagtccctagatccaaacaccaccttagcaaataaccaaatagctctcttagatttggacttacaagagaggtgaattattaactatttgccacttttgatgacgtggcatgctaacatgggaaataaaattctcacccctttctatcttttgttatctccttcgtcctccatcgctgtatcgccatggccgacacgcacgctcatcttcctccttatgcccgcacagtcgattgcactaagctgtccacgtagctacctctagcatgcccaaggctcacgactgcttgcaaaaaggcaagaccacgccctacgccctatgccgcagttgcccccgtcaaacgcggctggcctcctaaggtacgctccatcactcttatcgagctagcctcctctaagagcaagaaggccaagtggacacttcccgaagctctccagtggcgatgacaagcttgttttcaccttgtctccctactttgaggccgagtgcaacaacagccagccaaactaaatcaccagattcaaaaggaacatgtttctttcctttgcttccagcaagtttacacctagtattcatgtgctctatgttctccttagtggtctcatgcagttttaacatcagttcatcacattgttttgcatcaaagttcaccctctctgaagttgggaggggcaaaagatcaataggagcacggggtagaaggccataaataatctcaaaatggcacttcttagtagtagaatgttgcgaacgattataagcaaactcaacatgagacaaacattcttcccacattttaatattctttttcaaaatagctctaagcattgtagataaaattctattcacaaccttagtttgtccatcagtttggggatgacaagtagtagaaaataaaagtttcgtccccaacttagcccacaaggttttccaaaaatga

SEQ ID NO: 25364 - DNA, 1817 bp, Oryza sativa
tggcactccatgcaagcgaacaatctcacgaaagaacaaatcagcaatgaaattttcttttcccttcttatgtttgatgacatatggaaaagattcaataaattcaacccatttagcatgcctacggttaagttttgcttgacttcgaatgtgtttcaaagactcatgatcaaagtgtataacaaattctttgggccataaataatgctgccatgtttccaaaattcgtactagagcaaacaattccttatcataaatagaataattcaaactaggcccactcaatttctcgctgaaatatgctacaggtttgccttcttgtaacaacacaccacccaatccaatctcactagcattacattcaagctcaaaagttttattgaaatcaggaagttggagtaatggtgcgtatgttaacttatctttcaaagtctcgaatgcattcctttgtgctgcagcccaagtgaatatcacattcctcttggtaagctcatgtagtggggctgcaatggtgctaaaatacttcacaaagtggcggtagaacccagcaagtcatagaaagcttctcacttgtgtgatcgttgttggaaccagccaactatgtatggcttcaaccttggcttgatccacttcaatttcctgcggagtcacaacatagccaagaaaagagacttgatctgtgcaaaatatgcacttctcaaggttaccaaataaaggtgcatcacgtagagcataaaaaacaacacgcaaattatcatgatgatcctctattgatctgctatatatgagaatgtcatcaaaatataccatcacaaatctgccaatgaaagcacgtaaaacttcattcattaatctcatgaaagtactgggcgcattagtgagaccaaagggcatgactaaccactcatataagccgaatttagttttaaaagttgttttccattcatctcctaacttcatgcgaatctggtggtaaccactacgcatatcaattttagaaaacacaagtgaaccacccagttcatcaagcatatcacctagcctagggataggatgacgatatctgattgtgatgttgttaattgctctacaatccacacacatgcgccatgagccatgaactaaaagcatggggacaacacaaggactaagagactcacgcgcataccccttgtcgagtaattcttgcacttgatgttgtatctcctttgtttcctttgggttggtcctgtatggcacacagtttggcaaagaggccccaggaatgaggtcaatctggtgctcaatccctcgaattggtggcagccccggtggaacctcctttgggaaaacatcggcgtattcctgcaaaaggttagtgaccggaggaggcaaagaaatagaagtatcctcgagtgaaaataaagtttctttgcaaaccgaagcattgcaaatagaagtgtcaggatcacttcgtccaaatctgactttgttgcaatgaaacaagatcccttcagcttaatctcatttttattattttgaacagagttggtgcatttcttcttatgcttctcaagttcattagccacaatatgatgctcactcctagtatgctcctgaagtttttgcttgctagctctagcaagttcatcctttaaaataactttaggagacataggatgtaacacaagcttttttccattatgcacaaagaagtactgattggaattgccaaagtataaagaatctttatcaaactgccatggcctacctaataacatagaacatgcttgcataggcacaacatcacagttgattgaatcatgataagaaccaat

SEQ ID NO: 25365 - DNA, 5581 bp, Oryza sativa
  unsure (1)..(5581): unsure at all n locations
gcttgggcagtccttgcacatgtgaccaaagcccttgtagtgtaggcactgaatatcgcttgtccttcctgatgatgccactaatgatgaactcttggaaggtgtagcagcaacccctcttgctggttcactcaggcatggtgtagagtttgtcgtggaggaacgtagcttgttgcttgaggacgatggtgctgctgctcgagttgacggtgcaacagcgttggaaggtgtccaagagctagtacgacctgcagaaatgttagtcctgaagctagctcttcgtccctgcacttccctttcagctttacaagcaagatgaaacaaacggttaattgaattatattctttgtaggctagaatgttctaaatttctcgatttagcccacccatgaatctagccatatgttggtatttcttaacgacattactaggcaatggcgcagaaatactcctgttatattatggttacagagttcatccacaagcgcatggatataccattgtagcatttcacctgagagtattccaaggatatcgtatttatttaatccccgtaggaagatcatagtatagagataataatcatagtctaagcaggggttaagataatcaaagggtagagtgacacacaagccacgaactactcattctcatactaaattacctaagctaagtggaaagaaaatacaaagagaatctattcctatacttctagtatacataggatacatacattctagttatctgattaactagctaataccctctatccgatgtcctcctagtacttcaagaagccacccctgactgccgaggtcctgacgacagcccgtcatgaccatacaaccggggctaaatacagaggagtaccctcccctggaaattaacttaggactatatacacgcgtggaggaatacacgtactgagctgtcaccatcagcggtccacctctcatccgcagcatataaccccaaataatgatatcccgtaatctagacaccactcctaaactaccagatactactctaatatcatcgtcatgacatagagcaattgcataagcaaacactatacttgtacctatgcatctcccaaataagctagcagtacaatcagtataacatgaatataaagtaaagttggcattcatatactccgaaaagattttcattaccagaaatgtataaaagaagaagnnngnacgggatgtacaaagcttacaaaaagaggaaaggaaagctactagagccataccccgaaggcttccggactccgatttctactctattcctgctctactagcttaagaacactaaactaactttgagagaatatgagagagctttgcttgaggtgtgtgagtgaagtgagaagaggagctccttttataggcatgtaatgacgattatgacggttggaaaggtcagtaataccctccaactgtcattggggaccaatcccagccatccatcaaaaccctacatccattggtgccacgggaggttcggccgaaccatgggctggaccgacctaacccaaactcggcaggtggcctcctctattgcttctctgcgaagacttgtgaatttttgcccaattcatcgtgtcaattctgagttcttggcccattcatacataagtctgattctcgacatcgttcgattgatttattgtctgatttgatgtcgattctcctccactttatggttattctctgcaaaaggttagtaaacctaatactagtggaatattattattctaacataaatatgcattgcaagtataactatttctcctctattttggtaatatttacggtcgaaactgatcgctaacgaccgtcaacaccataccagcatcatcattttccaccaaaccacaacgaagcattcctgtttgcaaagcttgataatactcttctacatatttgattccatgtctaagttgttgcaatttatgcagcaaatcacatgcatgatatgaaggaacaaatctagctcgcatgactcttttcattgcatcgcaggtttgtggagtgttatttggattggaacgaacaaattcactccaccaaatggatgcaaaatcagtgaacttactagtagcagccctaacacatttattctcaggaaaatcataacaagcaaatttctgatcaatggctaactcccaagtaagatatgcatcagggtcatattttccatcaaagcaaggaatggtaaacttgatcttgcctaaagaatcgtcattatcatgtacctcctgccgtggtggagcgcccattccatggcgctgttggcgctgttgtcgttgtggacgaccaagtacctcctcatcaagctcggtgtcagcagcgtagtccacttcttcccttgctgcgacgctgctattagcttcatggccaatgtggttgcgcctagccggtccatcatgaccatcttggctcattctcttcaacgtattcaagatacctgcaagagaagtgttcacagccacaaggggtgtctccaatgaggaaagcttggagttggtgtcaatttgagtagcctccaattgaccaaggcgatcattggcgaccctaacatcctcatcaaggccttcagcatgctccctcacttggtgctcaaaatgttgtatgatgcccctcgtacgtggtgaatgttgaggatgctcccctgatcctcctgtcatggttaatactccctccattctaaaatataaggcacaaccacccttaacccaaagaccaaaaataattattatcatcttgtagtttgaatcatcctaataaatataatgcatgcatccaataggattagataacatgagagtggaggatttaaaaaataataatttaatggagaagatgtcatagttaattgcatgcttgcatgcatgccttatattatggaacatctaaggaaagtggttgtgccttatattatggaatggagggagtaggaagcaacaattcacaagagatatgtcctatcaactattggagctaggtgttatccatctccatttctaccaaacttgtgcaaacgagttcttacatgttcttactttgctatgtaaaaggcgttggcaactagcaagaacaacaacaatggttagtagtaccagagccgacaacaagcacgatcctgtgatggtagtagataaaaaattgtggagctataggtgactgcaagtaatgtcaaggtacagctagaaccacattaatcaagcaagttgaataatcgctcaatgatggtattgtgttggtcctaggtaaaaccctgttagagagacgaacctactcacaagtgtagccactcaaaattgcaccaaaagaacacaaggaaaataacagcaacaacttcttctctatttttttcttttcttcttctccttgtttttcacttctgattttttttctttcctttttcttcttcctttttttaaactagttcaaagctgaaaatttttcccaatgaatttcgaaattactcaaaacagcaggaacaggaacaacttcttctcttttcattcagccaacatgtcaacacaatggagtaatgatgggctggttggagttacttggttcagccaacaagtcaaaagtgagggcacttaaatgctttctttggaagggctaattcactttacaaagttgcaaaagggttggctattggtggaggtagcaataaatgcatttgggggtggctgatgtagtgatgagggtgctgttggttgtggtggacgaaaatttggtgcggatgaaggtggattcgtggtgaatatggtgatgatggtggcagcgggatgaagatgaaagaggtgatggtggaagtgtttgtggtgacgaaattgtcaacagaacatgaaactctaaaggactaaactaccagaaccagtaactcaaccaatcgatgcaaccgaaaactcagcaagcaaaaactaagtagaacaacaaaggctcaacttgttttggtgattttggatctgacctattttgaggtttttttatgggctgtaggtaaaaacaaaggattgaaaaatctctcaccgagcaacttgagctctgataccacttgatgcagcaacgggggttctcgatctttcgatgagacgaggataaacttcgatttggaggaggacacgacgttggtggtccgactacaactaccacgggggtgctacgccttagcaaccggtgcaccgactccacgttgttgttgttcttgccgtgccaagaacaaccttgaacctacaagcaatcgaagaacaagcaagaacaagttgacaaggaaatagctcacggcgcttgtcaaatgatgaaattgaaacaaacgaaaatggggttctgaatacaagtattcgggtttactagctggtacacgcgagtacaaggacgtagctgaagctaaacttacatctaaacaaaactcaaaatacaaaatggtggctgctaggggtttatataggtggaggaatgactaggagaggaggtgggagcaaaccctagtttttgtggacccctaatgggctgtaaagatacaaggcccaagcccaagtttctgatgtgaaaactattttcgtcattctgagcagcttgggtcgaatctgatggtgagaccacacatagctgaaagtagacgacaagatctttccaacaagtactcatttgccccaattggccatcgaagtgaagagcattgacttcatcaaatcagcgctgctagtgttgtttgtgatctagatcttctcccatattcctaacaacaagtagatcataacaaccacttagtagcacccaattctgagaagaacttatatgagtagctaggaatgactttacctgataattacgttcacaagctcgagctctagtcattggtccttgctgtgcttaggcatggatgtatcgttggaagggatgtcctcatcagttctttttgacatcttcacaatctagcaatataacaagtagcaaactaggaatcacaaacaaaattttcaattcaatatctctgatttcttgaaaacttgaactattaataacaactagacttgacaattgaaattgattttaaatgacaaattagaaattttatatacctcacttcctcaaatcctcaattgctgagttcctgccttgccccttgctgctgccggcagctgccctttgcccccttgcccccttccctgcttgttgccgcgccgcgccgccgcgtcccctcgtcgacccacccccttgttgccgctcggggcccccaggccccagcggccagcggccggcgcgccgcgtgccctaactgctgcagtgtcgccggtcgccgcaacttcgcctggaaggctggaactggaagccgtcggccgtcgcacgcgcactcgcgcttgtatgccgccgccactccgtgagtctccgcctctcttcggtaggaggaaggagattagggttgggtgggattgttggggatattatgggacttctaagcctttagggccttctaaaaatctcagacaaagtctatctcagccccttcttaggattaggtattatgggggctctaatggtttgttagggggtagtgg

SEQ ID NO: 25366 - DNA, 1148 bp, Oryza sativa
cccccctccgcccccacgctgtttccgccactgtctggaggtagtgcttcgacgtgctgcgagggtccagcgcatacagccgccggccgtcgacgggcaccatgatgcccagcatcagcgtcgttgttgggcgagggccagtggccataaacgacgtccctgtgtcgtacatgaagacgggagaatcctcatggaaggcatgcgtggcgatgacgatcttgctgccgaccgcgaccatggccaggaaggagcggtccaccggcacctctatgtggacggcgactggctaagaaaggtggtggaacatggctacgccagtgccggcgccggaatcggtgaactcgtcgatgtccagcttgtggatgacgtatcccatgtcccaatcaagcaccatgtagaggtgtttatcatcgtccctccaccgcgaccttttactggacgtggcgatgttgctgctgtgttgatcccacaacgatcgcttggagctcaacatcgtatcttcctctgcatgccctatattttttagaacatatcaacttgcattgatccggcttttgggagaaagccgaaaggactacaggaacagagtcttacacaaaacgaaaagaaaaacacgaacatactacattattgctgtgaggaaaaagtacgaattatcccccccaaactatcgtggtcatccgaattacccccctgaatcacaaaaccggacattcttcacccctaactatgcaaaccggacgaattacccccctcaacccaatccacggtggttttggtctacgtggcgtacgcgtggcagtccagtcagcaatttatttatttaaaaaatatgggacccacttgtcatactcctatttcactttttttctctctcttccctctctctcactcttcctctctctctcttctctcactctgtctcacgcgcacagcggcaggcggggggcggcgagcggcggcggcggcgggagctcgcgctgctcgagcgaggctaggcggcgacggcggaggaggcgagcggcgggaaggacggaggcgagcgttgggggatgaggcggcaagcggcggcgagggagagggagctcgcgctgctcgagcgaagcgaggcggcggcgggcatcgtccagcgcgcgctccgtcgccgc

SEQ ID NO: 25367 - DNA, 5322 bp, Oryza sativa
tcacctcttaaaaaagatcctcctcctcccctcctgctgccgcggccacggcgccgccgtcggatgccgcgacgacgacgacggcggggccgatgaagagctgcagcttcgtcgtcgtcatcgtcgtcgcgtgttgctcgtgggaggaggagccggtggtcgtggagttggacgagaacgcggtggccaacgacgccgtggtggacgccgggaggagctgcagctcaggcggcagcggcggatgatgatgatgatgccgcagcgccgcgggacggatgaccggcagcgtcgtcaccacgggcacgacctcgccgcgcacccgtccagagttacacgcatcctggtgctctatgaagctctccaccctgcaaccacacgcacacaaccacccccaaaccaaaccaccgccattagcgcacactaaccataccacttaacctccatctcatcaccaaacacaacaaaaatacggcaatcgatccgatcgactgatcgatcatctgtacatgtagatcgatcgaaagcaacgcatcgatcgaacacgacacacactgaccgatcacctcgtcccctctccgccgcctcgcctcctccgctgccgcctcgcctcgctcgagcagtgcgagctcccaccgccgccttgcctcgccgccgccgctgcaccccgccgcagctcgccgcctcatccctcgctggcgctcgccgccccccgcctgccgctgtgtacatgagacggagagggagaggagagagagagaggaagagtgagagagagaagagagagaaaggggaaaagtgcaataagagtacgacagatggggcccaactattttttaataaataaattgctgactggattgccacgcgtacgccacgtagaccaaaaccaccgctgattgggtcgaggagggtaattcatccagtttgcatagttgggggtgaagaatgtccggttttgtggttaggggggtaattcggactaccgcgatagttgggagggggggtaattcgtacttttctcttgctaggaacatccagctttctagacacagcacactacaggaacatcatccaaatagaacccttctggagttggaccaaactagatacaagcaaaacaacttagatagacgatggtagatgttgtggtttcagttgaaccaacttccctagcacagcttcatgccacccacccaagattgctctttcttcctctcttaacagcacactccacttctgagagaaagacagagctttgtaagccacctgcaagtgtgatttcaccaagatattgttaaaaacccaatcattcctagttagccaaatagcccaacagaagctagccatcatcagcaactaaaccctagattccttgtcacacctcactagcccaaaacaatcccacaaagatcctggtaaggaattcaagtttatagccaccttaagcacacaccaggaaaaaacagctaaagagcaacgaaagatagcatggttagtatttttagtttgtaaacagagtttacagaactcatttcctccttccaattccttttcaccaattgctcagcacaggggagtctccctctcccaactagatacaaaaaaatgttttatatttagaggaattctacctttccaaactgcccccatttaataccccaaaagttaaaattttgtacattgattttgtggtgaacacctctttttcagtatgaggccaacagacattgtctttatcagtccccatctgagcttccccaattaactctacaagttccccaacctctaaatttcttctaaactccaagctccattctccttgtaccaccatatccttgacagtagcattttgatcatgaataatttcaaagagatcaggaaatctaactttcaaaggtacattataacaccaaacatcattccaaaaactcacatctcttccattgtgcacttcctttgtgactagcctggaaagccactctttgcatttcaacaaacccatccaaaatttgagagccaccactcccattccttgtgaaaaaattacaatttctctaatatttccttctcagtacctccaagcaaacatcaggtgctccactttccaattttcataacccatttactgagtaagtaaagattcattgctctagtatccaaaaagcccattgccccaaactctttgggcctgcacagagtatcccatcttatcatatgatatttatttttttccccaaccccgccagtaaaagttccccctaattgtgtccattttttggtgaaacccctcaagcaaaaggtagaaacccatagcatacatgggtgcactagacaaacatgagttaatcttgatctccctgccaccataagtcatgtaaccactcttccaagactaaagtctcttctcaactttctgaaagattggagatatgtctctcatcccaattctgtcaaccctgtcacgcccggaaaaataccttttccagaacgctagtgtattaatccccgtcccaggaaaagccggggtacaccacacaaacatgatataaaagacacatcattattatatcgataatatttacattattacaaaggcacttcaggcctgacaaaaaaaataaacagcagcggactagcgggcctacggctccatattcataggcgctcaactggggaataagccaggactccacctaatacttcttctccaaagctccacttactgaggggggggaggtagagcaagaatgagcacaaccacagtactcagcaagccacactggcagatgcatgattaatgcaagggggtacaaggggaaatagtataggggttaagctttgcagaaaacagcatttaaaagtcacttagttgcccaaagctattttgtaaacacgatcctagagctacacaatattattaatcaaggccgtggacccacacgaacctgccttaacccaaggcctacgataattcagaccgaactggcaacccgacctgagtcccagctcgtcccaagccaacccaggccaacctttccatattttagttgttaagcaaattttaagaattaaaccactaacttgggtacattgctaggcttgcccatatccgagggcacggctattcgaatagattttactctgatcagaggtgtacatctttacccacaagacacatctttactccgcattccatggccttggaacccgtcgtaaacatgtgacataacccttcacccatcctagctgtgaacaaaagtaccgacccaaccctgcctacggccgttatcccggacagacaggccaggattgagcccctagcaacaggatctagaccgggtgcgccacacacataggggtgagaccacccgcgtactagtccagtgccatggcatctcgactaacgggcaacgacccgtgtagccttcatttgcctagacatctcgattaccaagccgtagctcgcgtagccttcatttgcctcagagatatccatcgtcgtaacgacttcatctatctctatttgtgtccttttgttcaggactagactgagcaccgagttaagccttacccattagacatgtggttagtacggtagtgctttgcaacagaggcccgaagaccggtccttatggtggtcgaggtgctcctagcaaaaccatgcacctcgagcccagcctaaaaccatttgggagtttgaatagagggggaggtgtgtgttcaattccatcacaagccaaccattccataatgtccaaatgatatgagaactcccaaagtctaaagttataaaaccatctagtgtggcctaattaatcagcgaagcatctacctaaattcatactagtggaaccattaatacagtacccactagttggggttttgttttttctagggtaagcgaggtgataataaacaatagtaatgataaagctataacaaggattaataggtattgctaaataaaacagtgataacgcgggaatttaaataaagcaataatgcaataatttaaatcaaaataattttataaactgggattcaatatgctcaaggatgatgcgacttgccttgctcagagagaatggccttccgaaccttcagcgacgaccgcgaaccatgcttcgggaacctttgaaacaacagaagctacgcgaagcacacaagcaaagctacaagcctataaagaagcaataacaatacataaaaggaaagcacagggttctttaggttataacaaacattaagagacttgaacaggtcgattcggggttcgtatgaccaagacatggtcatccgaagtttaatgttgttatatggagatttgcggattattataattaggctttgcaactataaaacatgtgtaagcgctagcctagaaaagataggaaggctgcgccgttgacatgtggaccccacatgtcaacctaaaggaccatggtggaccgggtacatagagacggttcacgggtcgacggaagcggaccccatgtgtcaaccgaggcgagtggccgacaaacggactccactagacaccacgcgggctgcacacgtggaaaccacgcggctaccgagcgggcacactaacacgaacactacacggtcaccacccgcgcacgcgaacaactgccgacaccgatgcacgggtaccggggccgacaaccgcacaacgggcacggtggcaacaccgaaaggacaagggcggacagcgaaggagggatccttaccaccatgcgacgtggcatgggaacgacgacgacgaacgggcgcggcggagacggctcggggacgatggaggagaacggcgagggaacgacttcggcggcgatccttggatgaagacgagacacgaccggcatagggcttgacgacgcggagccgaggacgaggatgacaacggggctgcagcagctcacttgacggaacgcggacggcggacgagaacgacttgacggaggacgaacgccacgacgagcgcgaccgggaacgacgagaggacgacgacgaagaccggcggggttcggatggagaggaggcgaggccgaggacgaccttcccactgcgatgccgaaggtggagatggcgacgtcggctggcgcactggcacggtggaaggggctaccaaagtgggtgccgacgtgaccgaaggaggggcagcgtggacgacggcattccggcgaatccgagggcaagccggggtggaggtcgatgcggcgacgtcgtgaaagcgggaggagacggcgacgtcagctggcgctctggcgacgaacagcagccggccggagacggtgtagtggcggcaatgccactggacgccgg

SEQ ID NO: 25368 - DNA, 1124 bp, Oryza sativa
ccgtgaatatcaattttgcaggttaccaaggatgggtgcccagtcatcttccatgataacttcatctttactaaagaagatgtaagttacttttcttttactgtatgaattacagtagctaccttaaaaattcagacaaaaaagtaacatcattgaaactgtcatataggcatggaccatttcgtgaatcatgtgatatatggtaaagaaaaaactaacctgtatccataatggcatccattttcagggtaaaattttaaataagcgtgtcacagaccttcagttggaagacttcctgctatatggcccacaaaatgagcagggaaaggtatgctagaaactatttttctcatttgaacttttggggataactagaattgattttaactttggaggataactagaattgatctgatcacatattggttggttctgaattcagggtggaaaacccttgctacggaaactgaaagatggtcggatagtgaattggaatgtgcagtcagatgaccctctttgcacacttcaagaagctttcgagaaggtcaatcctagattgggcttcaatattgagctcaaatttgatgacaatcttgaataccaggaggaagagctcacttgtatcctccaggccatcctgaaggtatgtgttagcatagtgttatggctattcagaaaatttgcagattgatacctatggccaatctaacaacatctcaccttttatctgtactacctgatcaggttgtttttgagtatgccaaggatcggcctattattttctctagcttccagcctgacgctgcacaggttatgcgaaaattgcaaagcacataccctgtaagtacactagtatctgatgcattgcaaatttgcaagttccataacagtacttttcgtaccatgaacagttactgatctcctcatcccttgcatcttcttcaatcaggtttactttttgactaatggaggcacagaaatctacgctgacgttaggaggaactcattggaagaggccatcaagctatgcctcgccagcggcatgcaaggaatcgtgtcgaagcacgaagaattttcaggcaccccgctgctgtaccaaagatcaaagaggctaacctctccct

SEQ ID NO: 25369 - DNA, 2464 bp, Oryza sativa
ttttcctgcatagcttcaaagttgcaatgctcatcaagttctgattttcgggctacgattattactgatgaagtgatgaggccccacgccgcagaactgtctgtcctgaaaaactgaaaatcggaaggaagatagctgggccgggccgccatctgctgtccagcccatctgtgcatatgcacgtgctcttcaaggcagattggcaacatcagattgatcactgtcagtgtcaatggctgggcatacaacacacgacatgtttaagcagttcggtccactgacaaataaacctgttcaggaggcagacagaaaatgaaaaagttaaaaaaaaacggcatatagttctccaagcgaattctcataaattcacttatccattatcctcaaaagataaaatatattactctacaaattcacgccgttaaactacatctatataacaaatataaaatatccaaaacactcttgaaatactgtatcttttaaattatttcaaaattatatattcaatttctaatccccttgtattcctttaattaaataaattattattaaataaactattgatgtctatggttctaaatacgtcacaacacatgatgccgacatataataattaatattatgataatattttaaataatttcacatcgtatttttgggtgtcaaatattacttgacgaatgtacaacgctacggaagcagacaaaaacctctatcgtttccattttcattttattttagaattggaaccggaactgaaaacaaagagaataggaatagggatgaaaatggttcggaaacggacagaaaccacctttatcgtttccgtttctatatttttttcggaatcgggaacccatgatacaaaaacgaaatcaaatattatcgaatacgaaaatggagcgaatacaataacggatatttatcaaaatatagaaagcacttaaaactgaacttctcaaatcaactaagagatgtagctcaatattttttttctaaaaaaataaagctattattctacattttatcaattaataataacacaactagttttacactttactttcttggagaaaaaaaaactatatccatctataactataattataagtagtatggtctaataaaaatagcaattacgcaaaaaaaaaatctaaagttcttgactacaaaatatctctatttaattaagcacctcaatacatagtataaatctaaccatttagagtagagaaggctgaagctaattagttgtatatgagaaatactatgttaactgaattcatttccggaaagtttccgatggatagtagccttattatatttgtttccgtttccgaaagtttccgaaaaaattctgaccgacatttttcattcctgaaaacatgtccggaattgggaaactttccaaaccattttcatccctaaatacgaactggcgcgaatacggcaacgaaatttatgggaagaaaaaacccctcaaacttagcttcgaactttgtcaagtccaattactgtctcaggtctcaacggtcaacagtatatcacaaaacacaatcaattaggatgctaacttgaatttgactggagtattattatggtatatggactatggtatgggcctttgtaacttcgaaaattctgagaaattgtttgcaaacctattctgagttccgacggaaactgcctttatcatatttgttttcgtttccgaaaaaatttcgaccgacagtttgtgtttccgaacataggttaggaatccaaaaagttttcatccctagatgtatgtcatacacctagtgatgtgactataagtatactccacagattagttactgtaaataagtttagtaaattaacagcattctctactaaaggtgtctcacgtgattatgaatggtaggtgttgaaaacaaaatataagcaataatatggtgctatggagattatcgtggtagtttttttttcttttaaaaaaatcactttgtctaggtttcatataaattctcattggtttgggacaaaatttgactctttatgtcaccgagggtgtataagtaatataagtctatatttaattagataaaatagtcatattagctatatttttaacagaaactatctttcattaatatatcataaaaattatctatagcatacaggaaaaaatattacttaaaatttagaaaatccaaaaataaggtatggtaaatattgcataggaaagaatgagacgtagtacaaatagatacgaacaaactctactatcgtgacaatttttgtgttttaagtaatatgcccaaaccaattatttacaaaaacatgtttaacatagagtcaaagaatatttcgaaaatattatcaacataatcatttgtagtaaaaattaaacaaggttcctgtgcatatgcgtgggctaccctcctagttatagtaaaaagcgtaaaatttagaagattga

SEQ ID NO: 25370 - DNA, 9540 bp, Oryza sativa
  unsure (1)..(9540): unsure at all n locations
ctgcagcccttatttgttgcatggtgattggtgaagagattctagtgttataacttgtttttttaaatgctctatggtaaggatcggctaatatatagccttttacacatcaagaagattaaattttagaaaattataactagttttgtcaaagctattatttttctacaagtctagctcgtcatttacaaagctgcaacaataatacacgatattataatcaggggcggagctagagcgaaacagagcgtagtgccacttgtttaatttactttactttagatcaagtttaagctgatacgggtgtctaagtttgtattgagggggtgcatacatggtgaaaatagatgaggtatagctaaaaaattttcttgaccgagttcctgggcaccccctaacatatactagctccgctcctgattataataaaattgtaactttgtctccctcagaaatttggatccacctgtcacacatatatacttccaatactctcattgtttctacttagccccacctgtcaaatatgcatatagggacactatggtaaggctatagtataagtgatagttaaattaaataattacacttttctcaagtaaacaacaaagtcaaatcatatgattatgcttgaaacgtgaacggagagggacttagctcatatacagtactgctgctgccgtagaaggcctccaccttttgctctatataaatcatttgtcgctaaaatttaaattttgaaaattttcatcgaagttttttttaaatcgctgctaaatttgacatttatatcactaaaaccatctatataaaaaattactcataaattatttttttaataagccatacgatatattattagcttaattatggccaaatgatgtgagccgtagtcgcaatcatatgagccacggtactgcagaacagaagatctcattctaacaaagaggtttatcagcatcgtcctcgacgcgggacacaacgtgccaaaagcattgcctattggcttcctttcttaagagcacccgaaaaaaactcatctgctcgggcgtttgatagtcggtccatttttatccgtctctttttacatccaaaacgtcacatcaacactattactaatattcatgtccaactttaacaaagcttttagcacttttttctcctaaactatttattcaatatacgatccgatcataccattgtatttgttgcaattgaatatttataacaagatctcatatgattatatttcgataaaaatatttgttttccaattttttgttgcagtagattttttaaatgttgcagtaagtatattacgatgtttcactacatcatttgtaatgttgcatgtggtgttctttgggtgttccagaaagtattttgtgatgtttcagaaggtatttcactagctctataaaaaaattagaatattgcatgtggtgttctttgtatatttcaacagatattttatgatgtttcattaagttattaaaatgttgcaagtggtgttatttggatgtttcactaaatcatttataacgttgcacgtgttgttctcgatgtttcagcatgtattctgtaatgtttcaacaactacaacttaatgtttcatatataatataaaaatatttcaattagtaatataattatgttatttttgttcatcctaataatgtgagatctctttgttaagatttaattgcaacaaatccaacggtgcaattggatcacacatcaaataagtattttgtgaaaaaaatgatttaaaatttgctattaagggaatatgacgagagagaaaggggtgccnnnnnnnnnnnnnnnnnnnnnacgtggaagagataaatagttccatgcctgtgaaggttcccggagagaaatagttacatacatgcttactgacggcgcctgtttttttttaataaaaaacaaatgcttgatatgtagtcttgtcaagggtgagaggctaaatggtaagaaagaaaagaaggaaggaaacaatcacaaaaagggagaaaagaaaaagaaaagacaaaagcaataaaattcgcaaaaagccaccacctccaccttgtttgagcagatcaacacaccacatgcgagtacgtgacgatgtcccctctcccctccttcacctccggtgaatggcgtcccgtatcgccgcccgccacctcctccgccgccctgcgacggtaatccggcatccctcccccctcttcttacgcatgacgcgtaaaatgtatatgggggatttaatgcgatggggcctgactcgttatgagtctcgttgttggggttgattttggggctggatttaatttgttgtcccgatggtggtttggtgctctttccatcgcctctccgttcatttttcttctgtgttattaggatggtaagaatgcgattttttctagttggttgttgttgatcaggacggtagaggatgcttaaactgtgaaattcgaggagattgcaaattttattttttgtttgctcgatcatgcggtttggtctgattgtgtcgttgccatgctgtagaaaaaaaaactggagagagcatggtagcttctggagtcgattcagaattttttcacgcggacagttagcgatagcaaaagcacaggaacttttgtgtgcaatcatgttgaggtgatatgctggctcccttgatcattgattacctgttgatttttttaaaataaattaaggaatatagatttattccggccaccgcataagaaatggattgcctgttgatgattgcctcaactgcatgatcattacatattaatttaaacattttgtgaattagaatgtgattctagtaaatcttcacgcgagtttaatcttcctactcgatgaacagggacaatgggaacaagtcttggtgtgtgtcactgtgtctgttgaacatcttcatattagtttgtcatttggtttcagtcgcgctagctaccaccgcatcaccaaatatgagctaattagatccatgtcatcgtaaatatgccatattgaaaaaaataccactactatttataaaatcggatagataccactgcaatcttctaaaattagaaccataccactccattacaattcccgtcgtctctgtcacattttctgttagatcgagcagcagctggctgtctcccggccctccggcgccgtccgccgcggccaacggagcggcagttcacgtgggcgcagagctaggcgtcgatgcaggggacgtggaacgcgaggccgcactcggggagtaggcggaggagctcgccgtcgcggaactcgccgaggcagacggggcagtcggtggcaccgagcatgccggcgccgtacgtcgcggtaccgcgtgagggcaatggattcgatcgcggcctcatcgagctgctgctgctggtgctggtgcctacggtggatgaagcagtagattttttgaacgatgatgaagcagtagatggacgtgttcggggtgcggcgacacgacggcgccgcccttgccgttgctggccgtcgtaagcagctgcatcgtcgccgcctctactgcgccccgccgcggcggccgccggcgtccaccgtgcgcatcatccaccgcccaggaagcccttcgcccagcgccggaggcaccatcccccggacgcgcgtgagcagctcgaccaccggagtcgaagccgatgaggcgcacgcgacaaaacggagaagatgatggggagctggcgcgacggccggcacgggcggaggacaggccggcggcagtcgtggctgggcctggcggggttcgcggtggaacggagtcgtcggacgcgcgcgcggaagcgaggggggagggcggcagacgcggacgcctccgtgccggcgacgacgaggagcaggagaaggcgccggcgccgcccgtcgccgtcgccgagctatgccgccgaggaagtgcccgccgcctccggccaaggcgccggaagccccaccgtcaccaagttccctcaccgccgagctccttcgccgccgccgagctccctcgtcgtcatcgtgcttgtcttaggagagatcgatctcgatctcttcggccaggccgttcgtcatcgtcgtcgtcaagcagcacagcagccgccgatcttgggccatcttcctcgccatcaggtcatgtccctggtcccggtcttgagctcctcgtcgccggcgtccccgacatctgctccggccccgccgtcctcaccggctgggccaccaccgccagggctcgactccgacgcgaccgtgtgggctcgcctccgccggcacggcgcccgccacccgcctggacacctgctcgggctgctcctccgccgctgccatcacctccagtttgctccttgttacggttgcgtggtctcggagatggcacaggagtacaggacggcaacgatagaaataacgggggatgaccggaaaaatggatggaaaatacgacggattggcacggttctaattttcctaaattctagtggcatctagccgatatcgcgaatagtagtgatatttttttaatttgacatatttgtattggcatggatccaattaacccatcaaatattgttcttcaaacctgagttttccacttgtaagtagtatagcatactaccttgattatttttcactagcatattacctgtacattgcaatgggattttaattatttaaaattatcattaaaatattattagcatatcttaattgttattgttaatcacatgttgaccttttctttatcatactaatattttttcttccaaaaaagtagagtgatggtgggagtagttaacatgtcggccctttagccccatatgtttttttccttaaaagaaaaattaagagttggtagtaggagtgatggctcttttataagtaagaatagataataggcttaaatggttcgaactgaaaaatcagccaaccagccagcccatacgtagagagagaaacaacccaatctaatctaatcctaatctaatccccatccgggcaggcatccacggatgtttggttgatgcctaaccttgctataactaagtataggctagttaaggcatggtggcacaagtgtggcttagaaatagttggccataagtgtagcatgcttagctcaaaatttgagagtatgacatgtgggtcccaaggctaagaaattgtggcatggcataattgcggtagcgaaagaaacacatacctaagatattgtggcataactaaagtgtggcgtgccaatgtgtggcaaccaaccaaacacgcttgctgctcgctgacgcgctttccattggcgctttgctcacgccccctgcgctgcacagtggtgcctccacccaccttcgtctattactcatggcatgctagcgcgcggcacaatagatgtggtccaggtggtctttccctttctcgtttttgcggtaaggagagttccttttccttttctaaataaggattatatttttgggcctttgagcacttgagctagcgtgtagcactcataaatcttgggggctttggatttggatgttagatgtattttctttcttttttttggggggggggggtggggggcggttcagttaactcagaaatcgtggtgtcgtgcggcaacctcatcagcgcttgctcgatggatgacagacgaggaaaaggattggaggtggacatcaggggaacgaagtagactcctgtttgggccttcaacatgtgctatacgaaacacaagctgggaaggcgttttgttgacgaatgaaatcataattgtgacaaacagaaaattacaaattttttaagtaggttagattagattttatgggggaaattttggttttgccattgaattctctaattgacaatttaacatgcaaacccagtaccccctggcagtgagatattcattgtgctgaaataaggtgaggggctaaggccggcactactgggtagcagatataagttacttgtttacccattatccttttgttcccacaagcatatacggtttatgttccttcatttacttttgcttatacttggtttgtctttctaacggatctggttcacttgcagacattatgcttcttacggagttataaacatgtcagacatttcagcactaagctacttgaaggttagaaactcaacatttgttagtttggaatcctgacaacctcttagtttgttcaaacctttattttaggtgttcatggatgctcactgccaacttggtaatgatcagagcgagcaaacttcattgtcattgtgtgcctgtgctgtaaaagttgattatttggcacatccttgctctctatggtttggaattgtcactacactttactaaattcatagttcttaacaaaaatgtggcatgtaattcatatgtagcggacgatatttcctttcaaatgcttctccttatcaaccttggactagatcatttgcttcaaagaatggtaaggtacagaaaccctatagatgatataatgtttacaaatttctaccagttaaatgcttaatcaatttttttcttcctttaaggtgacttggttgatgctgttgttcccttcatgggtgaatccataaccgatggaacccttgccaccttcttaaagagtacgcatctatctatatgcaatttgagtggtcaaacttctttgtattcacatgctatctgatacagaacctggtgatagagttgaagctgatgaacccatagctcagatcgaaactgataaggtgattctgtgcactgtttattcttgttttcaacttctaagctattgttgctatcttttgcaaaattgttttcagaaaatgaaatacccttttatttcaggttacgatggatgttgctagtccagaagctgggataattgaaaaggtaacaaagagccttcccctgatttgttatttccatatttgctaaatatgattctttagtagattacttttctaaccacatcaatgcattacagttcgttgcgagtgaaggtggcattgttactccaggtgtcaaagttgctatcatatctaagtctgctgctcaaagcaagacacatacacaatcatctgaagatacctcccagaagcatagcacaaaaccaccttctacaaaggaaaacaaggttgaggctaaaccaccaaaagtagagtccagcacaacacacgaatcaaaactaacttcctcttcagaaccacaactccctcctaaggaaagagagagacgggtaaggccatatccatcacttagttacagtacatcatgataagatatactatgttacttcatattcttgactcttgcggttgcatacattttgtcaccatcaaaatgcaggtgccaatgccaaggcttaggaagcgtatcgcaaatcgtttgaaggattctcagaacacttttgcaatgctaattacattcaatgaagttgacatgtaagtgcatcattagttggattgcttatttcttgtacgtctgcttggttaatgtaatgcataagctgctggcttttggccaatttaagataacgggaataagctattcatcctagcgcgcaataatactccaatagctatagtattggttcttgttcatgccaataagttaacgtgattattgtgtaaatgaaacatcagactactatgtttagttgaggactagcatcaatgcacctcatatatttatgtgctagaagaaacggattatcaatggagtttgaatctatatggctatttcctgcatatgttacatcacctttttatttactataactttcagtgtatacaaggataaatttgctttgtgacattcatcttgttgctttcacttttctatatctgtttcaacatcatatgtactgtgatgtaggactaacctaatgaagctactttccgattataaagatcagtttgttgagaagcatggtgtcaaattgggcttaatgtcttgctttgtgaaggtaatgtttacccctttttttcttcttcttaatataatgatacacatctctctcgcgtgttcgagaaaaaaaaaacgcaatcttatgagatacttaaaccataattgtggcaattgtgtgggttgtactaaaaacccacttgcttttgcaggctgctgtttctgcgcttcaaaaccaaccaattgttaatgctgtcattgatggtgatgacatcatctacagggagtacattgacatcagtgttgctgttggaacttccaaggtatcgccacctgtttttctttatgttgactgccctaactattattttatgcaatctgttgtaatgatgtgacatgtcatttgttttagggtcttgtggtgcttgttatccacgatatagatgcaatgaattttgctgacatagagaagggtataaacaaccttgcaaagaaggcaactgagggggcacagtccatcaacaatatggcaggagggacctttaccatctcaaatggtggtgtttatggaagccttatcagtacacctatcattaattctccacaggtgctcacttgtttttttttgctgccttgtaattttgtttgtaagttccctctaacacgagctttatctaatgtagtcatcaatcctcggaatgcattccattgttcaacgtcttgtggttgtgaatggcagtgtccttgcaaggccaatgatgtaccttgcactaatgtatgaccataggctgatcgatggtagggaagctgttctcttcttgcgccgtatcaaggatgtggttgaagatccacgaaggttgctccttgacatatagttccatgcatcatagatggcctacaaatttcactcgtttcaaaataattgcatgaaaaagttgactcatgtcatgcttgcttatccccaaaaaaaatagatggttgcaggcctttagacttgtacaagagggcatttctttctttctttcttttgttgaggtattacattttaggaagatgttctctaatgttttaattttactagagagaaagacgattactatttaggtcaaatagaagctttggagccacattctactgaacttttggcacacaattgtgaaaatgaaatggcaaccaaacatgcttttatactccttgaagtttgcctaactagcttgtataggcggaattggtctccacaggatgtgcgggttggcacaataatattaaatatctgttaacttgtgattctcattggtttctacgatagccacaacaagttgaaagaggccacaacaagtttgtatacaataacatcatctgcatttccttcgttacatgtttccactaaaaccaatagcacaaatttctccgtattttgttctgcgttgccgtcattttttgtgtttggtgtattttagtagttggatatcaggtattgtaaagtttatgagttctatgggttaaacctcactgatgcaatgttgcatagtgctaatttccaattccatgtggcgtgccatatgattgtgaacaatcagacaatttcccctagcaaaaccattaaaaacctcaccctccatgtacttcaacaaaatgtgcaaaacaac

SEQ ID NO: 25371 - DNA, 7276 bp, Oryza sativa
  unsure (1)..(7276): unsure at all n locations
cctgcagccctgcagcagacgcaaccaccccttggtgacctggactgagactcgggactaactcatggtgtaaagctatacatatttttcgatttcccacacgatattccatcttcatttatctagcaagttgtcgatatcagttgttccaatgagatgcttcttgatcttaccaaggctgcagaagtgcttctcccttgtgttaataggtacaacctcttgaacaaattcgcacttcataccagctgaaacctgtacatttaatttatgttagatgtgtcgggaagaatcaaaagtctataaatggatacgcagcagatatttcactaattacatcaaacagtgcatctccgagctttatcttcattttaccactattgcacacaagtatcttccccatgaggccacttggaagctcatacagtctacaaccttggattgactcatgcctcctcttttgatcactccaatctaatgctgtagtagttgaattttaaattgcatgtctgtggagtgatatatttcatattaatttatcttactaatttttaaatatttttttaactatttaggtgacatgcatgaaacaaggggatatcctcccctcgagggatgaaaacaatttccccatctctccccctttccggcggctccatcgactacccaagagggacggggaggctacccgtacgtatcgatctggcagggcaccgctgctacccctcgtccccgcggtgtggcctcaccctccgcatctatggccagtgcggtggtgctcggtaaagtggagcagtgcacgtacgcatcggttgcggcggtcatgttgctcctcttcttcatgtcgtcggtggaagccaggggtgacaccaacgacatgtacaagctgtgcgcggacatggcgatgcagcgtggggatgaggaagagtgggccgccggtgaggatattggccatgatgctgccgagcaaccacctatcaacgaggaagtcatactcccgtgaccccaggatgagctctagcacgcggtacgatagcgtgacctttggtgatgtgtatagcggtgctccggccttggtgacgagctacgtgccgaagtcgctgatcttgaggtcgtcgtgggggctgacggcgatgttgtccggcttgaggttccgttgcatgatccctgctatgtgcattgctgtggcaccgtcgaggagctgccacatcagttgtcgcaccgctcctcctgcacgacacgcacaaggcttgacctgttgatgtactccgtcacgacatagcaacacgggcaagctctgccatcgccacccctcttcatctctctgtgtgtcgtgggatgctcaacaaggtacgggtggccctggcacgcctcgaggcaccgtggctcgcgaaagcactccacctcaccgtagttgatccctctatggaggcacttcacggcgggtttccctagtcctcgggtcctgcaccctatgcaccacaccctcgacttcctcccgatcttgtcgaggcacttgtagtgcttcatggtgggtggccacaatgacgggtgtcaaggggggaggggggtcccttggacagcggggagtggagacccctccccgagagtgaagagtcgaccagggggttagtaggcgagcggtgcgaggtatctactatcacagcggtttcacggggctcggccgccccgcgagaaggaggcaggaggttatacaggtttaggctacccaaaggtgtaataccctactcttgtgttggtgttttttgttttctctagatcagctaaatacaagagaggccttttcaggctacaaagcgaaataactgacatagcagaaagcaacccttcatctgtatctattacccttccttttatattccaaggaggggctcacattattacaaatctactcttagtcttgtctcatcagccgtcttgtcgttgccagctggttcccttatgcaaccctcaagaaacccatcaagtcttacggttcatattaccccgggctcccaggcttcgtttgagacagttgggctccgccagtgtgctcaccacgtggtgcgtggtgggcccgacgaggcccgacctgcccgaaacagtgccacatttgcttctctgcccatttggctaaatcaagtggtgcggggcatgtgcggcgtgtgtcccaggcgccaccgtccaaagtgactcaacgctggcgtcttgtccacgtcctttcaacttagactggccagggatccccctataatcctgtttcatttatggcggggcgtgctgccttacaactaattgtggagcacgcccaacttcccagaagtttctgaggtcgcgtcctattgcgcttaaagaaggtttattattccttgatgagtttctcgaaggcgtcgttgacgaaagaatatcttgagattgtgtgtcttgtaccttctgtcgcccctctgagtagaggggcgcgagctatacaaggtccaaggtgagccctgggcccgaggcaaggccgggcccgaagcacaccttggatcacgcctttatgcttggcaagcctcgtcacccttcttccttgagcaacgtgtgacttgtaggggctaaggcgagctcagggcccagagctaggccgagcccgaggcagatcttatctcatcctcttaagatatagatcttgcatgtttttacgccctcttgccgaggattgtagaatctgcaagggctagggtgagcccggggtatggaacagggccgggcccgagacagaccataggctatatttttaaggcatatttggggtatgcttggggcccgagccaggccgaaagctacttctatactcggagttttggaccatatacgcagtatccctcctcagccagagaaaatcccatatataaaatcttaggtgggcccaaagccctccggaagggccccctagctacaacaccctagggttaccttttatttttaaatatagtgctatttatttgagaatgatccttttgccgtataaatgggtacgtgggttcccatttcaccgacaacggggtcctagacgggaggcggcttgtggtttgtggagttgtgcggtctcttataggggaatcgaggagttttggttacatcatgcggctgagacgcaaagtgtgaagcgagtgctgccgtagatgccaagtggtggtcttggatgatgccaccgaaggcccaggtgacaccatagaggctgacgccaccacattcctcactgacgatggcggcgtcttggtgtttgtgcctgataaccatggtcaccgtctcgtactggaacaatagtgtcaccacgaactcggcgattgccgcgcggtacagctccaatgtccctacctccaaatcagcctctgcgcatgcggcactgctcactctctcgcacctaaacccctctgccaaccctcctagccatgccgctggccctccagcagccggcgccagagtgcatgtgagctttgcttgagagagagagaagggaggaggaatcagagaaggagaactggggcttacaagtgggccccactattttttatgtttacccttgtggttatacgtgggacccgcttctattttcggtttctttgatgaccgggtgccacgttagcacacttggaccaagtgaaactgctcccaaaactaacgagggagttgatttgcaccggttttcgaagatgggggaggcattatactcggttttgtggttgaggtatgcgattcgaccaaggacaagagatgagggaggcaaaatagacttaatccaaatattgaaaatactattggtaatgtgtagtattaggaagtattggtggtaaaccaaacattgacaaaattactattcaaaataccaatattttggtatggcaaatttcggcttcaaaccaactagcccttacatacatttccctctaaaacattctaagaaaacatttgttgagacaaaaatgaaatggtataaattcgtctaaattttattttatttttgatttacatgaaagacgcatacacgcacatacaccacactcacacaaaactcttaacccacattaaaaaggaccattagaaaatcttcagcatcagtaaaatcatattaaaagtacatccgcgtgaggaaaaaaaatatcatgaatacacaattccaaaaaaatataaaaatatacgtgattcgcttagggaacggatcttaagcaatgcaaagcattgtcatcatcgctaagcggagtggcgacagcggtgtggtgtcgcgggagaagaggagaggctaggaccttgggtatggcacgactaaaacaccatgccaccgtgcttctcgaattcattacaaaaatgattcaataatactatagtgttattataaatataatgttgtagaaaccggtcaaacatatatgattaacgctatttaaaatttcacaaatattttttcttgtaatagatatgtaaatattttaaattctgcacaatataatcgaagtacgttgatgataaatataactataaccatatttctttagttgaacgtaattgaagtatttaaagtggtcaaacacacggaatatatcagccaacttgtagacaatacgaacttcaaacgaagtaaatagcacactttttgttgtatagaaatattactatattgcacacatttacttcttattagtcgagaaatcatccgtccgccctttcacgtcccacctagcatggtcacaattgacctcctgaaaatcagaaatagcctgttttttcaacttcatgcatattccatagttcattcttaattgtatggacgcctaatcatgaaaaatataatctccataaaactaaatgtttcgttgcaatccatggacatcttaccaataaacatgtaacacaaacagatcaataagagcattactataaaataggtagcataaatagcatgtaatttttcatatccaaagaagtcctgccatccaaatagttgtttccattgaggcatctaacatttgaaccaatgcggcgcagattgcaaagcctgcacaaaaaagaagagtgcagcatgcagccttccacgagagacaagagccgctccgaatagccaaggaagacatgcctatatatgtatgagtacagagtactacacacacatataattgacgacaggactgatcaggggataatcaaaatgcagatgagcagcgtataaacacatgcacataggcattaggcaagtcatccttggctaccgaatcagctcttgtcctcatggaaggcccctcctctactaattaagctctgaaattaaccctctcaaatctgaatctttcatgcatggcttgctctgcttcattacgcatgtcttcaggtatttatagcacagaaaaggtatatgtgtgcagggaataatattagttggacaatgcagtgtaaatgcatttatatatttgtcctagatacccatatctcccctcaacaacttcgtctgctctttgacatctatacattttgtagtaccatcggaatatattcggttaggttaggttttgacagcttatggtcatggtctatcagctcatttttccctcggcacatgcccaatactgtccgtctatttctgaggtctacaaggcaacacgtctcaaataggttcaattgtcaagtttggtatggctccgactccaagcattctcataaatatatatggagttcttagactctaaatatagtagtttaaaagttaacttttaggcataaaaatatgaatatgacggcctactaaaataactccgagctactctgaacttcaactctaaggactcctttggagaataatcatgattctgtttaattcttataaaaactctcctaattttttttcaatttaaaagaggcctaaaatttgtttatttatttggattggcaagaaaatttgtaataattgaactttatcatgtattacaaataaaatggcggagctaggtccttttatgatgtttcatcttttaagccagaatctattgtttaatagagctggccctggggaaacttttttttttatttttagacctttttatgttttaattttattaatagaccattccaaaatatatttctaaatctaaaccttttagtgtggcctaataactctgtcatgtggcgtgcagtgggtgtgccaattttgtcttgccatgccagcgagagcgcgtgatcaaaaaacgttgccacgcaagcgcccgccggcgtggccaaataatgttgcccggctagcagaagcggcgtgatagtataggccnanagtttcagatcttgaaaataattttgggatgggtttatttttaaaaggcatgtcttttaaanttaaaattaaaagggttcaaaaantatttaaanaatcgctctggggctgttcntaactggtttcgtccttgcaaatacccaactccaaaagctcttgtagtaggagcncaatatatcaagcgggtccaatatatcatgtcttttcctatccggtatacatacacaccaatagatactacaatagatttgctggggcatataaatgatgcacctaaaataaaaggtaaaatctaattcccgcgcgcgaaatagtcttacagcgagacgccatgcggtagccatcgaaagatgtgagtattcatgtagtactagtctatttaaaatttttgatgaattatatatttcaaaccatatattatttttaacacccgttttaaccattgaacttcactcaaaatatatgataaaataagtacaatattgaatatattaaaatatttaaaattaatttagttaaatgttagaattaactaagctctataatgaaagtaactttttatagcattagaagtaattacatatatgtgttaaaaatatcttcataggtaaagtgtagatttacaagtaaatacatgccttttttattcgaggtaaaccatatgtgtgtatagattattgttttcgataaatgcaacttattttatataagaagtaactctttagaaaataggataaactattcacagtattagtattagaagtaactcttaatattagaagttactacattcctagagaaaagtaacttaaaaaaatagaactgaccttttacgatgttaaaaataactgcactgccagagggaagtcattcttcatggtattaaaagtaattataccgctataaggaagtaactcttcatagtattcgaagtaacaacactgccatagaagtaaataatctaaatatattcaatattgagctcgg

SEQ ID NO: 25372 - DNA, 1392 bp, Oryza sativa
tccagcttgggtaggatttaaatatttgttggcttgtctccaaggagactactaacttcatgcaaagccaactataaatcatcaacttaccaaatccaaactgtgagcataaaaagtgcttattttttggtgtatatacaagcaagttttgaaaagcacatttgaacagtaaaagcacaagcaacaccttgaattatccacaactattacctcgttacgcattctttgaagttctctggttgacagcgagcatagagctaagctggaaccaacaacatcagtcggcatatcaccatcaactgatataagctctatgtaaatactagcgaccgcgtcagctaagaaaataaccaggtcctccaaaattctcgctccatgttcagccagaaatttagcatcaaaatagctataagacctgccatcaggaaatgaaggataagaatgaactcatttaccttatggaaggattactgtttggtaaatagctatatatggatataagtacagacaataaacaaccaatagtgccatcttaaactcttaaacaggagatggagttcagatggaaaaaagtggtaccatatggatcaagaagtgaagataaatagtaccttgcagaaccaaatctcaggaaataaagcagatccaaatagagttcagatttccctaatctgttgaacctcttcaagatcctgtcatcctcctttattttgctggttaccgtcttcataagttcctttatcaggaaaaaagaaaactatcagggacttgaaggcatgacaatatggagaaatgtaagacagttgaaaataatggtatacttcattgatcttgctgttctcccaggctttttcttcttgaatccatttcataaatgttggttcaatcaagccatcaatcaacgtagttgatatttgcaaccatttgatcccatctacaagttcagaactttcaggaacatttcttacctgcacaagatcaaattaactacaacaaaatcaacacatgtgttctgacatattatacagctgtgctggttagaaagaaaaacatatcttgatactgactgaactttagtccatagttctagtggctagtcaagtaacattaaaaaaacaaagagagaaagcttaactaagctagtgaaacatgcaagaacaatcttcaggattcatccattataatactctacagaaggatagtggcaccattttagtagaaaatatcacaactaccagcttgcttaagctttttgaagtatgctctctcccttagaaaaaaaaataagtgaagtatgcatgggtaatcttcagtattcatccatgataatccccagcatattagaaagaaaaagttgatggccctcttgcctccatctcaagtagctgaaag

SEQ ID NO: 25373 - DNA, 8252 bp, Oryza sativa
  unsure (1)..(8252): unsure at all n locations
ggaatgagagaggaaggaaaggggattcattccccctaatcaatttggaaagagccggcttgaatggggcgaatttgagggaggaacggcgctagggttcacgggagagagaggaggagctgggcgggaggaggacgacgaccgggtgggacccaccggtccgcgcggtcagcgcgcgtgcggcgcgtgtgcgcgggagggctgcagctcggcttgggccagggcaggtcaaggcgggaggaggataggagggagtgggccgggaaggagaggaggagggagtgggccggggaggagaggaggcccgagagaggagggacaagggaggagagaaagactttgggctgaactcggcccaaaggaggaaggaggattatttttagctttcttttaaatataataaactttcttaattgttgttgttgcttaataattatttccggtgctctgaaaattcaagtaaaatttgagtgctctttttagaccaaagagaatttaacaaaaattctccgggccacattcgaatttttcttgcacgtattttagtgtttaccaatttcttttcgaattttaattaattctattattccttttagaaaatgatttttatttcaggatgaatttatcaggacgtgacaaacccccataggcaaactcaagtatgtgaaaggcatcataccaatcttacagttcaacatattagcaattcttaatccctcattatcctccacccctatgacatatacatcacttttctgataattaatcttcatccctaatatctcttcaaagcagaataataacttaagggcaaatatgttctcatcggaattcttaagggcaaatgtgtattgaaggtgagtcaaacccccatccactaagtttggaaccagaccttcaaggactcccctttgtttggttttatccaaaatggcagccaaggcgtcacccacaagattgaaaaggataggagacaaggggtctccttgcctcaaacccctgtaaggcgtcaccattgatgttaatacttactctcccaccttctgttatcttttttatccatcccatcattatggagtcaaaattctttttgtccatgacctcatacaaaaaatcccatttcatcctatcataagccttctcaaagtcaattttgaggataatcccagtatcccttttaattttcagctcaagcatcacctcatgtaaaataacacaaccttctaaaatattccttccaggtataaaggcagtttgagaccaactaatcactttgtttgccacttcagtcatcctaaaattcatagcctttgtaagaattttaagaatcacattttttagactgatgggtctatactgtttgattgtgtttgcatccctgatttttggcaaaagagaaatcaccccataattgatcctatctatgtccagctcatccatgtgtaagtcatctgacatctctttaactaaaacccttatatgaggccacacttgtttataaaaacccatagggaatccatcaaggccaggagttgtattgtttttcatagtcttcatcacattgtccacttaatctaaagagaagggtctaaccatccaaactttttcctccccagtcaatctcagcttatcttgccagatttcaggacttagatgaacttccctacttttttcttttccaaacaaccccttataatatgcatagatgtgctgtttaatttgtgagagctctatgatattaacatcccttcttgcagagaagaaagaatatggcttttcctttttctttgatttgcagcccttatggaaaaaaggtgtattaaccatctccttgtaaaatccaagtttccccctcctttttctctgtcaccaaaatctgctacctgaatgtaaatgttttccaccttctttttccatctcatatctgatttttcattcaatttcaaaaagtccactgtcatctgcttatccagctgtaccaaagcattctccaattccttcttcctcttcttttggacactatttacattagcactccatcccctcagccatctcctcaaaaaccctaaaccctttattgtttcttgcaaacatatcatatcaattctttgttcaaaaattaactccctaagctttctttgtcgccctaatccctctcacattctaaaaaaatctcatgatttactttttttttcctccccttctttttctgctcagatcctatgtattctttagtctttgatttttattggatcactccaccttccctgcagaatcctctccttgcctccttcctctttaaccatcccttcaacatcatcactaatctcaacaaactcagatgctcattgcacttactctgttccgcagcaaacaacatagctttgcttcttctctaacacaaacgactgtcaaatttgtctcaatctcacactcatttctctccaacacaatattacttatattgacaatatcaactaaaacatctctattaactgaattgaaaatggcaaaagagttagacatacctgtgttcaaattgacttcagattttctcaattcagctttcaattgcaccggcacttctatgtccctcaccctcagtccctgtcttataacctgtttagttcccaaaatactttttttttgtgtccagttcctgacccacaatatttatcccacttgttcagacttactaacatcctacctgccctatttgcgtgcgaataaatgaataataattggtggatttcgagcatttgattttggagggttcacggcagcctggttaaccttgagatgactcggatttcagaatcctaatcagtcgcggaattaagatgtgatgtgcttacatgaacatgaacgctggacgggccgtgccgcgaataaacgaataataatcggcgaatttcgggcgtttgattttgtagggttcccggcagcctgattaatttgagatgactcggatttcggaatcctaatcagtcgcagaataaggacgggatgtgcttccatgaacatgaacgctggacgggccgtgccgccgcaagccctctccgcgagaggctcccgcgcgcacgtggtatattaggtcttgtaggctggtttgggctgcatgtcagcgagacggataggccgtatgatagcgttatgagtgagcccgttgatgggagagtatcgggcttctttcatatgtgttattgccccctcttttgaggataattttcatatttcttttgcttgcacatctttttttaaaactgttttgcttgcacatctgagttgtctgagatgcgggtgagcactgtgatattattggggcaccatcataattgtaccttagactattttcgaatcaaggggatgagaacctcaccttccacatagaaaacatattaacgcagtattaattaagtaccgttgagtagtttgagaagcatacgcacaaaagtcgagagtgtgaaagttgtgaaagtatagttccaaataaaacctgaatattgcttataattctttgttgataatttgatatataagtatgatactatgtcttagtacaatgggaaagtattatgtgatacttaactagtatggaagtttttacatagggaaatttaactattcgctactattaggtttgccaattaaaattgacgcggcagccctctctttcctggctgcagcggcggaggagtaggaaagggagccaagtacgggagacggagatggcgtaggtcagtaccgaccagcggattctccaaggaagagcgtggcgagctcagcgcctccagcgatagagttgtcagcagcagcggagccgcccacgtcatcttagggtggctggggagggaggaacgccgcgtcggccgactggagtccgtggttgccatggagcatggcgaggcggaggtcggatttgcggcggcgcttggctcctcctcccatggtgtgctggcgagggaggccgcgttgcgctgctctgtctcgacggcggcgccacccaccaactcgtagctgtagaggcactcgtcgaggactttgaccaccgttggcgcaaacgatgcgagcacggcttcgcacgtccgatccagcgtgtaaatgctcgtccttgaccgcggcgtcacttggctcctcctttacctctgccgcgagccgtcgcaccgccgccgccgctgggaaagagagggttgccgcgtcgatttttaatactgccggaggcagagaggaagggagacttgtgagactgacaagtgcatcccacgtcgctttttacactacattgccacgttggcatcccagatgggcagaagtggtaaaaagataagaagccaccatcttagagaggcaaaaaaaaaaaaagagagcaaatctaaatctaaaagaggtatttggataattgacaaacctaatagtgtcaaatagttaaatttcccttttacataagggtcaacataaaaaaaattacttacctccgttccaaaataattacatttctaaatcgaaaaggctaacgggcgatcgatcgttgccagcgatcgttttttcctcttttagtaagtttatacacctaaagtttacacatctaaagtttatccacctaaagtttgtgaagcgaatgtttataagtcaaaagtttatggcaaaatttgccataggacacacaaaaaacgtgtaattagctgggagacaccgcgaaaacatgacacggctgatggacgctacaaaaaatgtataattggctgtagaacactagttgtattattttattatttctaggtcaaaagaggtgggatattttcctaaatgcccggattgcccttctctttccttcgttttctcctttgctgggaaggcgcgtggtgggcagggttcaatctatcgagaaggggaagattttcgggggtcagcgaaattccgaaatttcggaaatctttcagaaatttcgaacaaattttcaaacaaattttgaattcaaacaacgaaattaaagaaatgtgatctagatcagaagataagcattgagtccatccaatccaaagtagagacaggagaatgagacagtcacacgcaagccgcaaggatgggaggcttgtgtcgtcgttgtcgtcggcgcgccgaagaggcacggagtcactggcggccactccagccatgcgaggcccgcgtcgtcgtcgtcgtcgtcacgccgaagagccggggagcccaccggtggccactccagcctcgcgaggcccgcccggtttgtgtcgtcatcacaccacggagcgccatcaccggctactccaaccacaccactgccaccagttccacagccaccaccaccaccactcactaacactcagaggatagcaacctactgcctactggggctagctgttggaagaagacaacgaancaaatctgcatccagccttggctaataagtgaggaattcagggattttgaccgtgaaccctcgccccactacgcacgtgaaaacgaaggaaagagaagggggtaatctggtcatttaggaaaatatctcacctcttttgacccagaaataacaaaataatgcgaccagtgttctacagccaattacataatttttgtagtgtccatcagctatgtcacgttttcatggtgtctcccagctaattacatgttttttgcgtgtcctgtagcaaattttgccaaagtttatatacccgattcaaattcaaatttgaattcaaatattttatattttcctcttttagtaagtttatacacctaaagtttacacatataaagtttatccacctaaagtttgtagagcgaatgtttataagtcaaaagcttacatacacgatttaaattcaaatccggattcaaatattttatatataaaatatttctatagataaagtttatgcgtataaagtttatgcgtgtaaagtttacggtataaactctatgcacatgaatgagagtattattttttttattaactttgtgttttttttatttttacgatgaaaggaaagaatagagaggagtatccgctgataatagagacagattagcaacaaacacagtaaccctatttactaacgacactgcatacacacatttcgtacgtacacttgactaaaagtaatattgagacaataaactcagctaattactattattaaacttgattaaaggaaaattggatcccactttggtagaaatactccctccatcccataatataagggattgtgacatattgacctaaaatcccttatattataggacggatggagtattttttttaataaaatttgaatggtaaaaatgtaattattctagaacggaggtagtatattacacaattatttcacgctcgctctctatctaaaccgtcgcgctcgcgcatgtacaaacaatggcaggttgtaactttttttttgatatgggccttgtttagtttcatatgctaaattttattttaagtatgcggacacatatttaaagtattaaacatatactaataataaaataaattatagattttgcatgtaaactgcgagacaaatttattacgcctaattaatccgtcattagtaaatgtttactgtatgtgtatttagatcctaaaaaaatttgtcaaaaaatatcacatcaaatgtttggacacatgcataaagcattaaatgtgaacgaaaaaaacaattacacaatttgcatgtaaattgtgagacgaatcttttgagcatagttgcgctatgatttgacaatgtgatgctacaataaacatattctaatgatggattaattaggcttaataaattcgtctcgcagtttacaggcggaatctgtaatttgttttgttattagtctatgtttaatacttcaaatgtgtatccgtatacttaaaaaaaattagccaaagaactaaacacggcctgtagcaccacattatcaaatcatggcgtaattaggctcaaaagattcgtttcgcaatttatatgcaaactgtgtaattggttttttttcatccacatttaatacttcatgcatatgtctaaatatttgatatgatgaaatttttggatgtttgaagggaactaaacacttccatacgcaggttgtaacttgtgagtgcttgaggaaaacatgagaggaagaaacaaaaagaactactggcgagtagagaaggtcgctcggtggcaggtatttgaggccgtgatgcagacgaattgaagtgacgtggaaccgacgcagcaaccactctatcggtatatccatctcatcactccatcagcatcaaagctcttggcaaaaccagcactcctgcctgtccaaccaccagagaatattcttcctcgtacatccgccacgtcacgtgatcctcccctgtgtcttctagatctatcaacagattgagcaaatggcttacaaattcacatatctcctctcgtggtaaggttttcctcagcattttcgtcgtgccaactggaagattaagacaggctcaacagccctatcatgttcttaaaaaaaaacagccctatcattgcatttgtagcgtggataagcaataatggtgaacattagacatgattaatttagcgaaatgacgaaatgggtagattatttggcgccatctaactagttaccagctatgcatcgacaccgtagatgtgaaaaaacacgcaccaaatgtctagatcgatatcgaccaactcaccaccgaacagtcagaatcaaaagccatctcttaccttctctcctctccctaaagaaaaggccatccttttactagtgtccttgctttttgcgatggcatccatccataatccatttatccaaagtcaatgcgacgccaggaggcgacagacacgagcgcgcatcgacctggcactggcacaccacaggacaggagcccaggaagctacctataccttgctagcttggcgtcttggcgaaacacccccttgttggatcaatctgctgtgctggtggtgagtcagagttaagagttctaaaaaaaaaaagagagtcaaagttaagagatcgaccaagtcgctaaacaaatgcaggataagacgagcacctcagcatgagccgtcgtcctaatttgcaatcacctgcatttcatcttctactactatcagatccaaccaaacaagcaagggcatcagatattcagatcagtatatcgatcaggggcaatggacaatgcgctgatgcatgtgattccacttagtcatgcgagttaaccaaccggccgtgtgcgcaat

SEQ ID NO: 25374 - DNA, 4014 bp, Oryza sativa
tttatccaaagtcaatgcgacgccaggaggcgacagacacgagcgcgcatcgacctggcactggcacaccacaggacaggagcccaggaagctacctataccttgctagcttggcgtcttggcgaaacacccccttgttggatcaatctgctgtgctggtggtgagtcagagttaagagttctaaaaaaaaaaagagagtcaaagttaagagatcgaccaagtcgctaaacaaatgcaggataagacgagcacctcagcatgagccgtcgtcctaatttgcaatcacctgcatttcatcttctactactatcagatccaaccaaacaagcaagggcatcagatattcagatcagtatatcgatcaggggcaatggacaatgcgctgatgcatgtgattccacttagtcatgcgagttaaccaaccggccgtgtgcgcaataatggattaaacaagtactagtaacaggagatttgtggcctagttgcctgaatttatgcgtgacgcgtctcccattattggactacttgacgatgatttattgttaagttgacgtgtaaaattattactgtaaactgccttttctgtaatctttatcagtcgatctctgtctctctctccgtcctgccgtacgtggtttcagaaaaaaaggaaggttgttgttgctatgctggatatacaggattagtcatgaaatgaaggggagttgcaagtgttgatcaattagtgtgtcgaaccaaatcaaccatgtcatcagcagttcttgtcttctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaaagaattttcctcgttaattaatcaaattaattaacccggctgtacttagtcgagtgttagcccaagccattctcagccagctagtcctttttctcctttttttttttcaaaataaatagtgctgtttgtacgtgctatggctgttttgaggaataagctgctattaattcacgtcttttatatgaaatgaactcgtgattctatttccaagagatattgcgttctcgcgcgtgttgatctgacagcagcattgacccctcagtataatgcagtttttttatataaagaatcggatgcaactaccaacaatggacaattggacataatcactaaactaaaggaggatcactcctgctaccacatggacaataaacaaattaaaacggcactgaaataccgaattcagctacacacgaaagaagaaaatatctactctagtagcaacttgcaagctttaattccttctcccttaattaacccttcccctttatatatatatatatatatatatatatatatatatatatatatatatatatatatatatatatataaactgaaacttgcaatctcctctgcacatattctcagggttcagcctaaataaaaccgagaaaagaaggtgctcctttgtgctctcgtgatgaatctgtcgtgtccatcacgtatagcaggaataaaccaatcgtcttatcctttaacccgtcgtggaacagaatcacgatttcttctttattggacaaacagaatcgcatacgaagtgacgacgaaaagcggaaccaccagaacgatcgatgcatccgcatgatgtggctgatacgaatgatatcacttgacacactcgaccaacggctagctaggcagcgagcggcgatcgacgagcgcgcgcaagcaacggcacagacgcacgcacgcgttgcgcgggcggatgctgcaggagttcgctgcagattgggcgggcgaagccgtggtaaaagctagtactacccaccagctgttccaaaccatctggacgacaccacttgtcaagttgtattgccacgatggcggctttgaacgattgcacgtacgcgaacgcacaacgtcgactcgggctctgttagttttcacgtaaaaacttttcactatgtgacattgaatgtttagacacatgcatagagtattcaatataaaaaagacataattacatagattgtgtgtaaattgcgagacggattttttaagcctaattgctccatgatttgacaatgtggtgctacagtaaacatttgctaatgatggattaattagacttaataaatttatctcgcagtttacagacggaatctataatttattttattattagtctatatttaatacttcaaatatatgttcatatatctgatgtgacacgtcaaaaattttcacctaacatctgtatgaacacagaacacagcctcggtcaaagagaaaaaacgaggcacggagggtaaaaaaggaaaaggggaaaaatcgtggcagaaaggacaggtgaaaaaacggaaacagcgctgtcctgatgtgttcgttcgttggttcgttctcgtagttgtagcagcagagggaagcgtctgtctgcgtcgggtgcgtgcctttggaccggaatatcctggaggataaaccatccgatccgcggggacggtggcagcaaattggcaaatgcgcgcgatggctggccatggcgaacgcatccccaccccgaatattccccattcccgcttccttcctttctccaacgacccacacccaacactcgatccctttccccttcccccgccttgttataaattaggctcggctcccgcttcctcgcgtcgcgtcgcgtcgcgtcacgtctcgttgttgcattgcattgcgcccacgatcctcctatacgcgcgcagctaggacatcctccgaatataatggcccagctcaaggccgcgcgcgtcgccgacgtccccatggcgctcgacgtcctcgccgccggcgcccccgccacctccgccatcctcggtacgtacggattattcaatattcattgcgtggcgtcgagacaccgtgccgcggcggcgttagttatttccttggttatgcagcagaggtggacgcggcgggtgctcggagcgccgcggcgggcggcggcggcggcggcggggggcagaggttcgcggtgatcgggcaccgcgggaaggggatgaacgcgctggcgtcgcccgaccggcggatgcaggaggtgaaggagaactcgctcaggtcgttcaacgaggccgcccgattccccgtcgactacgtcgagttcgacgtccaggtaacgaaaaaaaattcttcatcatccgtccatccatgtccatccatccgtcatagcggtaacctgggtggggttgagctgctcgtgctaaatttgggggtccccgtgggcgttcgagacgaaaaagcgagaccaatcaaggaaaaggaaaggaagagaggcagatggggagatgggttcacgttcacctgggtgatgggacgggtcgccggcttcctctcctcgatggcgacgcgtcagcgccatggagggcagaggagtgggggcgccgcgtagcgtagcgagcgctcgccgccgcccgcgggcgaaacagaagagccaacggtgtggcgacgcgtcgcggtgagctgctgttccgattcgcggtgtcacacgtaagccccacgcgcccgcccgttctcgctcgccttcttgggaaatacgaatcgatcgacataataattgcccttcttggagaaactgaaacgcgaatcgaaaatctcaccggcacgattaat

SEQ ID NO: 25375 - DNA, 1270 bp, Oryza sativa
tatatgactttaccaaagcaagaaattaagcaccgctaactaaaaatgtgccgtcttctataataacaaataaatgtagtatcaaaacatatttcaaatggtggatttaatgaaactaatttgttgttgtagatgtctatgtatttttatattataaactcggtcagaattagagaagtttgacttaggacaaaactaaaacaagaactgagagagtatgatcctatatatgatttttcagaatatctaataattttcataagatctctaactgtttatttttgtgttccaaaacctcttatactctcttgttatgaatactagtccttgattgaggaacactttttatgtaacggttccttttttacttggcatcgaatactatctatgtacaaacattaattagccgctcgtattgtttgagaaaaatataaatattttaaaagataccaaactatcaaagcacctaattataactatactacttacattcatcaaaacattgtaatttaaaagtttttattggtcaaaaataaaatcacactggccaacagtactggcaagtaaaagagatcagagagagtgtagttccaatccttacccaggaaccaaccacatgttgaaggttggtcgaatagatggttgcaaaatagaaccatagcggagctggcccctaatctagtaaatatgatccctaaaaagattagcaagcatcctaccatagcacaaactttagaaaatcatgggtggactgctgatatcaaaggagcactcattgtctaagtcattgttgagtacttgcgagtttgggacttggtggacggggtaatcttgtaggatggcatcccagaccaacatcattggatgttcatgaggtctgaattgtacacccgtaaataagcatatgagtccttatttgttggaacaatcaagttcactccatggatttgttgaaggataaaacagagaaacaaatcaaatcaaacatttgagccaattttaatcatatctacacctacccttccacctgaaacattttacttgatacggattttacctggcttaatttcaacaaacttgctttataacccccccaccccaccccaaaagattgctttataagaatatatatgtaaacctttcaaaaagaaataagaggagtacaaaagcaaaagacctcccctccctaatgggccatgaacacatcacttgggacttgggctgctaaaaagcgattgggcccaacccaagtgacacagacttggacact

SEQ ID NO: 25376 - DNA, 1233 bp, Oryza sativa
ctcacatgacatgcgggcccatgtgagtcagcggcgtatggatcgatctggtgaacccggcgtaggtatgacgagcgaatgccacatgggtgacacagctgtggtgtggttggtcgcgccagtgaaaggagaaagaagcgagcgcatggagttcatcgggtgagcgttcttggtagtaggagattcttctccaatccgtgggagaagagctaggaggagcggaggaatccgtgtcccctcccgcggacctgcttctccggctgcccgtaagttggatttttctctgcttcgctccctcccctcctcgcgccattgtttttttcttggtcctttggctctcgggtgcgtcgccaccgcgattcgatctggggggagagggaggaggcgcaggcggagcgcacgagggaggtgggtggaggagagggtggggggcggcggcttagctgctgtggacggcagaaggggtttcttgtgttccagacaagaatcctgaggagtgagagcattacattgacatcctcatcagggctttgggtgtggaaagaagcgtataatgatgtattccttgttcagaatttactgttggttaaaaagtatatgtgcttcaacttttgaggacagggccatagggggtgaaaataagatataagtaaataacttacaaggaaacatggatgagagtgtgtaccataagcacaatttcgttttgtttcaataccaaatattttcttttaactaaatggattcattgacaataaggtatttgcttcaatatgcgttcttattacttcatatcataccacattttgtgattggggaatttcatatagtttcagatgctatgttagtttgagccatatcgtccaaccctgctcactccccctcctaaatttccattttccatgttttgttgtgcaggaaacatgctttctccctatcagcctttgtgatgcattgaacaggggttgagaagtactgtaatttttgtaatggctgggtgttccttggcaacactgagaggacaacatcgagggagatggatccaatctcacagcaagctccccacaaggattatgtctattaatctgccaaagaggtaaaaaagttttccgtactctgttgatattagtcatcttgagttcttcaatggtaatttaatgtttgattttcttcatttgcagtactcacagtcacaagattcagcttccatgccagtccaatttgggctgcagg

SEQ ID NO: 25377 - DNA, 603 bp, Oryza sativa
gcttgatcttccttaattcatcaccagcaaaatactttctgaaggcatttgtttctcatttctgaaatttctgcatccatgtgaggagcttcacgggttggaacctcagccaaccagctttcgcagtagtacctacattttataaaaacaattaataggctaacaacgactacaaattatggaaacaaacatttaaaagtagaagcagaacattacttggggttcagtgagtgtgccaagcaatgcaggggggtattactttttgcccatcgagagtacaagatctcttgcacatgaaagaaaaaggaggaatgctcatttagttctttcccttcatgacgataaactatttttttcaccttatctatcattgaatcccacatctcataaaccaaatggaggcaaggtttgtcggtgtcagctgcacgaatcatggaatagataggatcagtgaaatctaggatatactgcaccttatcccaccacacatcatttagaaccttctctttgacttgctgtgcttgaacttgattgtcttccctaataagaattccatttttcactcactaccatcaagattagagattctttgacagcacggaa

SEQ ID NO: 25378 - DNA, 423 bp, Oryza sativa
tgcggatgcatcgatcgttcgggtggttccgcttttcgtcgtcacttggtatgcgattctgtttgtccaataaagaagaaatcgtgattctgttccacgacgggttaaaggataagacgattggtttattcctgctatacgtgatggacacgacagattcatcacgagagcacaaaggagcaccttcttttctcggttttatttaggctgaaccctgagaatatgtgcagaggagattgcaagtttcagtttatatatatatatatatatatatatatatatatatatatatatatatatatatatatatatatataaaggggaagggttaattaagggagaaggaattaaagcttgcaagttgctactagagtagatattttcttctttcgtgtgtacctgaattcggtatttcagtgccgt

SEQ ID NO: 25379 - DNA, 636 bp, Oryza sativa
acgtggaagagataaatagttccatgcctgtgaaggttcccggagagaaatagttacatacatgcttactgacggcgcctgtttttttttaataaaaaacaaatgcttgatatgtagtcttgtcaagggtgagaggctaaatggtaagaaagaaaagaaggaaggaaacaatcacaaaaagggagaaaagaaaaagaaaagacaaaagcaataaaattcgcaaaaagccaccacctccaccttgtttgagcagatcaacacaccacatgcgagtacgtgacgatgtcccctctcccctccttcacctccggtgaatggcgtcccgtatcgccgcccgccacctcctccgccgccctgcgacggtaatccggcatccctcccccctcttcttacgcatgacgcgtaaaatgtatatgggggatttaatgcgatggggcctgactcgttatgagtctcgttgttggggttgattttggggctggatttaatttgttgtcccgatggtggtttggtgctctttcatcgcctctccgttcattttcttctgtgtattacgatggtaagaatgcgatttttctagttggttgttgtgatcaggacggtagaggatgctaaactgtgaaattgaggagattg

SEQ ID NO: 25380 - DNA, 2251 bp, Oryza sativa
agaggctggcgccgtccagttggacaatggcgctagccactctggcgccccaaaaaggaccatttctgggataagtttttttaggggtctatttgcgaaataagtttttcaaaaggaccaaaatgtgaaaaatccagcttcattattactatgttgtcaaggctgaattgttagctttttttgttagcttcctagttcctgaacttttaggtctcttttcatctttggttctatcagactgatagcattccatgtagtgcatcagccttagtttggatattagtgtggctctttgctttacttgtttgctcttatgtaatctgtactctgcatttgttcaatttgatatttggttgacaggaaagaacatatatggtgtatttctttttggaattgatccaatgttgctccattttttttcagagatgggaacactgcagctgggtgactgaagctcatggtggcattagtgctaagcttaaacacttgcattcaatttgtagtttagctcttagatggctacttctatttattctaaaaaaaacaactgaactgtaaccatttttattactttgtgacactttcatgtatgcatttgtgaacgtacagcatgcatgtgtgttttccctatgctaaaacaatgttttttttactgcatcctatggatttgatctgggagaatgcatattgtttcattgcttgcttgggaacatacagctgctgctttatatttccctgtgctaaacgaaggcagtgtttatatgccagggattagaaacgggcagggattcgaaccccacagggtttgagtgagataggagggattcactcaatccctccctggataggatcccttggggattaattcccaagcagccgaacaaggcctgagtggtgttagcggctccaacaaccaatgaaaaaaatatggagccgcacttagagccaccggttcttcatgcttaacataagatttaaccggtcttgttatatgtcaacaatagctagcaaaagtaagtagacaataaaaattaaacatcattccttattttgtaaaatattaattgataattagtgcaagtcaaggatgaggacttacgtttccctgtcaaaaaaaatgtttgctgaagctagctagttcaaatggttaaacaaaaaaattcaaaaggtttagcaaaaaaaaaaagaggtcgatatattaacataaaaaactaatggcatcataaagcaccaagcattcatccatggtgctggaaccagatcctctcatgttgggatattgtgtggctgagtcatccgatccgcatcgcagcaaccgagtgaactcagcgactgaacgggctgggctgtagcttggcccacggcaacgaaattaaaatggcccatttgcacacaaataggtgtcgccactataggtgtcggtagtactaaaaccggcacctataggccttttcccacctccgcgggttcaaatcgcaaaaaaccggaacctttaagcaataataggtgtcggttccaaataaaaaccgacacttatttcattttgtgccggtttttttttaaaaaaacattataggtgccagtagtactaaaaccgacacctataagatattataggtgccggtttttaaaaaaaccgacacccaaatcaagccgaaccggcgggccccacaagacgagataaggataaggacgagctagtggcttctcgatctctctctcgtcctcagtttctctctctctctcgcctctctcttctctttctcagtttcccctcctcctctccccatacggcgtcgtcggcggtggcttctcccgcggcggatgcggcggtgggcgaggtggcctcggcggcggccggggtggcgactgctggcggagcagcatccggcgtcggcgtcggcaggcaaagcggtggcggcggtgagtcccgcaatggatccggctcccgcaatggtgattgtttctatgaaattgttgagggatatgtgatttttgattctttcatcagtgatttatgtggaacttctgtgatttgctttgacggatatgtgttggatgaattgatttgtgattctttcatctgtgatttgtgtgaaacttctatgatttgctttgagggatttgtgtgaaatgcaggttgaagggagataactccgctgcccatttgctgagccggccagtaatttccttgccccggagcacttcgcccaaaggatactgcgatggcatagtgactttgtgggcctga

SEQ ID NO: 25381 - DNA, 10133 bp, Oryza sativa
cagcgaagttatctccctttgacctgcatttattcgcccgcactgccatcaagtcccaagtcctagccgacttcgtggtcgaatggacgccagcattcgcccctgaacccgagcctgtcgaacaaccttgggtgatgtactttgacagttcgtggtcgcacaagggggcgggcgccgcggcagtactcactttgccaggggctgcgccgattcggtacactgcaaggctacagttcgatacgaccaacaacacggcagaatacgaagttgtactgttgggcctaagaaaagcgaaagcattgggggttcggcacttgctgatccgaacagactccaagctggtggcaagtcatgttgacaaatcttttgaggcaaaagaagaaggaatgaagaggtatctggaggctgttcgatctatggaaaagtgtttcgccggcataacggtcgaacacttatctagatgccagaacgaggaagcagacgccctggtgaaatctgctgcttgtggaggctcacattcaccaggcatcttttttgaggtcttgtacgcaccaagtgtgcccacagagagcctgcacatcatggcaattgaccaggcagaactgggcgaagacccagaggactggcgaacaccgttcgtgaagtacctcaagaacggttggctcctggaggatgaagtagaagcgaagcgcctacagctcagagccgcaagatacaagctgatctcagggcagttgtatcgctccggggtgctccaatccttgcttcgctgcatctcctttgccgaaggcgaggaagtggcgaaagaaatacaccaggagctgtgcggtgcgcatcaagccgcaagaacggttgcctccaaagtgtttcgccagggggtatattggtccaccatgctaaaagtttgtgttgagcaagccaagaagtgcgaaacctgtcagcggcatggccgaagccaagcagcaccccagtatgagctgcaacctatcgcaccggtctggcctttcgccagatgggggttaaacatcattggccctttcccagtagcgtgaaatgggtacaagtttgcaattgtagcaatcgaatacttctcccgttggatcgaagccgaaccacttggtgcgatcacttcggcagcagtacagaaatttgtatggaagaacattgtttgccgtttcggagtgccgaaggaattcatcactgacaatggcaagcaattcgcctctgaagagttcagagagatgtgcgaggggctaaatctagaaatcaggttcgcttcggtcgtgcacccacagtcgaatggggcggccgagcgtacaaatggcaagatcctggaggcactcaagaaaaggcttgagggggcggcgaagggtaaatggccagacaaaatgctatctgttctttgggcccttcggacgatccgtacaaggccaaccaagttcagcccgttgatgcttctctatggtgacgaagcaatgaccccaacagagctaggggctactaatttgccaagggtgatgttctctagaggcgaagatgggcacgaggtgtcgctcgaactcctcgaaggggtaagagtcgaagcactagaacacatgcgcaagtacactacaagcacctcggcaacttacaataaaaaaagttcgaccgacggagctattgcctggccatctcatcctaaggaagaaggcgaacccagtggcggtcgggaaacttgaatcgaagtgggaggggccatacctcatcaagcacaggtccaggacgggctctttttgcttggtgacgctggaaggcaaagcgtttctatgtctagaagggtagcaccccattcgccaacttgtaaaaatgtacacactattgtataggcctttcggcacctctcgttaggtaagcccttcggcacaaaaatacaaaaaaagaggaaaataagaaaagaaaaaaaaattggatgtagggctattatccatcctggaggcctgaaccagtaaaaaattcttgtgtctttcgccttttctttacttgtgtgaatgataatttgtcgaaaaaccccaaggcaaacgccttatcagcgaaaacgccagggggcgaaacgaatcagccgaagcatcgctcgccgaacgttgaaaccacgacagcttgtttcggaaaataaataacagaacaccgttatactcgatttatgtgaaaacacaaatgcttctttcagcgcagaacaccacagatcaaaagcggaactcgaaagctgaaaagtcagcagacctatttcgctaatatacgcaagggggccgacatgtttcgacctaacgaacgcacgaaagttgactatgcgaacaatagcgaaaaggaaataaaacacatctttattaacttcaaaagatatcgaagaatacatgccatacaacatggtacaggtcaaagaaagtaacgggctttacagcctagcttacaaaaaaattacatcttcacccccaaaacaacctccactccctaaggtgtgatttggcgaacttggttcatcatcactactaatattatacactatcctaagaggagaagggagcgaaacacaaactaggccatagcggcgctgggcgatcgcttcttggcgatcagtccttcggtgatttcgccaaaagcgggccatgtcctcccgacgttccacatggacacggtcgtagtcatccaaggttcgcccggggtgcgcccgcatccagccgacaactttcaaaaccttgtaactattgccgtttattatcatctcacgacaagaatacttaatcttcagcaggcctttaatcgcgacgaatttctcattcttgttctgccaatcgccaaaaagaggccgaacacacacctttcggcgaaaaccctgctaatacaacataaaaaaggcaaatggcaaagtgcatggttaagagggggcgaagcacataaagtgggcgaaaaacgtcgcctctttttggtgtgcaaaaataatggaagcataaatatcaaagccgaagaaacaggataattggcgaaacttgattcatctattccatataccaaaaaggccgtttccggctacagtacaaaagggggaacactagccaaattcacaacgttcgccctccgtggccaacgcacagagtctaaaaatctaaaaagactgggcggagagcctcacacctctgggtgatcttggccgacatccgccccagcgcccgcatccgcaccaccttcttcggccgctggctcctcacgctactctgctgcctctgcctttgccaagtgttcgagcaggcgcgccttggcagtgaatcggccctccttttgccagaactgtttgcgccaggcacgaagtgcgggaaaaatgtccagagagctgacctcccaatcacccttcacaaacttggggaactcggcaacgtgctcggaccaattttgttgcagcaggcccatggtgacggccactgacagatgcgcgcagcaatcgctgtacgtagtggcgaaatcggagaccgcaccaccggcctgttcggtccactccaagaagtcgaaggcagaagtatcttcactagggattcctcgcaccttcgcccccatgtcagtaagagcgaggcaaagcgtgcgacacgcggtcttcgtggactcagtggctttcgccatctcccgcgtcaacctttgtgcgtctttttcagcagctgctttcgctttacgggcctcctggcgaagagcctccatcttcggctcggtgaggttgtagtattcagtcaaggcggcggaatgattttgttcttttttaagctcggcattcagacgcttgatctcggccttcgcctcgctccccttctctagctcaactcggagccgcttgttgttagcctttgtctccttgagggtgtcggcgaggctctccatttctaggctcttgcggcccagttcgtcgtctttagcttaaagacggtttttgaagccatcaagacaagcccgtacggtccgctcagtcgaacaatgagttgcaacaatctagttcaagaaaaaaaagagaaagggggagaagatgatgatcgtcaacattagttgtggaaaaacgatagttaaaaagaaagaaaaacaagtgacatacccggacagctaagctcttgatggcggaacagccttcgtcgaactcgttcaactcagtgaacaggctcaggctgccagtcggagaaacgagattacttaccccctcgacgaaggggataagatccgcccgagtctcgaaatcaccaggggcaaagtggggtgccgcaagagaatactccgaagccgacgtttcagcagccgttttcttccccttctggatggcgagcggcgacaccaccagtttgctcagagggcttccgaagagcctggctgcggccctcacaacccggtcagcaaaagctgaagttccagtggcaacgctacctcctgctccgcccgcatcgaccgtagcaccgggagcggtcaaaagacccaggctcgtagcaggcgaagttggagtctcgtccgaagactcgtcgtcgctaaaaacgcatgcgacattgacgggccctttctttttggaggtcttcttaactgaaccccccttcgccagcttggccgcttcaatcgaaaccagcgccttccctccctccaattcctttcggccgaggggggagctgttcgactccaccccagtttcgacatcgtaagggcttggagttggggtgtagccgcgcgtctcagtgcggttgtcggcgggctcgtcagcggccatttcggccgcgagctccgtctcccccttatcctccccttcctcttcgccatcatggtcgtcgacagtgtcttcatcgtcggcgtcagagtcggtggaggtaggggcctttctcttccgaggagccaatttgacttgtccgcgtgtccgcttcctggaggtcccttcatcgccatcggccttgaagggcttcgcacggggaggaagatcgccatcgtacacccgattcgcccggccggccgcctgccgcgtaagcagctggctgaattcaacgatcgacacatagccgatcatcttctgggcttcggtgtcagcctgagcaagagttaacactgcaaaaatgaaatgtgtcatcatattacgcgtcgagcaggacaaaagagcgaaatacacatacatataggaaagcagaggcttactgtttgccccctctggcatgacgagctttggcaagccattgacctcctcgtcttggttcacctcgacttgccacgactgggagagagggaagatccggagcatgcaaaactcttccaccaggttgcggcagctaaggcgggagcagagcttgcgaagcagggtgaactacgcttccatagcgccttcgacgacgactttgggcttcctgttcggcatgatcaccctgcgctgccattagagggctttcaccgactcggacccggcctcgaaggggatggagtggtagaaccacttcgacatccaatggcgatcccacttgaacatagcggcattgaccggccaaagatcggagcgctcagggcgaacattgaagttcacgctcccgaacgctgtcttcttcgtccccactggagtaaccaccgtcttctaatttacggtggcataaaaaacggtgccgaaaaactcggcgctcggttcgaacccagcggcccagcacgcccagtcgaagatggcgttctggacgagagccgatgggcttagttgggggagctccacctgaaaaaggcgaaggatctctggcaacaacacgttgcacggaaacagaaggcccacctcgaagaacatggcaaagaccaccgtccggttgtcaccgggcttcggcaccacagcctttcctgggggaaaggcctgcttctctgccaacacaccggaggtgaccagcttcgccaactcatcctcattcacaagcgaaccccccagataggcggtggtgtcatcatcgatcctgctgggatcagggcccgtcacggagggtaggttcagcttgcgaggggccatggcgaaaagtgtgggcggtggcggaaagaggaacgatcgaaaagtctagagactcaagagcgtcgtgaagtcagagggtggagaaagagagagctcgccatgaaactgacaggggtgcggcggtgaaaaaagggggggaatatattacccacccaggcgtcgattcgccttcccacccaatcgtaagccgccatgtgtcacaagtgtaggtgaaacggtaaattcccattcattgagccgcatagtgctaagcccacgaagggaagccgtcactgttcattgcggccaacaggaaaaaataaggacggtttcaccatttgcaaaaggcgaaagctaggaaaaattactaaccgtaaaaatacatatgcacaaagtgtatacatttcctgtaggactccagtataggtttcggcaggagtgtcggtcgaaagggggcgcctcatatcataccacatggtttgcacggtctcggccaaagctcccaactcacccttgcccgtgaggggcttgttggcggtatgtcatgagacccttcgattagacctaccaaaaccatgcaaccagcgaggatgcaggcttaagacgctaaggtcatctaggtgaagctacatggcgaagactatgaagtaaagatggcgaaggctgaagagtcgcgttggtatcccgcaagaccaaattcgtcttgggcgaagagtacatggcgaagggtgtataccgaaggaaggagacttcgccataacaagcccaacttcatggaggcccaaggggccatcccagccgctcaggcctgttcgccaattggcccattagaggcccatgtatccaaattacactatgtacccacatagacgttcctttcataagggcagccatgtaaattccctagtaaaacctaaaccctagtaggggaacctgtaataggattataaatagcctcctagggacatgtaaagtgaggatcccaagaaaaattctaaccaattagtacatttactgtttccaacactgttgagtaaccacgtccttcgacgtgcgcagttgttacttcgacaatagctaatttatacaatagttacctataaacatatactacactattaatacatggtcccacctatcatacacatattgcattttggagtccgtgctgcagctggctatatatctgtagcccgctgctcttatatatctctcctcctttatctcattgatatgtgtttatagttggattatagtctgctattgtacccgctcttatctacacattgaacgtgccagcagcgtcgtcgcttcgttatcccgtgcatcgccccgtgcaatgttgtcgcttcgttagcccacgcatggcctcgtgtcaccgtcgcttcgagtcgcgccatcgctcgtggcctcacgaatcacgtcgtgacgtcctggggacctgataacactgcatgatcatccgagccgtgatccaatctgcagaatccatcccgcccatggtcgatctgcgtcatgtcgctgttgacccatctctgtgatcgatctgcaagccatgacggacccgctgttgccctggcaatcatgtatactccctgttgtcttctcttccaagcaatacctatttcctgcacatgtcatcacctcttttgttcatagctacagtccatggcaacactggatttcgaccaaaacaatcccattgattgcgacctaaacaatcccgttgattgcgagatgatgaaggtgcaactcgattgcaaagaatctggttgtgttcggtcaattaattggaatgccactaatgtgttttctctttttctttttggtcctagatggagaaggacaagaagaatgtccttgagaagatgagtttaacaatgcacattcacctctcgctcctcaccatagtgaccgcgatccccacgacatcgcctcccactccgcctatgccgactgagaagccatctcttgctctggccatgtcgtcatccatgatccatcgcctccatgtctttcagtaggtgtgagaagaaacatcgcccgtgctgggttttggcataggaagctccgacgggaacaaaacgaagcgtgtgcgatacgaggctccatgcaagattttcggtgcctcccctcgtaatacacaaaatggatttttttttggtttttttttttttgctatacgacgattatttaggaacggaggaagtaaaagccttattccaaaagattattaaagtctagtagtattccatctattaaaggcgcaatgaatttttgaatgttgatttttttttcttttttgcagatggtaggcaaatatttcctactcccactcgcatatatcactactaaaaaaatgttttttttatgagaccccttgatttttgcaaacggaacataactagtgacgtctgcaagaatcgatggtcatttttgcatgcggccggtatgaaaaaatcgattttcccatacgggtctcttaagagaattgcatgcaaaaatgagctcatttttacatgcggctcacttaagcgcccttatgggaaaatcgatttttccatacaggctacttaaggagccgtatacgaaaataaaatttaaaaaatttgaaactggtttatctcactcatatgaacttccaattagatgattttttctaaatgtttctaaaatcatgctctatcatgttattgtgtttttattactattattttggacattttttcttgtgaatttgttatatcaattaaaattttgaatttcaaaacttcaaataatattttaaagcagtaaatgattttagctaaaaaagtcatctacaacaaagttgtataactcatcaagaactataacaaagtcgtataacaacaaaattgtataactcatcaagttataggacgtcccaaattatatgtattcagtagtaggcatcttttagagtagggatttacttagattatttttgaaattgcagttttgccgcttgttctgtttgtggaatcccaactttgttttttgaaagggatggaacctcatctttgagatattaatcattcatcggcaaattgagatgcaatctaccttgttcttacttatgttctttgattcacacgtagggattagccttcttagaaaggtcaacagggtttcagcacagttgataaccaaagaaaacgtggtgttgcgattgcagggttcggatcgtgttgatcggaagctgaatcatgtgtgccaagttttcgacaaatcgatagttacgcgacctagttccacatcattttattttggagctataggacattaggagaaaacaaaaggaaaaggaaggagcattaacaaaatgacattttatttttcacaaagctggatggacatatatcaaaatgatctccattattatgtaattaataacgcggaagcaagtttgtatgtcccaaacatactagtccttgcattaaaaatgaaattagacatgtggccgaactctaggatgcagtttacaagccacatctttttcttgacacccctgatcgaatccttgacgtggttctgtatgtgtcgtttttcttcctatatcctcccattcatatagcgatgcctaccactttagaagagaacttggggattgaaacatattgactaatcgcgtagggcaatatactgtgtacaacagatagaaaatgacgaaaatacacctgcacactattacatttaatatcttagcacttgaagcttgctgcgagttcattgtagtagcatactagcatggatgcgtcgagaatttgagatgcggtatatatagagtagttctgtacggaagaaaatcaaatcagatgatggcgttttaattctccacgcaacttttcagtgtgttcacaagaattaacagagaaaaatgataatcggtattgaagatcatatgattgagggaccagaaaatcctgtgtatttttgttgtgaagagcaaggcattgaagacaaccatatttttcatatattagatgtgcgttaattttcgaagataaccaacccaacaacacaaattaaggactattcatgcaaaatttatcttttttggtatattgatgtaaaattaccataaaattctgcttcagccctcgcatgggctgcagga

SEQ ID NO: 25382 - DNA, 5126 bp, Oryza sativa
  unsure (1)..(5126): unsure at all n locations
atccgttcggccggccagaatagaagaagatagaggtgggttttgtttggggatttttagtgaagttgtagattatttatatttttgttgcactttgttccattaagttgtttcgttctgttttgattcattgttgcattcatcgatttttggtgttgcaatccgaatgttcaactattgattttggttgaaataattttgcttaagaactgaaacattttttctctcctagtgaaactttttgactctgaatacatcgattttttgtgttgcaataagtatgttctactattgatttgggtaaaacaattttggtcaagcactgaaacattttttctttggtagtgaaacatttttggaacattttttattgaaaattttttttaacagaagatgaaacatataaaacatctctcaataacacggtgcaacaccgtccaacaatcttcacaggatcggacgtaagatcagtagcagcctccgtaaaatgctccattgaatcgctataacgcaaaagtagaaaataaatgactttgcaaacaatccgtgtaaacaagcagactcggttgacagtaacctacactagaattgagaagcgatttaatcgatatacgattaattaggtgatgcaaccattgcagtgacttgtttagtaatgaaaaccatggaaatcgtgttagcaaaaaaaattcctaaataacaaattcgggaaagaggttaaaaaaatatgtagaaaattagtttcgtacttcttgacaaccatagctgaggactgtggtggcctacaggtaggggagacagggttatctcaagggccccgttacgatgctctctacctatagttgaaaaaaatatgaattattgatcttatttatttagagggttcagatatatttatactatcgcattaagagcaaggtcaatagtgcagcccactactagcttcaaatcatctataatcaatataatagccaattcatacaagttgcttactatactattaatatatggacccgcctgtcatacacatattacatcttggagtccgtgctgcagctggctacagatctgtagcccgctgtatttctctctcttcttttatctctttaaaatatgtttataactagcttatagcctgccatatgtacatggtacctgcaaagcatgtatagccattacacgtgatgaaagaactgattatatatgtatagaagcccacaagccttttaaaattagtagctaggagatacccaaaaatactgtcagtacttgcgccacaatcagaaagcatcagcacctttgaaaccgcgtgatttctctcgaaggcctatgctgtcctaagcaattggtgtctctaggatgctattaattaattaatcaagttattttatgttatgaaaatagatgcacaacggagacacgaattttacgtggaaaacccttacgggaaaaaaaacacgggcgccaatcggcaatgatcactatagaggagttgattattaacgtaggggaatcacaatgggaacgtcaccccttcccgtacggcttacaagagtatatatagggaataaaagaaagatacctaataggatagatatgaagtcctactaggaaactaatccaaatatattgtggccccaaaattcagatcacatatttaacaatctccaccttgagacgaatttcctcttgtaacatgaaaaacttcaaacaccaaaaatacctcatgtaggtaaaatcaccgcgcgccaaatggtctctaggactatactgtaacaccaaccaagcttgagcaaagctcaaacttagtagcagtaactggctttgtcatcatatcagctgggttatcatacgtacttctcttgcataccttgacatcaccttcagcaatcacacctcgaataaagtgatatctcacatcaatatgctttgttctctcatgaaacatctgatcctttgtaaggcatattgcactttgactattacaaaatatatcaacacaagacgtaactccacaaagctcagtgtacaaacctctaagccaaatagcttctttacaagcttcagaaatagccatatactctgcttcagtagtagataaggcaacagtggcttgcaaacttgccttccaactaacggcacatcctccaatagtgaaaatataacctgtaagcgatcttctcctatccaaatctccagcaaaatctgaatccacataaccaacaagtccatctgtagatatcccaaactgcaaacaagcactagatgtaccacgtaggtatctgaaaatccattgaacaactttccaatgctctttgccaggattagccatgtatctactgacaacactcaatgcatgtgataattcaggacgagaatataccatggcatacataagtgaaccaactgcacttgaatatggaactctagacatgtactcaatatcataatctgactgtggacataaatctgaaaataatctgaaatgtgcagctaaaggagtactcactggttttgcatcatgcatattgaaatgatgaagaacttttttcaatataacctttctaactaagatataacttgccagaatgtctttctctagtaatttccataccgagaattttcttcgctgcacccaaatccttcatctcaaattcactactcaattgtgccttcaactttgctatctctgatttgtcttttgcagcaatcaacatatcatcgacataacgaagcaaatatatagctgaaccatcaacaactttgagataaacacagctattataattggatcttctaaacttctgagaaagcatgaaagagtcaaatctcttataccattgtctaggtgactgctttaacctataaagagatttcttcaacctacagactaggttctcttttctaggaacaacaaaaccttcaggttgctccataaaaatgtcctcttctaactccctatgtaaaaatgcagttttaacatccatttactctagttcataatcatgcattgcaacaatactgagtaaagtgcgaattgaactatgcttcacaacaggggaaaagacatcattaaaatcaatacctggaatctggctataacctttagcaactaaccttgctttgtaccttgcctcatcacttggagatataccttcctttcttttgaagatccacttgcaacggataggtttcttctcctttggtaacttcatcaattcccaagtatgattcatttcaagtgactccatctcatcatgcatagtagttatccatctattgcaatcatcagaaacaatagcctcagaatatgtagaaggttcggtattaccttcaatttcttccgccacactcaaagcataagcaactatattcgcttcttcaatatatctttgaggaggtttagtatttcttttgggctaatcttttgcaatagaacgttttgaagactactgaacagtagaagaatctgaatcttcaaaaacaggtgcatcttggttaatagcaccatcttctttttctggtgcatgccctgaactaatcaagtgctccacctgcacacntgctttctcctgactctcaacaggaacattagtagaaggtttgtcatgtaacataactgattcatggaagacaacatttcttctaatcacaacctttttagtttcaagacaccataacttatagcctttcacaccagatggataaccaagaaaaatgcacttaatagctctaggctccaatttaccattattaacatgagcataagcagtacaaccaaatactcttaggtctgaataatttgcgggggaaccagaccatacctcaattggagtcttcttatcaatggcataactgggtgatcgattgataagataacaagcagtggaaacggcttccgcccaaaactgtttaggcaaacctgcattagacaacatacaacgggcctttgatataattatcctgttcatacggttcagctacgctggttttgtagagtgtgtgaggaacggtgtagtgacgcacaatgccttcagacttgcaatatgatttaaatatcttagaacataactccatcccattgtcagtacgaaggattttcaccttcctttcagtttgtcttccaaccattgttttccactctttaaacacatcaaaagcttgatatttgtgcttcaagaaataaggccaaacttttcgctaataatcatcaacgagatagtcatcatgtaacgagcacctccgaaagatgtcttacgagcatgcccccataaattagaatgcacataatcaagaataccttcagcagtatgtgtagatgtgttgaacttcacccttttatgcttgccaaagatgcaaagctcacaaaatttgagcttcccgatgctttgtccatctagcaatcctcgcttgctcaattctgccaaaccattttcgctcatatgcccaaaacgcatatgccaaagattagtagcatcggaattagataatgaatcagaaactgctgcaacattacctaatatagttgtaccccgcagatagtacaggttggcagatttaatatcagctttcatcacaacaagagagcctttagttaccttcaaaattccgtctccaccggaatatttgtaccctttgcgatcaagagtacataaagatatgagacttctcttcaaatttggaatatgccgcacatctgacaatgttctgatacagccatcaaacatcttgatctgaactgttccaatacctgctaccttgcatggtgtattatcacccatcaaaacagtaccaccttggatagcttcataggtggcaaaccaatccctattcgggcacatgtgataggtgcatgtagtatcaagaatccactggtcactagtttgtgcacaaccagcataagcaacaagcaattctacatcagacttctcatcagtaacaactgcggctttaccttttggtatatactttccgggtcttttgtctttgtcctgtaacttccaacactcagagatatcatgtccatctctcttgcaggatttgcatgacttatacctggctctggactttgatctcccatggtagctacttgagcttttatctcttgattgggtctctctgttctt

SEQ ID NO: 25383 - DNA, 8793 bp, Oryza sativa
ctgttggacatcccacggagagcaagtggttgaaatggaagaagatgaagtgaaagacgacaatattttggattttgctcagtacgctggatttgaaggaaatcaaacggatgaggaggaaagggatgctgatggtaacgacgttgcagatgatcttggtcagatgttgcaggacgccaaggaggactgtgaaagtgaaaagggggcccataaattggacaagatgttagaggaccacagaacgtcgttgtacccaggttgcgagcaggggcacaaaaaattggataccactctggagttcttgcaatggaagacaaaaaatggtgttagtgacaaggcatttggcgatttattgaaactcgtcaagaacattcttccggagggaaacaaattgcccgagacaacgtatgaggctaagaagatagtctgccctctaggactggaagttcagaagattcacgcatgtccgaatgattgtatcctatatcgcggtgaggagtacgaaaacctagaagcatgccttgtttgttaagcactaagatacaagatttgacgagatgatccagaagaagttgacgggcagctaacgaagaagagaattcctgctaaggtgatgtggtatttccctataatactacggctaaggcgtttgttcagtaacaaagggaatgctagaatgatgcgttagcacgctgaagagcgtcaataggatgggatgctgagacaccccgccgatggttcgcagtggcgaaacatcgacagaaaatttaaagactttggaaagaacgcacgaaacatacggtttggtttaagtacggatggcatgaatccttttggagagatgagcagcggccatagcacttggcccgttacgatgtgtatctacaacctccccccttggctatgcatgaagaggaagtacataatgatgccgattattactcaaggccccaagcaacctggtaacgacatcgatgtgtacctaagaccactagtcgaagatcttaaactgctgtggaagaaggaaggagtccctgtgtgggacgaggacaaacaggaggagtttaacccacgagcgctgttgttcgtaaccatcaacgattagcctgcacttaccaatctttccgggcagtccaacaaggggtacaaggcttgcactcactgtatggatgaaacagaaagtacgtatcttaagcactgtaggaaggttgtgtacatgcgtcatcatcgattccttgctgcaaaccacctggtacggaagaaaggcaagcactttgaacataaggcggaccaccgtacgaagcctaaacatcgcagcgggaaaacagtgtttgctatggtgaaagatcttaaagtagtgtttggaaaggggcctggaagccagcctatagagagcgaagatggtcacgcagcgatgtggaaaaagaactctatattttggaacttaccctattgggaattcttggacgtcagccatgccatcgacatgatgcaccttactaagaacctttgcgtaaaccttcttggcttcctaggtgtatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcatgaatgtaccgtttggatactccatgaatataaagcgaataataagcacaaaggagataaagttcacaaacctaaagtctcatgactgtcatgtgttgatgacacagctgctaccagttataataaggggtatccttcaagacaatgtccgagcaacaataacaaagctatgtgctttcatgaacgcaatttcgtagaaggtcatcgatctggatagattagaagcccttcagaatgatgtggtgcaatgtcttgttagccttgagttgataattccacattcatttttcaatataatgacgtgtctgctttgcaccttgtcaaagagatcggtattctcagccctgtgtacctacacaacatgtttcctttcgagaggtacatgggtgttctgaagaaatatgttcataaccgtgctcgtccagaggcaagcatcgccaaggggtatgaaacagaggaggtcattgaattctgcgtagaatttattgaagaccttcgcccaatcggtacccgaatcacgccatgaagagagactacggggaaaagggactctcggaaggaaagcaataatgacggtagacaacaatttatttcgtaaagcccatttcacggttctgcaacaatcttcattggtggctccttacattgaggagcacttggctctagttcgtgccagaaacatcggtaagtccgatgcatggattacacggcatcacattgatactttctccgcttggctgcgacaacatctcatgggtaacgagacgattaaccaacaaccagccttcctagcgaggggaccatctggctcgatcacgacaatccaaggatatgaaatcaatgggtacacattctacacgagagcctaagacctgaagagcacgaaccagaacagtcctgttcgtattgatgccatgggacacgatggtacaactggcacgtattatagtaccatcgaggacatatgggaacttgactatggacctctcaaggtccctctgttccggtgccaatgggttaggttgcctggtggaggcgtaacgattgatgacagtgggatgacaacggttgaccttaacaaggttggatactcggacgaaccttttgtccttgccaatgatgtaacgcaagttttttacgtcaaggacatgtctagcaaaggaaaaaggggcaaagggcctgacgagccgaagcaccacatggttctcccaagaaaaagaaaaatcgtcggagtagaggacaagactgacgaggattacgatcagtttgatgggcaaccccctttcacggtgacgattgaccctagcatcctcctatcaaatgacgacattccttactcacgtagcgatcacaagaaagaaacaatagtgaggagaaaatatgtgcggtcaaccgtcaccggcgatgtattgccgtaattgttgtgtacacgatgtaaactattttggatgtattgaatatccatacaaatcaattgttgtatggcatatgttaattatgtatgatcattacaatttttatcaaattgaaatcatctatatgctagttatatatgattattagaatttttaaaagttttaaatcatgcatgaggtatttacatatgtaattagaatttttaacaatttaatatcatgcatatgctaattatatatgattattagaatttttattaattttaaatcatgcatgtggtatttacatatgttaattagaatttttaacaatttaatatcatgcatatgctaattatatatgattattagaatttttaacaattttaaatcattcgtgtgcttattacatattatccacttagtttactacatacaacaataatttttcgaaggttttgtcattaatttttcgactttaaataattgtaatgcattatttactattttagaaacacatatgtaatgaaattcgaaattcagtgctattatctttagtcccagttcttaaccctaaccgggtttaaaaagaatttggaaatagcgggaagatatctttgctcccggatgttctcaccaaccgggactaaagatctaggggtataaatattcccggtacgtcctcgtcttctccaccaacacttagaagtttttcctccaatcgatctcggcttctccttcgccgccactgcctagggaaaccccgcaccaacgccgccatcatctctcaccgtcgtctcgcggtcctcgtcgcctccaccgccgacgcatctcttgggtgagagccgcgctgcctctctctctcgatctcgatctctctctctctcgaaaccgccgctgcctatagctcattgccgacgctgccgcacgcggccgaccccgaccccgactccgcctcccgccgattccgaccccgacttcgacgcggctgccaccgctgacgacataacgtccacgcaactgccacggcgacgatgcgacacgccctgccacgccgccttgagctcgccacgccgtcgcgccacaccgccgcgacgccacgccgccgccgcggcatgccgccgggtcgcccgacgccgccggaacgcgcgccccgacaccgccgcgacacgccgccaccgcgccgccacgccgccgctccgctgccgccactgccgcgcgccccgacattgccgaacgtgaacgaatgtgaacgaacgtgattgaaacgtgaacgaacacgaacgaacgtgaacgaaacgtgaacgaacacttaacgaacgtgaacaaaacgtgaacgaatgtgaacgaaacgtgaacgaacgcgaacgaacgtgaacgaaacgcgaacgaacgtgaatgcacttgtactaaaagtgtgagaacgaacgcgagcatatatgattattatacgattattaaacttagcatataatatgattatatatatatagttgaaaacgtgaaatacaatatatgttcctttgcatttagactaatacattttcctggtaatgttgtagagaagacgtcgtcgtcgtccctcaagctgaagttgtagctagccatcgaaggaattcgcgcaggcaagtgatgtaaagaagtgattgttagagatttaatataagattattagagttttaatataagattattagattattagcatatgtgagtgttagattattagacttagcatatgtgagtgttagagattcgtgatagacttagcatattgtattagacttagcaaatgtgagtgtcagagattattatattattagacttagcaaatgtgagggttagagattattagattattagattgttagacttagcatatatatattattattacaattttaatataagattagtagcgatttaatataagactgttagacttagcatatatgattattacaattttaatataagattagtagcgatttaatataagattgttagacttagcatatatgattattacaattttaatataagattagtagagatttaatataagattgttagacttagcatatatgattattacaattttaatataagattagtagagatttaatataaaattgttcgacttagcatacatgattattacaattttaatataagtttagtaaagatttaatataagatcgttagacttagcatatatgattattacaattttaatataagattactagcgatttaatataagattagtagagttttaatattacgcttagcaaatatgacaaatagacttagcaaatatttcttgtatgaacagatggctgatcgcgatgaggaacatatactgtacgatacaatcgcagagggaagcagccagtattggaacgaagaagaggggaacgaggatccaaaccagtacttgaacgaggagaggaacatggagagggatgcggaggggaacgaggaggggaacgaggaggaggaggctagtggaagtcatccctccgctggacagaagagggcacgcggacaacgaggtgccatgaagaagatagagggtcggcacatcataactgaggtggacgaagacggccgaccaagtgccccggcagaagcagccaagaattttgtatgccacagcggttgggttgtgagggataacgtgcctgtcagcatggtgtactggcgcagaacaagggcacgagggggtaatgacagctttgtctcggaatcagagaaagagatgctgtggaccacaatgctcgagacgttcacgctccctgcgggtacggagaacatagtgaaacagtggactcttaagaaaatggctaaacagttccagagcttcaagggagatctctacaagaaatacatcctgaagggactaataccgaacttcgacgtattcccaaagctaagagattattgggacgagtttgttgcttagaagacagggcaacaagggcaagcgatgatggttagaaacaaagaaaatgccaccaagaagaagtaccatcaccacttggggtgaggcggctatagcatcgcaatgccgaagtgggaggagatggaggcaagattgattgagaggggtatcgaaccggccaccgctaaatggccggatcgatcgaagttctggtactatactcacggtggaacgcttaacccagttgatggctcccttgtcttcagcgatcagatacgagggaaaggcgtgattccctggaagattggattcaaggaggacatccacacgtacaggagtcggatgaggagcaagagagataccgaggtgaagattgcaaatcttcagaacagggtatcgagttacgagctcagcatgcaagaggaggtggcaaggaagatggatgaatgcatggccgcacatcggtcccaggatccccagccgtacattcctcctgcaatggtcagcccattaggcaatcatagtagttgcgcctcaacggggtaggtaggatcacagagcatggacgccatgcaaacccaggacgaaaccacttgccccgttgatgagatcacgcaacggacaccatgtgagctacatattcccttcaagaacttatcaatcaaggtatgctcatagttttatgatttttgacttgtacattccgcaagttgctgcttaggttgattactaatagataacctctcatcacatgaaggtggcgtcgggaatggccatcccaacgaacatttcagggacttaccactgcaggccgattccagcaggatactcgagggtcgaagttgaactggtggaagccgcgtacaaggacctcgagttggactacctaggaggagacggtgagacgcatctatgaaacacaagccatgccattatactatggcgcaagcggtacatcatcctccttgggcgacaagcgacgtctcgtgcaccatctcctctggctccgccatctcctcctgcaccatctcctccggttcctccgccaagtcctcctgcaaaatctcctccggctcatccgccacctcctcctgcaccatctcctccggctcctccgcctcctccacctccaccgtgtcctcctgcacctcccaagacaaggtctcgccaagctccaccgtctacccgcacaagggcaacgaagaaggcgaaagttgacgccaccaaaaacaaggagccgtcgtacgattacagttaagaggagcttgatgcttatgtggcaggagaagtgaagaggcaactcaagcctcggagtcctgaaaagaagatacctattgacccgagcgtgaagaacttcttcaagggaatgcccacaacaaataaggaggcgttaaagatatcggactatgaccgaacacttcagaaagcctatcacaagaagtccaaaccagtcccttagcttggagaacaaccaaaccaagaggtcaagccgttggtgaccggcgaagattttggcataacggtgtaactgtggatcagctgattggaggcacaccaatcccgaaggcggaagtagcatacaagtttgagctcggtaaaccgcttgtcacgcctgagcagcagcagtccctaccgacacagatgtacaaattccatgaatggtacatggaaatgagcgccaagggtagagagatgttcggagcgaggattagaaactccgacttcttgcaaggaggagatgttctctggatccatttcaaggatgtcttcgatctgtaccatctagacgccctcgtcgtctctcttctgagcgcatggatttcgtaagtatctttgagttcgatttgtttcgttcaataactagctccttgcatatatgtaaacaataataatttcattttttcgttgtagaatggagattcaaagggcccgacggcggggggcttacgatactaggttcatcgaccctcgaaaaatcaacaccgaaatgatcgacaagtacgagaaagtcacagaggacaatctcgtccatctcctaacgccgcagcatttcaagacgttcatactactgccgtacaatccagagtgagtttttattgtcgttcgaacaaatttcattcccatacatatagcatgtacattttcatatatatctcatctcacgcatattccagattccactggtcctgttattctttgacttggacgcatgcagagtcactgtgtatgactcaatgaataaagaggagaagatttttgacaaggtcttccaaccgatagacaggtaatataatgccatctattccaaagtcgcggggattctattgctattatgttgatctcgggtaataattaattaatcatagcttgtagctgcatatgtagggcttgggatcgattccgtcaattggtccgcgggacttggaaagaaaaacttggacggaggtttcattttccagtgagtacatgcatgatccaaaattatattgaattgaatctctaattacagttaatataaagagtatattaaatctcccatcatttctcatgtagtgtgcaaagcaggacaagggaactaacttatgcggctactacgtatgcgagtatgccaactgcctatcaaaccaaatatgcaccagacaagagctcgatgtacgtatacataaaccattcaaaatttcattgcgtatcgatttgttaagttgtttattaatttcatatattgatatttcattatttttcgaat

SEQ ID NO: 25384 - DNA, 1220 bp, Oryza sativa
agtgggtaatgatgtggcacattgcatgttgagttgtagtttgtggccatcaacttttatagtaagataagataaaattggtcatttaaaaaaaaagattggatttgttgttagaggaggaaacacacttacggtagtggtaagatgggctttaaaacaggcccatgaggttaattaaactttatagtgtatgaccacggtaatacgatctaattaatcaatggtcatatctttctaattaacatgagagcttatacaaaatacccaattaatattgttagatagatagacaaatcgatcaatcacactagccacttagtcgtgtgttgcacgattttgggtgcatatataaaagcctagtatatacaatagtgagattgtgcattaattttttttttacaaaatcaaagaacttgataaaaaatagttagaaaaataaaacatagaaaattatgtttcaactaaaggttcaaatatcatgtccgagatatactgtatgcgatcaagagatgagaacatgtttactcagcaatctgattcataagtctcagaatggtcaaatagaatgcaataaacatcatgtccttatcatttgaaaccaacacgaggtcatttgacctctgagtatcacaagatgataacataataaacattccgaaatgattcttccccctgaaatgcaaaaatatgcaagtgcacttgaagttactgttttggaacagaaaaaatgaatgattaattcttatgagatatgaaagattccatttaatgttcttattatctgaaaatgtatgtagttcaaataaattgtagtctcacatcaagtatgctcattgagttatcatgacaatagaatcacagttgcaagcctacaatcctttatgacatatcccttctttctataaagttagtcccaaagctgaaaccacagcattccacgtcatcactaattctcagccattcgatcggtggatcagatcgcatatgaaccgttggatgagaaggtcccaggtgagatgttgagtcattggacagctcgcctcctcaacgtgcgcaccagcgcaacatcaggaaactgctggcggcatctcaaacgctcggcatgaatggcatgaatagctttaaacatcttcctccatcatggatactattatctttttcactacacaatgttaacagtggtaacaatgttagaacaaattgtttacacccaaatttgg

SEQ ID NO: 25385 - DNA, 644 bp, Oryza sativa
cagatcattactacaggtaatatagctcctatcagaaagatcaatactattttcctttagttaatgttcaatggtttgccctgttatagatttcattccactttattttctagtcaaaataatcagacagtatgcacacactgcagagaatggagaaaaggtcaacaattttccattattaaaaattgagaatcatggtttttgttctcctcgcgataatacgaaactaaattgtgtttcatggatggaagacaaacatttcgtggagttcaccaagcagtttcacagcaagactggaccctagctctcccagacagagtattcctcctgttggtgttgcaagctcgatcaatcttcaaattgtttattaaacgaagtctcttatttcctagttgtaaatgaagtgctgcacttagaactgttctaccacaactccaggtaatcaacttgtgaacagaaggaaacttggcatatggcagagtcagcctcgatttgttgttttgaatctccaggctaaaatcattgctgttcaagaggttttctacccattacgggatattgtcgatccagtcctgtttttcttcctgaagcctctggttcctatggcaatttcttcctcaaaattacaagtgaattaatctttg

SEQ ID NO: 25386 - DNA, 3196 bp, Oryza sativa
ggattctgaaatttttatactcgggaaaaccacagtactcccattcttgaaattcaacttaactcatttaaatatctagagaatctagatagagaattacttatatggatgcggtcctccggacaatacatctcatcatgaaaacgaaatacattcaaatttgaacaaatatatactcgatgtatattatattatcctttactatcataatttccaataacgttaaaaatcatattagatggctgtggcaattcagatctagcaactaaattcttctctaaacagttcaattgacaaagattttcaaattgaatatagccccatgtatttgaagaagataacgatttaagctcttcattctctctaaaaatgtgaataacatgtttaaactcaatatatggtggttcaagcatagaattaacatgttcatttactagttgtggcatggatataagtgaagcatcacacatctcttcttcgtcgttacctaaaacaacaagcaaatttttttgtgataaagatattttagtaattgttttcactattggatactctaatatagcgtaagtagtggacatatttagcgcatcataactatgcataccttgagtaaatgtagcatcactatcattaccattatcattatcgattgtaacatgatatgctctatcgttaaccataaacctatttaaaataaattgtggcaatgcttttgctctgctttctcgatttgaaaatttagcactttttgcaccaaaattcttacattaacttcaattgtagaaggtgacataccaactgtggtttgtctcccatccaacattatctcgtgtcgatgagtgatataacctgccgttgttagtagaaaacagtaaacaatacataagaacaagggtgatggaactcgcaaatagaagtgtcttaccgtgctctaacaatgttcttaccagcaaaggtagggatggtacaaccgatgcctgataatgataccttgaggatgtgatctaacaattgcaaggttaaaactgggatgacaaaaaatatgtatgtgtagcttgggggcataatatatagtagcaaggaaaagcatttgtgctaatcagtaaatacaaagttgaataatagttgaaaatactatattgagctctagctcaagtaagcacccgacaacactaaatcctagaaacaactcaaagaacaactttgcactccccaaacatattaaaaagagaaatgttttcttttctttttcttttttattcttttcccttttttgccttttattggtgcggcttgttagcaccattttaccttttctctttttgatctttttttcaattattacttatcaatgaacttcgactagggactcaaaagtaaatatgaatattacagagactcaaatgtaaaagacaaaagttatatagtgactcaactacaatgtaccgtttatgtaaaccaaaatttggtcactgtaaaacataaagactatcatcataacctacgtcggatcgacactaaattgggccaaccaagtggagcaaggtaagccttgacgcgatggaggataacttctctaatctaatctaggtgcacaaacaagcacgataagacagacaaactctaacaatgtaactccaaaactaaccgacataaatttatgcaaactataaaaacaaaaaaccgacaacaacatgttcaattttccatggtcccgacaaaaacagattcttacaaaattggacctaaactcactaacatgaaatactaccgtcaaagtacagactaagcggcaaactcaaacctaaaaatacctgactcaaaacaaaaaattaaatctaaaactaaaccaacactcgacacgatgatgcaacctaaaattcaacaaaacaaaatctaaaagagcaataatttatgttcacaaatataacgcgtaaatctcaaatggaaaatatacaccttcgtttgatgaatacataaggtatccatgattatatttgagctagtgatgtcattatttacttttctagcattttaaaatgggtggaaacagtgagcgcaacttgaagagacaactgtaggctgttgagcgaaagaacagctaacattggcatttgagatacttcgcacagacctccaagctaaaatcattgctcatcaataggttatccctgcgctgagagatattcttgatctagtgctacttttcttaccgatgcctctcattcctatagcaatttcttcctaaactttctaatagcatggattcattgttgtacggttgatgcattgataatttgagatggtgagtgcatcagtgcttgagaggctcgaagctaagtacagcctgcggggttcctgggcacccggctaaaaaagaaaaattagtgcttaacacccttacttaccgtatgggcaccccccttctcccagcttagtgtaccccctacatcagaaaccagaccacaggagacacacgagcggcccataaacacagcatgagttatgttgcagtctgcagttatttatgagtacagctgtatgcacgcatgtctttgtcctttctttttgtccatgagttacattgcagtttgcagtctcctctatcttttcttctccttttctaattctttacaagttaatttgattcattggaagaactccggtgaaagataagttttgaattgtgtgataatagttgtcgttggagagaaaaaaatatatacatgctgtgatgcaatgtaaccatggtaggatagtatgtatagttactgtcttttattttatctaaatattgttgcatgactaaaaatgagatgtgcatttatggagaatttctttaaaaaaaactctggttaatactagaaatgcaaaaaaaagtaagcatattaggcatgataaagctcaaggatgattataattttccagacaaatcgaccatttattttattttttagttaagtatttcagaaattttatggtcaaaacatacaattttgactgaatgtattatcctagacactaaatattcatgactaaaataaaaggaagtattctactcgatattattaacctaactccattgttacttatgttgaaccattgatggtgataatacatgaaaacattataatttactataatatagcttgagaaaaaaatttgctactacagtgctgcaccaaccccccccccc

SEQ ID NO: 25387 - DNA, 5210 bp, Oryza sativa
  unsure (1)..(5210): unsure at all n locations
ccatagagagagagagagagagtaattctgagttgaatgaaatcaaattaggttgaccatggttctgccacattaatattttttcttgtcgtactgcgcattttcatttttatactataacaaaaacttgtttcttctaggttgtctcgaaacagttctcccaccaacgcataattgatgttaagtagtactttctccaattcatattaataagcatataaccaaaaataaaaaaaatccaaatttatcatcacataaccattgtcccttagtttggcgtgtaccattattgcatctatacatgagaattaagtatgcatgtatgcatgcagacatttagggatacttaggctattcctaacccaataattaggatgatgtccatagcattaaataagctgccacctagaatgaaaaaggatgtggcaagtgaataaatgaggaaagagaagaaaaccatgtcttgcctaacagatggtttctacacaacatccaagacatcatgtgagataagtagcattaaatttatgtcggtgacatgggaccgggagtatcatgactagaggcttgaggcagacacaatcgcctacgtggcctggcaccctcggggggcgtcgggcccgagggtgatgtgttcgccctcctctttatctccccgagggggtcggaccgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtctatccggtctgtgaccagtcacagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgagcatgcagattgttaaactgacacgtggtggacaagaatgaccgatttgagaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggggggaggaaaaaggatcccagaacaatcgggggctggctcacactttgtagcttcttcatacacagatccaccaaaacacaggagtagggtattacgcttctcagcggcccgaacctgtatacatcgcccgtgtcttgtgtgtttccactctcgcgaactttccacagaccaggagcttagaatctcacccagggcccccggccgaaccggcaaaggggggcctgcgcggtctcccggtgaggagccccaagctccgtcatctggcgcgccaggtagggggctctgcgagtgatcttctgagctctcgcactctttcgtgtgtgccaagcttttcctgttcagcccaatggccgaacaagcaaaggcgcacaacctctctccgagcgttagcggtgacgatggggagccaaacccacgccgtcgagctcgtactccaccgccccctccacgccaaagtcctaggcgggaggaggcgctcgagagggtccaaggatccgcgacttcgacgtccacgggtgatggggaagggcggccagatggggagcgtcgcctcctcgtctacggcgacggcagcacgccccagggcgcgctccaagctgcgggcgtgctcctacgtcacccgcccgttgtccctgacccggagtctccagcccaacgttggctggacgacgtggccaacttggtcatgacggcacggcagcgcctaggtgctggtgggcggtcctccgccaccaagacctctcgcgctgctaccaccggctccgtgtcgtcaaggcggagggcgcggcgagcggcggctgttgctcgccattcggccgccactccttcgtcagcgccttcgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcatttgtggcgagccttcggaacgtccgttggcccccaaggttctggcccaccatcgccgaaaaatatgacgggagcgtcaaccccgccgagtttctccaggtctacacgaccgggatcgaggccgccgggggtgacgacagggtcatggcgaatttctttcccatggccctgaagggacagacacggggttggctaatgaacttgccacccgcgtccgtccactcttgggaggatttgtgccaacagttcaccatgaactttcaaggcacatatccgcgcccaggtgaagaagcggacctgcacgcagtacagcgaagggatgatgagtcacttcgctcgtacattcagcggttctgtcaagtccgcaacaccataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcagggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaaacagaaggcccccgccgaggacatcgatgacggcaatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgtggtggtcggaggttgccctcaccttcaaccagaccgaccacccatcgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtcttccctacaacgcggtcctagggaggcccgcgttggtgaagttcatggcggcagtccactacgcctacctccagatgaagatgccgggccccggtggccccatctctgtccatggcgaccttaaagtcgcgcttgcttgtatggagcagcgcgcggaccacctcaccgccgcgtccaacccgagggaggcgacgagaggcttggcacctccgcccccgcccccccgaggcagcggatagtcacatgcgacgaggtcccggtcaaggaggttgccctgggcgacggcccgtccaagaccacacggatcggtggtcttctggatggcaaataggaacacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattaattacccccataggaacttattgttatacgacaatgcccttcgggttaaagaatgcaggtcctacttttcaacgtactactcgaatttctttgggtagccaaataggacgtaatgttgaggcttatgtcaatgacttggttgtaaagacgcgcaaccaagagaccttactctcggatctagcggaaacttttgagagtctccgctccgcccgcataaaactgaaccccgataagtgcgtgttcggtgtacctgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25388 - DNA, 25061 bp, Oryza sativa
tgtggaacacacagtagttttcgttctagattcacccttatttacatacatgtaaagagtgtaacgacaatcaatgctgacacctattaacaattgttatctacccaattagaatatgtcttaattatattcatctcatgactctgactatctttgatcaccttgagtagtagaaaaaattaattgtactacgggtttaggatgggcgaaactaatggattatttgatttttatgatatctatttgagggtataaatgaatgaattaacttctacaaatttgaaatgttgttctggaaaaagcgctttaagaaaaaaaaatagaattgttttcctgaaacacatcatttaggaacatgggaaacatgcaaatgaaaatacaaaatctagatcgaaaggaaaaacagggagtaagactcaacccttagttttagcttacatagagttgcatgttgcaaaaacttaacccactggacttcattattttccttctgcaatagtcgttcaatttgttttcactttattaacaaaacaatcattatccattgatgatttgatgtgtcctcaccttggcaaactggtacggtgtggtgatcatgatcaccttagttgcctcaatctggtgctccgcattgtcgtggcgcacgcatgcatgtgttgtgcagaggaacggagtgatgtttttagaggctttattgtgtttagaaaaatagttctgatggtttattatctatcagtttaaatgaaaatcgatagccaaatattttagcaacaatatagtctcaaatattgggtccagttgttggtttaggtataaattagtcgatatagattataaattgttaatttaataggtataaaatataatggtgtaaaattcaaacaattttttatttgaaaaaaattagtccaccagtttaagtaaaaaaatttatcttatattattaatttaatgggttaaaagtatattttttaaaactttacatttaaacattgtagagctaatttttagttatatttatttgtaaagagttaatttatgatgatatatatagtctatgtttgtaaaattataattatttcaaatttattatcactaatataactgttttctcacatgtacatggagaaaggtggaaaggagagagaagcagatgtatttttttaattgatgtatataatttttgtttttatgttttttgtctttaatcttcttttattgatagtgcgttacttacgtactttgtattttgggttttttttttacgatcagtactttcgtgaacaggagattataagatggtagttttttaaatagatctaatctaacggtaaataacggatcaccgatttaagtgaaaaatcgaggattaggtgttttgcctttctcttagaatttgtaggaatttctttaatttattaagtgccacatgacggtttaaaagcatttgtataaaatttaataaacttttagtatgtaatagacaatagatagataaatagataattgaaatatagaatgttaaagagtgttgattggatatcttatatacgatctagtttaaccgcatatatttatagagcgatatattttatttttaaatagtaggaaatcctactttaaagcccatcagattttttaatgacactacgtacgtattttttttctttattttatcgcttttatacttagttttttcttctcatccggtgaagagtagataattaagcttcatcgtttttatttccgatgtacgtacgtactgaatactttcctttttcttttccgtcccacatgcggaaactattactttttaaaataatacatctaatcgaatggtctataatattgggtccaccaattttaatgaaaattaacggtgagattaaatagtgccacgtggcgatataggagtgtttgtaggagcgccacatggcggcttaagagtgtttgtaggaaatctaatagacttttagtatataatagatagatagatagatagattgatagatctctgtaccgaatctcctaaacctattgacaactcctggaccacaaatacgccgccatcactatatattggatcggcctcatcagcaaagcaatcctctgcctcttttgtacctaccatggccgaaccatcacgttgctccaactttgtgcacagttttattcatgagacaacctatgagaccaccctctcgctatacgccattgctaccggagacatgcatatatactagtggtcagccctgtcacgtgtggatccaaacaatgatgtttacacagtactaccaaaacacacgcatgcaccatgtcaatacattactactaccatgcagttcggcacaaacacaaacgatagacggcgccgaattgatcccctacagactagaagtactccaaatcaccatttgacagcatcggcttctgtattatcataacctttcacctattaacctaataaccagatgtctgttgttccaaataattaacatgccttaaagtttctagcaatttaactaaacctaaacattggtccaaatgactgtttaacaatccatcaaaacactaaaacttcccattaatttattggactattaaaaataaatcaccaaaggctacatccctcacacccatatagaccaaactctacaaaccgaatataaaggcttatacttggcctaaaagtgcaaggatactttaaacagactgaaagggaccgatgtgtcataagcaatattaagcacctagcccaggaggaagatcgaccatgaggggcagcaggatgagcctggtcggggcagcgatgctggcgcagctctacgtggtcgcctcctttcaaggcgcctctggggctaccagcgatggccctccctccagcagtggggcgaggactcccacctccggtgggagccctggtggtagtggtacaaggagctcagcagcatctacaagctctgcaagagccggaagcacccctgcaggagtgcgggggagccccgcgggagctggtggtagccccggcggtggaagcggaagcacccctgtaggaggagggaggagctttgcgggaggtgggagtgccgacgacggcgacgatggaactgggatctcaagcagtgggggaaggatgttaagtagatcgtatgatgttgagcactttttcatttacttcatgcttgttgttttagctgcattttagcaaaaaaaaaattcttattctcaacatgcatatgtatccagtgcgcggaaacagtgaggggccatcaacggtcactcgcattcccaagttcctgtaaaaataaaccatcactacttaaaaaaccctcatagcgactggctcagaggtgtcagtttatttacaactggcacctattaaccttttcctatctattgtgggataaaaaatagagaaccgaatcctttgaacaacgataggtgtcggttctaaagaaaaaccgacatatagactattggtgcccttttactacacattgtctacatcaagatgaactctggtgtcccccgtgctctccttcgcacacttgcccattcttgttggcagtgtcaaatatcgaacccagatagtttacaccacagaagtgagaatttatcctcggctatacctctacatgggttagctgctgctccttccgatggacaataggacaataacattggagatcacaagttgtagatagtactttctgcttgaactgctcatccagcctccattagtggatttgtgttggatttgatacagagtacctagctaggtgtttcgtttacttcctatacgcctcccattcttatcacaatcacatctgatatacgagttggagctgatcatagttgtagcgagatcgatgatcgagaatgatttagaactttgaggtgccgaatgttgggtcctaatgaagtgccattcatagagtatataataaatgtagtattgttacactcacacgtacaagctagtgtgtctaagagctttgctgcacaggttcggtttccccttccctcctcatcttcccttctcatcttctttctctccctcactctctctctccccttcatcttccttctctccctcctcactctctccctcacagatcgggccgtggccccctcccgagcgccggccgctgatgcctccccgcctcccgaccgttggcagccgccgcctccccgcccaccaccggatctggcctacgacgcacagattcggccaccgcggcctctcccccgaccgtcagccgcttccttctccagcaccacatcaccaaccgccggatccggccaccgcagcctctcccccgaccgtcggccacttcctcctccgccaccccaccgccaaccacggatccggccaccgtgacttctccctcgaccgtcggccgcttcttcctgcgctacagcaccgccaaccgccggatccggccaccacgacctctcctcccaccgtcggccgcttcctcctctgccactgcactgccaaccgccagatcctgccttgacaagtttcctacaccaccgcaccgccgccagatggagttatcctttctgatttgtgcccagatgaatatgattgtgatgatttttctgattctgttttgtgcccaaatgattgtgaatgtggagtgattttgttctttggctagatcaatgtgattgcgatgatttttgtgattctgtcttgtatcgaaatgactgtgaatgtgattatttttgtgatttgtgatgcctaatggtctgcgactagctaggcttataatattatatttttttgccccattttcctaccagaggaggcgccgctccagcttcgccctcggaggccgaaggctctgctccctcttcgtctatcatctccccctcgctgctgcgttcctttcgcttggcaactctctccttgacaattttctttgatggcatcaatggtttcgctcactctcagtggtttcgctcggaggtccccacgatcagtgctagttgttgtcgaatgcacaactgcgttacgtcgaaaggcgtggttctctcgacagtagttggaagtaaagacaattgtattgcttagtaacaattttttggatccccctatttcatggccttagggggctatttatagccctattactggtccccctttagggtttaggttttacaggggaatttacatggctacccttatgatagggacattatcgggggcacacagtatcctttacttgtatgggcccttattgggctaaatggctcggctcatttacttggcgaagtccttcgaaagcgcaacggcccgctaggcctccttacggcggagatcggtacttggcgaagcccatgccttcgtgccaaggctttcacctcaccatcttcgcccgtgcggccttctgacgaggccttttgcctgcccaagtctgtgtgttccgagccactgctttctccatgtggctttcgcccatatggttccctttttgtccttcgccgcttgcttccggtctgagcgtgtcacctatgttcttggtttcggtaggtccaaccgaagacccttcgtagtgtacctccaacaataagactgcaattttatatttaaaaaaaagaaatatatatttacttataccaaaattacagtgcacttacatgtcatatcaactaaaattacaaatgtaatttttgttatataggactataattttatatttttaaagaaaataacaaatacatatttacttacacattatttttattgcatttacatatcatatcaactaaatttacaaatgtaatttttagttatataggattgtaatattatatttcatgacaacgagagggatggtgttgctagccgaacagcgttggccgtagtgccggcggccagctcgctggtcggaggccaccttcatcatggtgcacgcgtgggctagctgacacaggccgtcagctgctgctcacatcgcaagtggtgcatagcggccaaaaaaaaaagtcaaatgccacagaaaaaatcacacgggagatggatagcaaaatctgttgacaaaaatgtgtctacatttggtttattgccaaactttaataaatacattagaaatcctgccaaaattaataatgtcaaaatttaataaggcttattttggctacaatttgaaccgttcccgttctgctcgatcggcagccacagtccgactttgccgtcgacgaaccatccagccgcacattcacgcacaaccctcccgttgctgaccctgccgcgcaccatccggcgctgcttccttcctgctgtgcaaccctttctgccggtacggtaccaccgtctgccgtgatgccatctcgctgctgggctcgtctcccgcgcgggccgccggttgtgacagtttccagcttgagcacgtcagtctccggcaccatcgtcgcacgacacggccgggcagacgttccactagctcaagctaacataggttggtaaaatggcataggtgttttgctcatgttgacgatgcgaatttctgaagatccatgagttgatttctagtatgtcttctatcaaaagcgctcagtctggatctttgttgaaccctttttcactcgtgtaaaaaaaagtacagttaactttgcatagctcaagctagtcttttttttcctgctctgttaaaatcaatcaaagagcaattgatggcaattgacgctgtagcagatgcaccggatcctgatcacctggcgggcggagtcagtcgcaaatctggacatggtagccgtcgcttgccctgatctgccgctagctgtgaccccagcctgggccctgtcccgtccgtgactgcgctgccgcctccaccgcagcgcgccgtctccgatgactgccgagcccgcggctccaacctacttaaaaaaacgattttttttaagcaatgttggccttttattttttcaagacggtactcctgggtagagtggtgggttttttttgctgagatgattttcgtaggacccgcccacaaaaatcatccattttcgtaggagacagagtagcggcggtccttccctccgtctaaaaaactgatttgggccgcctgatcactacttgattcacaaaccacaccggacaccgccctatagcctcaacactccacgactcatgtccaaattacaacattacccctccactccattactttaatagacgattatacctttctatttttctattgctgtaattaaggtggtactgttaatatatctgacccctttagatttgaaaaaatcaacgattaagaagaattctactactaccagcagagagtaccgtagcgagactctttacattataagtaggaactgtaatgtgtataggaatgggatgattcagcaattagaatagcagtgcagtctgggacaaacatgtcagcaattaaaatagcattgaagagtacattgaacttaggttttttctcttattccctatggttttgtttagctttatttcggctttatatctactaggactgaggcagattgaatctatgcattgacgatcgttttattattgactagtggtagttttgtacatttctatcctgctggtgtgacaataagaaaatatggttgctcaaaattaactgccaataaaaaaattgaaaatggtaaacataaaaatataatagaaaaagtagtgtggcacattatgctttcatcttgattttctataatcaccaactaatttaattgaatggttgagggttttgtttgtcaaagaattgcaacactttttacgtatgacatcgttcaattttttttccgatatgtatactatgaatttctcaagtattatatagagattatagagattatatagagattatagacaaatagaagctggcctaaaaacccatgaattgcgggagctgaagatggtggttgcggcgcgggtgccgaagccaatgatgccacaccagcttcgacgacgggggccaaaggcactaccccctcttcggcggccatctcccctcctgcttcactctcctttcgcttagcaaccttctccttcgcgaccctcttcggtgacattcgctctccgtggtttcgctcagaggtccccacagtcggcgccagctgttgtcgaagcgacaactgcgcacgtcaaaggacgtggttactcaacagtgttggaaacagtgaatatactaattgattaaaatttttctgggaatccccctttacatggcctaggaggctatttattatcctattacaggttccctcattagggtttaggttttacagaggaatttacatggtggcccttatgaaagggacgtttatgtgggtacacagtgtaatttggatacatgggccttctatgggccggctggcgaacgttagcttattggcgggtaggcctaagaggccgggatggcccattgagcttccttggtgtcaaacttgtcaaggcgaagtctccttccttcggcccatatccttcgccatgcaccggatggcctattggacctcctcggtattgagcttgtcaaggcgaagtctacacccttcgcctcatatgactggtcctacgaggtacccacgcggctttctggccttcgtcgtctttgttccacagccttcgccatggaggcttcgctcaggtacactagacgtctttggcttgaatccttacaggtagcatggtttcagcaaatatggttaccggcagcgcgaccttgagtaaatgtccaacagaaatatggtaagcattgacagcttgaggtcaattattgagtacacgaattctacatatatatatgctctgccatgtaatttctattgccctcaaatttttttcaccacctcaaattcccaattcatccaccaccagcactacaacatgtgacaggtgcccacttgcattttagaaatgatcgtaataagcatgggatgctataggaaggaaaaatcaacgactaggttattttcaatctaaagactgataagtagatcgagcagatagatgtagtattagcttccacgtgtcacctcctctactcttgaactatatatgagatcgttggcggtaactagatagagcttgcttacgactttgcctgacttgttggactaaaagtcggcctgtttttgttcatcaaaaacatttcagccctgtacaagttgtatcggtccaattatccaaactgccaacacgaaaagggctggaaatttcgtctgtgcgaaaaatactgagttagataaaggtaaaggaatcaaatttgaaaatatactttgctttttcatattttacatttatatacgtgtctaagattaatttgcaaaaatatagctaatccgcggaacggttgtgtgggagagcgggcaaaccacagactggggatgcgggagcggaacccgagccggtcgcgcagaaccgggatgcgcgaccgagtcggtaccacattaccgatgcgcgggagcgatagcgccctcagccccgcggcggtaccgccgaacggcatcgcgggaccgcgccatccctgtggtcgctgtattattcccccaatttttccaactcatctcctctttccgcgcacgcttttcaaagtgctaaacagtgtattttttgcaaaaagtttctatatgaaagttgcttaaaaaatcatattgatctatttttgaaaaaaattatctaaaaattaattaatcacgtgctaatggactgctccgttttccgtgcggagatgtgttcgctgtttggggaatgatgcatgcgggagagccagtcccgcgcatccggcgtgcgggagagaggtcggtcccgcgcatccattatgcgggagcgcgccagctccaggcatcgcccaaaaaacccaaaaaaaaaccacgttgccgctaacccgtcctgcgggactggcgcggtagcacatcccggccagcgggaccggcttggtcccacatcccagtttcgcggggccggcttggatttcgttccttatccccattatgcgggtcgtcctcgctaccgcgcattcgttctgcggattgggtatatttttacaaattaatctcatgcatgtatataatcacaaaatataaaaaaggtaagtatattttcaaatttttttcttaaagttcaaatctaatgaatgtttatcaccctgctaaacgaattggatagctaaaaagatggaccagtcaaaaaaattctccttcttgacaaactggaggagtacagagacctatctattgaagagttgagtatttatattattgccacgaaaccaaaaggaaggtaatatataattttgaacaaaactaggcatgtaccccacgtaattacacgggcacctctatttttaaaatgttaaattcttttctgatgattaataattattagtaactacacattttataaacaaaacaaagttctcggaggatattcatatatctgtcctacatcacctagtcagttattaaaggcttagctagcaagggaagaaatagaggtcttatttgcatgtatcaagttcgagatataattctaatttctaaacctgagttgttttaaaaatacaaaacaaattactctttaaaagtttattttttctattcttcttaatgacttcaactttttgtcattgttaatagtggtaccggattggttgttcataacatttatagcaatttcgataattttaattaactaaatatgatggttaccagttaatatgaagtttagagttccatgacatatatcattggctggattttcctccgatctgtgacccctcaatccgtttcaatcaaacgtgacaaaaataataataaatagataagtgagttgagagaagattcagtcatcacaaatcatttggcaagggttccccttgttaccttgagctcttttagtggtgtggttagttagcaagcaacctagtgcgacttgacgttagtcatcatctctatgaatttattcacgttgtgacggctcaataaaacctcccacgacacatgtacactaaaacaagttaggacgatttttttctttctcataatggccttgatatgggtacacatacaagttgaggaattgaaatcatccaacgtttaaattgaattgaggattaagcgtttgttgttttaccttttatgaagaacttccaaagcagttgtattaaatttgttagaggttaggagggttctatagcaggtgtatggtgcttagaaattcatgtaggatcgaatcacaagaactaaaccaaccagaggggggtgaatggttggtatacccaaaaaccaaatcttttagaggaaataaaaattaccctcaaattcgacggatcgcggtctgaccgaagatgttgcgtcggtctgaccgcctgatgaacgtcggtctgaccgggatcgaactctggtcgaaccgccaaaatcacctgcctgcgcctgtcgccaccgccggtctgtccgccggtgcaccgccggtctaaccgccgaaacccggtgaaacacaaatcaaagaactcttaaagtggatgacgactttattgattctctttgtgtttacaaagtgcaccaacagcactccttgcaaaaatctcgactattcgaaaccctaactcaactgtcaacttaattgctctcaaaagcgataccgggaaatctcacgctccctctctacttatacctgaggtaggcagcctaaagccacgaaccaaacttatactagaagtcctaatcaccctaggaaaccctctagcacaggaaacaaactttacataaccaaacataccaaatttggactccttccaaattcgactctgcatctcatacgcacacaatacctccatcgtatgccatatggaatcttcacctaccacgtgcattgaactctagccttcgtatcccgcatgatctctgaccaccacggacgtcatcttatccctaagccgactcccggtccatcaccgcaaatactctcccggcatctcgagtcatcaacaaatagaacaaacaaagaaactatattctgagaccaagctattcccaacttgactcattagtagcaaacaacaatatttacatatgcattgtatccatctagaagccataataatgaaacaatcacggatatccaaataaacaacccgaaaccgaaatcgacaaagtgtcggctggtcagactgcgggctgtgccggtctaaccgtgtaatacacgccggtctgaccggtagcacatgcccagtctaaccggacccaaatcacagcagttcctgtagatcacctgtgaaatcccaatcatctccaaaaccacttcgcaaataaattctaaatatcaaaaccaataatctccaattccaattgttcatcacagaataataatcaaaaacacctttcattttacaattcatagcttataattatatattctagagattagccattgataaacttataatccataattaagaccatagatgatctcagatgaaacttttgtcaactacaaaattataggtctcatctatacctacaactttcatacagattttgtgtccatccgagattgtctatatcttataacacattttgggacatccagacaatttaaataaaaagtcatcacctatacaaagttgtagatctcgtcgagctttacaaatttgatataatgtttatcttcatccgactttatatgaaaaggttagataaaaagcacatatttatgagttgcatcatcatagagcaaatatttctgcatggtcaagtttggatggtagatgtaggccattgaagaaaatctatagctccctctatctgctaatgatttgttgcatctggaaaatactatgtcttattctgtcacaatgttgcaacaactgagaattctcaattagaatgtttgtgggctcaataacccggcacgcagagaggcagtccttgaaaccgcaaagctggtgaaagcagaggtattctgtgcatgcaataaacaaaactaagtgccattgaccagtggattggtaaggaaattgggggaagcagattgacaaaattcaatttccttcctgccaatggaacacgtggtggcattgccatcttctgggatgactctattgtgaacatgataaacttctcgcacagaacacactacctctcggcaacggcaacgaccataattgaaaacctcagctttgtcatcagtcgtctatggtccctcggaagacagcgataaggagagttttcttgttgagctaatagcagccaagccaccaacagacacgccctggctaatcgtgggagattttaacatgatatgtgaggccagagacaagaacaatcataatctgaatagacggctaatgggacggttcagagcagccttaaacactctggagctaaaagatatcagattgcaaaacatgcggttcacatggagcagtgagcaaggaaatctgattctaagcatattaggtagaatgctatgtaatagcgagggagacatcttcatctctggacactccttgttagcactgttcacatcctgcttagaccactacccactgttgttagacccgatcatagtagaaaaaaccggagcggccacagaaccacttgagcttttggttcaccgggtcaccggttggaccgccggacttaccgtttcgattgctgaaccggaaagagtatatatcataaataatttctcctaaataaggtgagcaagttgccttggtggtgaggttgatgtgctttcataccatcggccagggatcgatccctatgcactcttttaggcaataaaatgcaattgggctacaacaatccaagtgggccttacaagcgtcaaaatagcccgggtcaccggttttcgagaaaaactattcggttcatccggtttgtaccgttcaattgcatgtgcggtctttgaatcaatccaaaccggtgagggtgctggttcctgcccgaaaaactatccggttcatccggtttgtaccgttcagatttagatttgagaatttatgggttagagtggaaggcttcttttttccggttcaaccgctggtccggtccagttttttgtactatggccccaatgcaagatccaaagaggagcccgagattcagatttgagaatttatgggttagagtggaaggcttcctaggagtggtgactcaggcttggagcaagcctatccaggatggtcacccctgtcttacggctcagtcaaaagctaaggaacaccgaaacgactttgagacaatggagcaaatagaagtttgggcaactgaaactacaattcatcatggtccacgaactaatatattggctgtacatagccctggaaacaagaacacttttagttgaggagcatcaatttagtaaatatctcaagataagaattctggggctagcagctgtggagaaggcaaggaaaaagcaagcatcaagagttaaatggttcaaagagggcgatgctaacacaaggtttttccacatcaagatgaatgcccgaagaaggaaaaatttcatccattgcttacagcaggatggaaacactatacatacacatgaggaaaaggctgcccaccttcacgcgcatttcaactcaatcctggggacaaggagaccatgaggctgcactaaattgggaagccctagaattaaaaaaatacaagatgatagcatggatgagcctttcacggatgatgaaatctgggcagcaataaaaaactctctataggaaaaagcgccggatccggacagtttcactggtgcttttttacaaaagtttttgtcaaataatcaacaaggaaataatggaagtcctgcaaagtttttatagcctatttggggggaattttggaagtatcaatagacccatgatagcattgctaccatgactcgccatgttcggcaaatgatttcaagctgcccatgatagcattgctaccatgactcgccatgttcggtaaatgatttcaggcccatcagcctgattcactccatggcgaagctcatctccaaaaacttggcaatgagactggtagcacggctcggtgaattggtctcacatgcccaaagtgctttcattaagaaaagatgaattcaagataattttctatacgtgcgtaacatggttcggtgtcgcgcccagagatttgacaaaccgaatcactggctatttgtgcatttaacctctgtccaggcattaaccagagtacacagacgacaattcgatacagtaccacgtcttacaaaaatataaaataaactcagaaaagtagcggaaaaattaaagaccatttaaacttaatcttctcacgaaagcgaagcttcctccataatccacacgcgaaacctcgacgtctggcacaagcctaatcttcatagaactcaccatccgacaaactctctgccactgggggattgggaaaaataaggcaagactgagtacaaccaccgtactcaacaaatcataccaaggttaatatttgtagtaaaaagcagcattcataaatcataagttgaaagcagtaaaatagtagataattaagcaatattaacctcatcactgtccaacgctaaaaccacgttgcgacaagcccagcccaaaccacctgaactacactagttcattaagtcaaattattaaggtgagactaatcatgataagctagttgaccgcccaataaccgtgggcaaggctattcgaatagttttactttaattagaggtgtacaactttatcgacaagacacgattccacacatattaccatgtcccgaagtacctccacgatactacaaagggggaaatagtgacaaaaccatccatataaccacccctaaccaacacacccaccaccaatttcacccccatccatatacaggcaatgggcagtccccgctcgtgcctaggtaaatccagaagcagcatagacgaaaatctaggtccatccatactccatcaccccacccttgccaacggtgtgttcgctagaaaagattatacttaagattcaaccttgagcctatctggcctgtggttagtacgagtatatcttcgagggattcccaagaaccggtcgttaattggcatgggcacgaccaccaatcaaatcatgcatgtacccacaacccaccaatagagcatatttcagttaattaaccatataccaggatggtataacatcatcataaaaaattaaggactaaattataatgaatcccaatgtgaggtaattgatctaagcattcctaaaccaatcatagagtcaaattattatcacaggctatcaaataaatcagggtaatcaaaaggctaagtacgggtaaattccatcccacatgacattataaaataatgcatgttttaagagaaaagcagggattttgaagataggctcaatatgatcaatgatatccgtatgacttgccttgctcttgagctgatgggaccactacgatggatcaggtcatctctgacgggctcatacccttatctgtgatgggttaagcactggtcacagatcagtgatcactgatgactcggagtcacctgtgacgggtaaagacccgtcagaggtaagagttacctttgacggattgcaaattaaaatatgtcataggtaacgttcacctgtgacggaggggtccgaattgggaccgccatctcttcctcctatagcgcccgcgtcttcgacagatgcggaaaaggcgaaagcagcggcagcggcgaaggccctccaggtcagagatgcgatcctgtcatcccaagcaccgggggcaccttcgaccgccgccttcgcccaaccggccatgacatcgacagccttcaccgccccgcaagccaacaccagtctcaaagctcaagccgaatctgacatgggggccatgaatcagaatatggctaaacttcaagacacgcttcgccagatgcaagagcagcagcaagcgtacgaagcagcaaggcaagcaaaggcccacacccagcagttctacgctcagccccaagtcgttcctccatacgctgcacaagcaccggtgtacttcgccaagcctgcccaagttgtcgccgtgcgtctgactccacaagtgacctcggagccggttcgcccgacggcaccctaagcccagtacccgaagcctgttcacacgccacaagtaatgatggaagcagcttcgaccttacaagcacaatttcaagccttcttgcaataactcaatcaaccccaaaacaatttaccaagaacttcgcctttggccctggccgagggaagcccaagtcagggtgcaccagtgggacagctgttgggccagttcgccgaaccaagtcaagctcaaggggcttcgcctcaaggccaaccgccacagttcgacccaagcacaccggcccaagcacccatgactttcgcacaagccgtacccccacggtatggtgcagccccaccactaaatcaagcctagaatcaagccatgttcgacccaacagtggtaatgcaagctacttcgacagatcagcaaaaccaagcaatgaagttcggcacggggcatcaatcgacacccacagcccaacctcatgtacaagctgtggcttcaccgttcgcgcccccatacccatagttgaattggccctctcagcaaggggccatggtcaagccgggtggcgaaaagggtctgccccttagttgggggatcaagaatcaccccatccccccccagttcaagttccctcctgttccaaggtattcgggagaaacggacccaaaggtgttcctctccatctacgaatccgcaatcgaagctacccatggtgacgagaatagaaaggcgaaggtaattcacctcgtgcttgatgtcattgccaggtcttggtactttaatttgcctactagcagcatttactcatgggagcaattgcgcgatgtctttgtccttaacttttgaggcacctacgaggagccgaaaacacagcaagaccttctcggcattcgccaaaggccgggagaatcgacaagggaatacatacgtcgcttttcgcaagcacggtgccaagtgcaagacataactgaagcttctgtcatcaacgttgcttcggccggcttgctcgtgggagaactcacgggaaaacttgcacgcaaggagccaaggacgatcgaacacctctttcgcacaattgatggatacgctcgaggtgaagaagacaccaagcgaagacaagagatacaagctgaatatgacaaggcgacttcagccgcagccgccaccgcacaggacaacgctcaagctcaggtccaagcccaagttgtaagatcggcgcccgtcctggttcaccctaccactccggcgaaccaaggacaacatccaagtccgaaccaagcctcgatgacatggaagaaattcaggaccgatcgagctggcaaggcaatgatggcggtcgaagaagtgtaagccctctgcaaggagttcgccatccagcaagtgggcggacagcaacaaccttttcgcaagaaaataaaaaaggacttgtactgcgctttttatggacgctcttcgcacacaaccaagcaatgtcgaaacattcggtaggaaggtaacgctcaagcgccgaggcagcaataagggccaaagaggcaccgcgtgaagcggtcctcaaccaagcacctcaagcagaacaatgccaagacgcgcagcgaagagtgattcaagtcatcaccagatcttatccctcctcacaagtgtcgaaacggcagaagaaaatacaacttcagacagtgcatagcattgtttcggcaggtgatggggtcccaagatacttgtcgcagccaatatccatcgggctggaggatgccaaaggagttcttttcccacaccaagacccgttggttgtttcggcagagatggcaggtttcgaagtccggcgcatcttgattgatggggaaagttcggccgatgtcatgttcaccgggacttacgccaagatgggattgccgacattggcgttatcccaaggaccgacttcgctcagaggatccggaggcgaagcagtgcaagtcttgagacaggacctaaagtcgctttcggcacacaagagaacaaaagagaagaggagatactcttcgacattgttgacatcccatacaactacaacgccatctttggcaagggcactttgaccaagttcgaagcagtctctcatcacaactacctcgagctcaagatacctggcctagctggcgtgatagttgtcaaaggttcctagccttcggccgccacagtggccactttcgatagggaagtccgtaccctacaagtcgaaggacaagaaaaaacaaagccaataccgaaacccgcccctcacggcaaagttgtccaactacagatagatgattccgaccccacgaaagttatatcactcggtggagaccaaagcgaacaagaagtgaatagcatcctggtcgcgctcaagaagaacatggatatcttcgcttggggaccaaatgaagtggggggcatttcgccagatctcatcatgcaccatatcgcagtcaagcctgacggaaagccgaagaagcagaagttgaggaaaatatcggcagatcgccaagaggcgacgaaagcgaaggtgaacaaactgcgaaaggcaggggtgatacaagagatcgaccacccaaagtggttagcaaacccagtgttggtgaagaagtcgaacgacaagtggcgaatgtgcgtcggatctcaacaagatgtgcccgaaggacgatttccccctgccacggatcgactagcaagtcgattcgaccgccgagtgtgagctcatgagcttcttggatgcatactcaggatatcaccaaattcacatgaactcgacagatattccaaaaacaaccttcatcacacccttcggcaccttctgccatctcagaatgcctttcggtctgagaaatgcaggggctacgttcgccaggctggtatacaaggtctttggatcccaattggggcgaaacgtcgaggcctatgttgatgacattgttgtgaaaagtcacaaggtcttcgaccatgcatcagacttgcaagaaacttttgacaacctccgtgcagctggcatgaagctgaatccagagaagtgcgtgttcggcgttcgcgctggttagttgttaggattccttgtatccgagtgggggatcaaagcgaacaccaaaaagatcgatgccattcagcaaatgaagccaccatcgagtatacgacaattacaaaagctcgcggggcgaattgcggcactcagtcgattcttgtcaaagatggctgaaaggggcttgccattcttcaagacccttcgaggggcaggaaagttcagttggacacctgagtgccaagtagccttcgatgaacttaagcagtatctccaaagtcctccagctttggtcagcccagcggcaggaaacgaactgtggctctatctagcagcttcgctcgtcgctgtcagcgcagctttagtgcaagaaaccgaagcaggccaaaaaccagtatacttcatctccgaagccctccagggggcaaaaatcagatacattgaaatggaaaaacttgcttatgccctagtgatggcttcaagaaagctcaaacactacttacaagcccacagaatcgtgtaaccttcgcagtatctgaaaataaataaatttacattttaaaatataaaattacagtcctatgtaactaaaattatatttgtaaattaagttgatatggcatgtaagtgcactgtaattttgataaaaataatgtgtaagtaaatatgtattttttattttcttttgtagtacgttagatttaaatctaaaggtagaaaaaatatgggtgatttttttttgttagaaatcacacgacaaatagatagacagttccaggagatcgattcagttgtgtggcgcgtgagactctctttggcaaaagacaaaaatgcctaaagaacaatgatagaaaagaactatcataccctaatgaattaacggtcgagatcatttctactggtagtatatactcgtagtagacagcaccggagtttcactctaatggaaaagtgcgaatacgttgtgcgttttgaatttgagagtgtaacgagcgcctgaatgtacatgtagtggtgtggaaatggtgcttgcagtgtgtagatagaacattgctgacgaattagatgaagaaaataggaaacctattttgagatgacgacattcgatcgctctcttgctggaaggctaaattttcaatggatcataattaacaatacaacaatgcagtgtgctacttggaagcgtgcaccgtggtccgtggtggctcatctaagtcataacatgtggcctttatgatacggtgctatttttattgctgaatcatccaaaacccctatacacgttgagttcgttccagctaaaaaaaaagacattatctaaaatataaaacattgagttcgatccaggtatttacaattcgaaacattgagttgttcaaccactgccacacaacaagcaatatgtgcccaagcaatatgtgccggttgggaacctcacaaaggtgccgaattttccaaccggcaccacgaaggcagcacagattagaaacactcaaaaccagcacctttgagatatacgaattgaaaaaaataataataaaaataagaataataaaattcagctcggctcaaattgaaccgagccgatgcatcaaagcaaccaaaaaaaaatccaaaaatctcaaaaaacaaatccgctgctggcaccactgccgctgcacactgttgcatgccgccgccactcatgctccgcccgctgccaggactctgcgccaccgtcgtcgctgccgagaccaccgcgccaccgccatcgccactggatctgtggagaggaggaaaggaatcatcagtttctgaagattacgaaaggaatcatcagctgagaaggacccagagagagagcctccgccgggccgccgtctctcctcccgccacctacccctccccccgtcggatttggtggagaaatttggaagagaggagagaggggatgagtaggaagaccttgacgacgtgaagagaggccagcgataacgcccaacgatgatgaagggtggtgcattgacaacgccatgatcaatgaggcactgacatggccgacgcagtccgtcgacacccttcattgaccttccatgcccgacgacgtggaaaagggcggcgtggcgcggcgagatctggatgggaggtgggaggctaggagaggaggtctgggagggaggaaaggcttcacaagagagagagagagaaacgcgcgagagaaaggtgggagaccgggcgaaatggataaggatgtgtgggcgagtggaggagacaatgatttgcaggcgaagtggataaggatgtgcgggcgagtgggctcgccggctcggctcaattcgtatgtgtcggtttttttaaaaaattagcacctataatatgttgtaggtgtaaccgacaccaataatatattaaaggttccggtttctttttagaaaaccggcacctataattacttaaaggtatcgttttttttacgttttcaacctgtgaaagtgggaaaagatctataggtgccggttttagcaatttcggaacctatagtaccgacaccgttttgtagtagtgtccggtgggtgcattgggaatatgagatgctgaccaacgcttgaatgtatgctaatgaacggttgcagagtatgtatagaaaagttctggagagtacttcgaagaaactagaaaattcacattaggataaggacaattgatcggcaaaatagccattcacaatagtgaaagaactatgatcatatcgaaacaagttctgatggaaaatttcgtgttggatgagttattaatgctttcttgccattgaaccattggtgttaatttatccctgctgttgattacgttcattttttaaatgctgggttttctttcttcatcttagactcaaccagtagctgcgtgccagctgacacgagaccaaggtcacaagtaggccagacaatttctggtgacatccaactttatttccttgggcggggatcagaagaaatgctcttccaaggtgtatacttgtactggttgtacgtgtacaaagcaacctatgaaaaattgaaagcaatgctcaatgcattgctctccattaaagagtaaaatataagtggtatcttcaacaaaaaacttctgtgatgcgttcattataatattgaagacaaatattttttggttctcgcaaagaaatagagcgtggcttcaaaattcaatgtcatcttccaaaaagccaattgtacaatttatatgtggaaaatttagtcactgcagcaagttcaaatgtgctgaaattcttttttattttttaaaatttttaatttttaaattttaaaataaaccatttcaaaacatatttttaaaataaaaaatggttcagatactagcaataacttttggaatggtttatttttaaaatttaaaattaaaaagttcaataaaatttaaaaaatccccgtgctggtaggaatatgtacgcattgaagtattgaagtatgtactaacaagaaattttctactctcaaactcatgatgccaaagtaaatatagatatcttggatactgaaagatttgttcagctagcggcagaaaattagaagatttttggcacatgttaccggtgccctctcttatgcagtttgaacacaaacaacttttacatgggtgaaaaaagaattgatgcacccaagaatgtcctatttctccgcaaaaaactctgacaaagataggaaactaattaattaactagttatcatcagcgatctcagatgcacaagctacgcctcttccggatggtcaagaggccattaacacacttaacagacgagatgacacattgaagctactgtgtcttctcttaatctctttaccatacagacatctcattcttattatgaccactagccgcccacccgtgcgttgcacgggctatcattttgatattataagtattaaattaaccacatttgcctctgattagtggcttgacaaccaccggatgttcaatgttggttattttccaaattaaaattgtttagattgaagagtctaaaagagctcatcctccagtcagaaaattaaatttccatattattttccatctgtatgttttatttaacacgaactccagtaaaatctattgtcaagataaactgacctatttgacaaacattcaaatacttccagtaaatatgtgagctttcttacagtgcccaattgtttggatttaatatgttttgttattttcatgaaaagaattatagcggtttagattaaaataagagtccatgcaacttcctaattatgtattttaaatttaggactaaactaataaaataatatattgatagtctaagatggatacaacttcatattcactaattatgaattttggaattatcagtctttatgcaactaaaacaaatgaatccatatatacatatagtttatttcaaatgtagaacttattgttaactgccatttcagcatatagagaagaacaattagatgatattgatgtggtcttcatctcgtaggggtaactgaaaatcttatatgtggtggttattgttcttaacgctaattatgtcaagggatcgaattaattcctcatcgaattaacaaagatttaacacatttcaatgatataaaattccgttggagtgacttactatatgaagatttcagaggaaattttacatgagatccacctcttcgaattttccttcgagtgtttcgctctaattcaattattgtatttctctcatagcttatgcgaacatttattcatgcattttattgtgtttgtaattccctcctttacatatgcattcttgtcaaaacttatgtctctcacgttcttagttttgctaatcctatgttgcaaatgatggtgttgactaaagagaagtccatattagttacaactcactaactattatttttcaattttacaactgaattaataaaatactct

SEQ ID NO: 25389 - DNA, 5517 bp, Oryza sativa
tgttatgaggcattggttcatttggagtattattgtacaaataatcaagccgaatacaatgcttattgttcggcttacaagttatggagatggttggagctaagtacgtggaaacttttggtgattcggaattggtggtgcaacaagtcgccggagtctacaaatgcttggacggatcactaaataggtacctcgactcatgtttggatattattgccaatttcgataattttgctattagacatattgctaggcatgataattctagagcaaatgacttggcacaacaagcatctggttataatgtgaagaagggattatttctgatattagaagagccggtgtttgattttaaatcttcgtgcgaaattggcaaaactggacaccagtggcggtctgaccggcattgcacggcaggtctaaccggtgaccagaggcggtccgaccggccgcatgccgccggtctgaccggcgacccagagcggtctgaccggcctggtgtggccggtctgaccggttctgggcagagcgctagggggcacgtttcgatcaatttggaggccgaattaattgtgaattcggacatttgtgcccaggaagcagaaaaggattggacaattcctttgattcgatatttgaaagatcccacagttaaggttgatcgaaaaattcggcggcaagcattcaaatacacattgcttgatgaggatttatatcgccgaaatatagatggtgtcttgttgaagtgcttagatgaagatcaatctaaagtggctatgggagaggtacatgaaggaatttgtggaactcatcaatcagcccacaagatgaattggttgcttataagagcggggttctattggccgaagatgattgatgattgcttcaaatattatagaggatgcgagtcttgtcaacggttcggcaatgttcaattggcgcccgccgccgtgttacggttcggcaatgttcaattggtgcccgccgccgtgttgaaccccataattaaaccatggccgttccgatggtgggctttggatttcattggtcaaatttatccttcgtcatcaaaggggcataggttcgtgctagttgctacggattacttcaccaagtgggccgaagccgtgcctttgaagaatatgactcatacggaggtaattgactttattttgaagcatattatccatagattcggtattccacaaacattaactacggatcaaggtgcttcttttatgtctaaagaagtgaagaattttgccgaatcttatggtattaaattgttgagttcttctccttactacgctcaggctaatggcaagctgagtcgagtaataaaacattgttgaagttggtaaagaagaagattgaggaatacccaaagagatggcatgaggtgctttctgaagcattgtgggcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagacgttgatgggagacaaccttgatgaagtcatcgacaagcgcttgaaggcattggaagagatagagaaagagaagaagagggtggccaaggcgtacaacaagagggtgaaagcaaagttgtttcaagttggagacttggtttggaagacaattttgcctttgggtactcgatccaaggagttcggtaagtggtctcctagttgggagggtccttatcgagtgtgcggcattgttcgagggaacgcatactttttggagacacttcaaggggagcattttcagcgagcaatcaacgggaaatacttgaagaaatacttcccgagcgtttggcaagacgcttaggaggtactatggccggtaattggattatcgtcctaagaccaaaaacatgttctatgcttttagattcacgttgttcatcaaaaaggcaggggggcatgtgtttataccaaaatttggcacctaggattaaaataggaaagattgccaaaatttggaagtctaccgatttcctccgagtgggccggtctgaccgccgtgtgttgggcggtcagaccgccggttgagggccggtcagaccggcggtgtgtggccagtctgaccggcaggtccaagtccgactgtgtttcatcgggtttcgaggtttccttgctcgggaaggcatgtttcgggtttcctttagtttctaccccgagttggatgtggaggagggcctgtagagggcaagaccaacccctatataagggacatggccggttgatggtaaaaaccaatctacaatcaatcaatcgaatcgttttttatattgcttttagttttctcttagtttttccatcttggtcggtttgcaccgtaaaccgtccgccgccgctacgagagtgcgacacctctttgtaggtttgtgctgaaaaccttcagttttgcccacgagacggatagttatctagaaatcggctccgctagccggtttagttatcaaaacccatctaggtttagctctttgctaaatcgaggtggttggcgactctaggatcaccgcaaggcttaaggtgctgcgatcgtgcttgtcaacttgtcaaaaaagttgccaacacaaattaggccattttctccatttcttctatctgcacaatgctagctctcagttgattctatcgcgtccatggccggtgcttccccttggcctaactacatggatgatcttctcggtgaactcccttagcaactttgcagaaacatacatactacgtatgtcttactggctcttatgttgatttctgattttattttcaggccaatcttacatttttttttcccgatctgttgtcttgctgaccttttctgattggacattccgcgggatcactatcatttccttgctactgtatttgtctgttttccttgctactgcctactggaactctctgcaggtaaatatggtcaaattgtgaggagatatcgtacattcgactaattctgaactttcaacatgtgattctttcttttgcagctctaagcggctacacacattaattaaaggcctaagttaactgaaactgaaacaagatgtgtagtacatctatgtctttatgcaagttcaagtggttcataggcaagaaattaaccaatcaatatcacaggtaccttctaatcatagagttcagttttacagtttatgaagacattaggtttacatgtgattcctttgttcaggatcgcaagttcgacccatttctgtagtttttacacagcaaaagttacattatgtgctatttctgtacctcactaataaaagtataatactttacaccattatattggaagaatatgatcaaattacaattaatgataaattattctgcatccagttgtcaatggttcttttcgcatttggttatccatatttacagcttgtgcttcctcatcataaattcataatttagaaaataatagcacataattgcaatttctgcagcgaaaaaccagatctgaacatatccttagctttatattgtgatatttaacaaaatttatagctgcttttgttccatttaagttgtattaatcagcagtacagtagtggtgtgttgcgcctaataagaaatggtagcggtatgttagtagactacagtagtaatttttttaagaacattctcattcaaaattttggccaactgctgacatttcccatgccatcacatattctcagcaaattcattgctttttatcaagttactcacactaatatttcacattttgtgaagtagagtacttaatttgctatgcccgcagcaacgcgcggggttttacctagtatctacagtgaagatggcatagaacataggatgcacataaaacttgtgcacaaaattgactcaaactgccacaaatttgtggatgcctaaggaaagaatgctacactgcaaaaaaaaaaatgatggataggctccatgtatagaatgttatatacatctaatagatagtaaggaatatacagttatttgactgtcatgtatagacatacagttgacttaatagaatacttattcttatggtttttgtgctttagaaataaaggcaaatcaggttaatcattcagattaaatgacaaaaaagtaaataaaactgatgaatagttatccaaacagatatatgtatttgtatctctaaaaggaaaatgttttcaattcaacatgccttgatactaagttgctacttaccctagaaaagttaattagtgtgtaatgacaataagttgacctcacgaaactgtgaataagggctttataacctgcataatagcattggatttccactaagatgcatgtctccattgacagcctgagttataaacaaattgacagttttactcactgtgatacataaccttgtttttttttaaaaaaaaatattttcttataagaatatatatcatcctgcccagtgcccatatccactaaactgcaggaacactcaacgtctcaacatggctttgttaatacatgcagtccgagatatctaagaagtgtaatcagctaggagtactaccttggcacttgacttcccaagtgcaaacaattgctagcagtgtgctaacgctgtagattgccctcaaaagatcgatacactggtggagaagtagtttttactcccggttcgtaactccactttagccccagtttttcaaccgggactacgaatccgggactaaagatcgctatctttagtcccgggtgaaataaccgggagtaaaaatctatcttaccaaccgagactaaagatagagcatctttagtccttaccaaccgggactaaagatagagccaggctgatccctggctgctcctttattatattcttttcttcattgtttttaatatattgatttcactccatccccatccccaaaatcccaaatcaattatcacctccaaatcctcaaatcgatcatctccaaatacatcacaaaatcttaaaaaaaattacatcacaacatctacaaaattcatcacaaataaatcacatattcaatatcacaaatacatctcggatccggaccacaaattctaaaaaaaaaaggaaaacaagccgccatcttccgcttgccgcctagccaccgccttccgccttccgccagccagcgccgcgcgccggccgccgcgcgaggccggtgccgcgcctgcagatcggggatgagtaggggggggaggaggagcctcgcgcggcgccgctgcctgcagatcggggaggagggggggagggggaggtgaaggaaaggagggggaggaggagaggatgctccgcgtgtaagatagcgaggagaagagggtatcggaggagaggaggaggagaagaagagatagaaccgggagggaggaggggaggaggagatatgtatctcgatcccgcacgcctcgatctctccgcacatgccgatcttttttcccggttgg

SEQ ID NO: 25390 - DNA, 16892 bp, Oryza sativa
ccaaccgggactaaagatattagaggggtttgacatcacctaccgttttttaaccgggactaaagatcaaaaagtagctctaaccttttcaaccgggactaaagataatctttagtcccggtttttattgcaaccgggactattgtggaagttggtcgaccgaccaaagatggtttctccaccagtgatatgtgcgtcagagaaaaatgaacacattttttcccattgaatcatctccgatctgctggcttccaccttgtgataaacatatgtgcgtgatagattacctcggcttccaccatctacgatctgccgtcactcccttcctcatcgtcactctcttctttcttccttacccctcttacgacgaggtatgtcggcatgtatgatgaagatgaggtggggggaggaagaggaggaaggggtgtgtggcactgtaggcgacggggatggataagagcaacgccgacatgggcaaggaggaggagaacccgttatgtggtgcatcgaggcctgaggaccctctcgatctggcagcaacattactctatggcgcttgatctggcgcaacagtgctcgatccggaaggatgaaagatggtggaggatggggaggaggggaggaggaggaggcgacggggactaggaggggagcgaaggggatggtggagaaggagacgaggtagcgaggggcgacaggaaaataaggcggcggcggtagcgcacgagaggataggggtaaaatgaaaatttttaactttttctccatgtacgtggaaggactagaaacaaatagaaaattcttaaagggacaaaacgatatttttccaactataggatctaatggcttagaactcgcagagaagaaatcagacggtatatatttatttgatgatgtggagcattatccttctagaaagcttgttgctttcatctataataaggatttgcaaaacatgtaactattttgatgacgtgatgcaagtagtatttctacaaaatggatttggcattgaacgtactgttttaacctaactgttatggagtttcaagttaaaaccttgccacaaaagttggcccgccagttacaaagttagttagtacttcaactgagtaatttgcgttggatttatggagaacatggttcgtcctccaatggatcaactccaacatcttgtccttttacctcttcagctcgatcggccagctaagtggcaagtttgtttcctgttgtattccatattgctactgtatgatcatagtcgaataggaaagaaaaaagtacttttttcatcaacatcacgaataggtacgaagcaatgtctcttgccgacggcctaagaagtagcggacagctgcaagacaagccagctttgcctagaaactatattttttgccaccccagtatttgtttggctgctgcaatctcccacatatctatcatttatatatacccttcatgtgcatgaagtatgttgttaataaaacccggaactcttgatgttgctttccattttgtcgttcaaagtcagttaatttgctatatagttgtgcacggacatgtcgatcgtctgtgcacctctgcttgtgcgcgcgcctatttgctgttaggttttacatggagtgatttcacacgtgtgacgaactgacaatgtgggactatgtgacgatggttattatgttttcgttgaaaagttagcaactatcttcagttgcattaggttgagtgtgcattatgagtagaggacaatatatatgcgatgcgtgtgtagaatctatggtaataatccggtgaagtagttgaaaagaactggaacttctctactaaaaagagataggagattgcaatcatctacaacataacgaagcattgccgtcaacctcagctcccttgtttttattcttcctaattaactcagttgtacgaaaatagaatagtccagaaatatcatgccttgtccagttacatttgtaggatctgctggctaccctagcgcgtagtgaggaaggcttgaggttgagcagaaggtctctaacaagatgatggtgaactagaacatatcccctcaatgctaggcgctaacttcattcccttactgcctcctattttcattatgttctccatcactgaaataactgcccagatgtggctgttgcaagtacacacaaggaaatatactttactcatggcattggttggtaggatgctcggtctccaaaaattaatccacacaccacgaccacatatagagatctatattatgcaccgagagcatgtactagcactggtgcctgttggctatgcacaaaatcgcgcacccaattgctcgcactgtatgatgtattcctacaaggtgaactgagaaaaatagaggacataaaacaaagtgcagaagaacacaagaatttgggggcaattttgtggggatttcttttattggaataaaaagctacaactcgctacgtgccactcttataattgttaactactattacctggacggattgttgttgctactgttagtggtggctaaatatggtgattagttttgaaacgcataatgccatagactaagcattaactcattaattatgaattttctatttcgagaagtaatttttttaaaaaatgctatattggtagtccaagatggataactccatatatattttgattctaaattacggcatgttatagattgaagcaatgatctatgtccggtacaattagctaattagtaatgctagatgtatgaaccaaattatagggctgagtacgcacacgttatgagtaagtatgtttatactttatttaaaaaataaagtgctaaattaagagcccacgacacgaaataactccatattgatgaatttaatattttagaaaaaaaaatctaaactgtcgacgataccccctcggcacattgtattgaacacaaactctttataggacatacgataataaaattataatccaactaatgaagggccaactatttttggagttttctacatctctccgttgcacatgctaatattaatggtgacattataaatataggaattttgatattgttttaaaatttaaattatcttagagtgtcaattttagtatttttattaacgtacatgctagttgggcactgtaccaaacagctcattacgtagaaaaacaatcaacaaattataaaacaccgaaaaatacagaacaacacacaccagacttgcggggccacagcaggcttcccttcgtcattgtctggccagtggaggaaaacaaatcaaaactctaggaaagatcgaaataagaagctacctcaaaagacgtaccagtgttgtatctgtaaaaaatcaatctttttgattgaggaaaaaatagcaaggaggagaggtctcgatgtggtcgccacagctcgtgttggtgcagtcccacatctagatcgaaggcaggcttcatgggctttcaaaggtagattagttggccaatgacgttaaatcactatagatttatggtgcagattttgtaatccatctaaacgataggtcagatttttcttgttaacatgagggctcgtagaaagtaatcaataataaaggtatagacttgtatatagagtacatggaagttttacgatcgtgcaatcccacgacctccaacaactcatttagccgattattactttcagtgtatttacttggtgcgcatgaaatggttgtattgttaggctattgcaaacattgattggattaggaccaatgagatgaataacattaattagtgaccctactgcacaaaggtggacaatgtgccaagatggagaggggccagccaaagatggcacctgtcgtttaactgtccgaccttgttgacggacagttaaatatattatttattaattattgtggcctatattaaaagaagagtttggcatcaccaacacttctcttataatagtgtagtggtatatgatagatcatagataccactacactaggaaggtaaaatgcctgatgtattaaaacaactccctatggaatggaagaacaaagaaaaaagccttttagttggcttggccataaaagaatttgcctcgcttcgattggacctaaagcagttataaacctcaaccgagccaagaggaaacacaaatcaagccaaatgtgtcatccagatggtaacacaattatgaatgtacatgtgcaaatagtatctatacctgcacgctgtctactgtgcaaaaggaataaacctccaccagatgatcaacaacaaaagaaccacttgctgaaacacatgttccaatccacactcgttcacaatacaatattacggctacaggattcaatccaatccacacatgttccaatgaagttgtgttgttcttgctgaatccctcccatctcaaaagtaaacttctccaatctgcggattgctgcagtaaccacctactggatcgcgttacattcgaccatggtgtcatatcactcaatgcttgagtaggaattacctactggatgattatgttataaaaattgtctttcatatagacttgactagctgaattcggaagaacaccataagagaagaattctttgtactcgggattggctgacatcctcagtgtatttgggaatgtccatgattaaagattaatttggttttcaatttgctgtccaaatcatcctcattatctcgagtgcaccatattcagcctcgatgctggcttgatctgacccaaacaacttatgcggaggcttgaaaaacccaagcatgtccccagctgccatctgccacgtccacatatgaggtgaaagaatgaagttacggtctaattgtcctactaaggctccacataaaggcagtataattcaagtgaatttctactgcattacattgagatatcctaattatgggttttccttcctatatgcctcccattcttattacggtcatttctactaaaatactagtgggtacagttcacagttttaattttttcgcatcgacatggattgaaattgaggtccaaatacttgtggcaagattactacatggcagagtatattatatatatatgcagaaattgctagctgcagtataattccaactgacatcaagctgtcaatgcttaccccattttgctgttgtacggtcgtgcagccgccgatcacgtgtcatgtattatagcccattatgtttggaatcactcccccactctactaacaaaatgtaaagtacaatacaacatattctctacgtacatacgaataaagtaaacctgcaaggttcgcattgctctagcccagtgcgactctgacagcccctaaagctgtctgaggtcgcccttcttcctgaggcagctaccggcaaagctggatgcctagaaggacagcggcggcgtggctccttcttctcccgacagtgaagccatggttgggttccaaggcagtctggagaatggacgtcacgccacccagatccagacctccatgacggacttcccaagtgccattagacataactgaggtcacctcacttagatactgcttccttccaatagtcagcatcaatagatgaatatgtctcttgtatggtttgtagtatcgtccacaaggtatacaatgtagtcatcatcgagtagcaacagtgtgatcctccttaggattttctatggacgtttgaacatcgtgttctatcagcacaaaagacacggggaataaaatagattcttgactagaagtgttaggtgtattcattttcaaaaaatatagtaccatatctttactaaaaaattttttacaaacatgcatgtcaggttctcttgaattcaaataagaatctatatactatgatgtgaatagcataaccaagaaacacacaatccacgggttttggtccaaatttatgctttttgactataggcacattgaccatagccaaacaaccccatataatctttgttcttattaggaattttattcagcacatgatacacaatcaatatagtctcaccccaccattccttaaaaagtcccgtagtgtcaaacatgacattcactaattcagttagactatgattctttcttttagcaaccccattagatggcgtgaatagggaggcatatcctatcatgaataattccagacttttcacggaatgaagtaagctcattttaaaaatacactccacctcaatcatacctcaaccgtttaattttactttcaagttggttttctaccccagctttatagattttaaagtaattcaatgtttcatcttttgtaaaatctagtgcaataatctcttaatctgacgagaggatgactacaaactcataatgctgaagtaaaaggctatgatgcatagtgtaggatttattcaattaactagctagcagccaaaaataagatttttggcacatgtttccagtgcccactcgtaggcattttgaacccaaacgactaataatacacaggttggacaaaattgatgcagtcaggaaggccctatttctccacgaaaagctaggacttggataggaattaatctgcgtatgcacaaggtactcttctttcggatggccaagacgacatgatcttgggagattacacattgaagctactgtgtctagatgaaccaatgtccctttatttgttcttccttacatttgatcggattggtaactcttggatttctttcctatgtacgtacacacacgtcccagtcttatgagagccattaatttctaaaatacaagcgggaactgattattgttgtaccgatggtatttgaggatgaattgagataatgaggtgttgaatatttgagaatctcgaagaagtgctttggcagagtatagacttcaaatttttgtactcaaacatagaagcatattgaagctgatctccttgtggtttaagtgggcttatctagtagccagtcgcacgatgactatattggaatccttgcatctatatgtcagatcctatctgtgtagattgtccatattgttactgaccttgccggagctcgtctgtgatataggcaacaacttgcaggttctgaagatgtcgctcgttgccgaacgatgaacaacagcttcagcttaatcaaggcacgccggtgacgttgtcttcaaggagattcacgccctcgccgaggtgcacgagacagacggcggctttcctccaagatacaatgatctcgtatcctcacccgtgcaatcggccaagaacgaaccaatggaatttcgtgggatgtaactctctctatgcaaaataagcagaaggatgtagagcaaaagcttcgtgtggtaatatcagcagcagtacgtgccttatatagccttgaatagcaacaagaaaatcctatctctaagccggataacaaacaatcaacagattgattttcgtcggcctgaatatctggaatgataaagactttatcttccacgtacagctcaaaacaacaatatcaaaacttgaaaccaaaatctgaacataaggcaaaagttcacatatgtccatttgaactaaactgaagaattgttggtacaaaatgaacagaaccaaagagacaaaatctgaacaaacatcaaacatcgtttgtgactttcattcagttataatcagaaggaaaatcacctgaattccaacagaccttaggcatgcgccgtgcaacaccactgttaaatcactaactgttacgtaccgtaaaatgacatagttaggcatatgctaattaatctgcctaactgtaatttaaatggctggatagaaagcagagctaaagctacaacaactataaggaagcccaaaaccttgcaccaaatctgtactccagacagtacaccgactgaagtatgcatgtcaatcctatcatgatatccaagctatcaaaacagaagcaataaacttcctatgatcgtcatgaatgaaagaatcagaatgaaatttaagaatatggtggctagctcatacacagcatgtttaaattgaagatcgtaaccgatatcctttgtgcatttggttggtccgatacataagaaggatcttacatattgtcatttgattattttggaggaacaacggattccttcttgtagactcataggtaagctgtaaaaagcgccatgatgttcaatcagatgacatcataacgtaaagaaaacaatatgataggttaaaaattatgattggatcatccacaacaacctcacaacacaaaccttatgtgctgcaaatccccctggtgttgcttgcgatagcatgttgtggcccaaggatttaagtcaacctagtcgtggtgagcacgtggtattgttttccttcaagagtcctcctattcctattgcagttcctaccttcattttagaagtgtgaattcattgtttcttgtcatgagtgcattgaaaaattgggatggtgagggctcgaacaatgtagaagttgtgtcggggtatatataaagaatggcaatgaattgaacaagatagaattcaataccatataacaataatgatactggattggcacaccggaaattcacaacggccagactcgaagtctcttttaaggcatgatgggaaatatttgtttgtattactatgatttaataacaatgtttgctagccactgaagcatgggtcatgatacagcagttaatataacagccattttatgtcaaagttttgtctttgtctatctctgataagcactcagcagacgggagggggataccgaggttggaagtagggccttggcctgaggaattggactagatggttctcttaggccttgttcggttgggctgttccaggccgggatcggggcccaatccctgtggatcaccccggcgaggaaaaaatcccggcccatgcgaaattgtgcgttcggttaagccctgccgtgaattttagcccggcccaccacggggtttccctcttctctaggcccgggaaaaaatcatctactcctggggtgtggaaaatttcctcgagaggaggcagcggcgtaacgaagacgcgacggagggggcggcgcgcggcgcgacccggaggcgacggcgacggcgacggcgacgacatggctctctcctccggccgccaccttctctccggtgagcacgctgcctttccccttcttccctcctcttgcaaagctagggttagggttttcttctcttctccctttcctgtcgtccccgccatctctcttctcgccgtgcagctttctggtgagtgagcgcttagcgattcatcgtcctcctcctcgtatcctgctcgatctggtgagttcttgatttgggcgtggagctttttttcttggttgggtggggatgcgttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtaactgatgctgtgatgcttgcctgagcatgtcttgtaaaattgactatacaagtttttacagtgaagtactcagttcttggtgcttccggagtctcaacttgtggttgttggttatatttctgtttggaaattacaagggttggggtgtcctgattttgaggattgtagagctatggaggtactctgtaattagtttaacatttctgaattgtaaactaattctatcgtcattgtttcacaaacaaactagcaacaaattgcagtagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgaactgattgggtgattaattctgtacccatgttataatgtatttgatgatgagatccttctatttgattgaaaaacagcagctcctactttgatgctagctagctctagttctgggttttatgtaactctagttctagttctgaatttgagttgtcagtgatgtgtataagttgtgcttgttttgtagattgcacttgcacccatgagagttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttctgaattctgaacatgctcggtgctaactaataaaagatcatctgtaactaaatttgacaactaaatttggtaagtgctactgccatgtaatctgctttttcatacatcctgtaagtgctactgccatcaattattgttgcactgtgcactctttaagaaaaaaagatccttattgttcttttcatttttcccatcaatttttaaatatgcttcataacttggatcttcttaagattaattcccatagtttagtgattcttgtgtgattatctttctagatcttttgttgctgtgctaagtgcaaaattgtaaataatttgtgtgctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttaaagagaagttggcgttcttcttatacatgcttagtcacaatgcttcatttgaggatttgcaagagaaatttgggcacagtggggatagctttcatcatcacgtaaagcatttcttcaactcagttgtcccttcgctctcgaagcggtttctgaagcctccaaatcctaatgaagttcattggaaaatagaaaaagatcctagattttatccctatttcaatatccttattaatatgttgttttacatttttagaaaatcatatgtggtttttttttttgctgcagaattgccttggtgcaattgacggcacccatatacccatatctatatcatctgacaaagcagctccatttagaaataggaaaaatactcttagccaaaatgtgatgatagcttgtgattttgatctgaagatcactttcatgtctactgggtgggaggggtcggctacagtaccccctggaaagttctatttggttgatggtggatatgccaacaccaattctttccttgcaccatatcgtaaagtcaggtatcatctaaaggagtatggggcaggtcggcgtagacctcaaaactacaaagagttatttaaccatcgccatgcggtattgaggaatcatgttgaatggactttgggggttgtaaagaagcgcttccctatcctcaaagttgcaactttccacaaaatcaagaaccaagtgaagataccagtggctgctgcagtgttccataatattatttgatcactgaatggggatgagcaatggttaaataaccaaccacataatatccatccaagcaattatgttgacctgccagatggtgatgaaggcaatgatcaaagcactaatcaagggaatcttttgaggggacaccgatagcacatcaaatttggaatgactatcacggcatagggaattagtgggttgtaataagtagtatattggattttctttggagttttgggagctgtaatacctacgacatattacaaatattatgttataaatgaactatggtggttgcatgtgacatacatttgctacaatgcttttgttatgaatattgtgttatgcatcctttctcagttaatatgcttctaagaggttctccaaggttgaccatgcttttagcgaaagctgcacaaaagaagaactctccgaaaggtcatcctacaaaaaagcatggaggttctccgataggtatgcaattatagaacatgtgaaattcatgtttgaaattattaaatgtagattatacatcaattcttatcttgcgtagaaaaaagaagagcctcttggaacacagccctagagaagattcttgttgagttattgcatgagcacaacactcctgagtataggggtcagaatggatggacttcagaagcttggaacaaaatcgtgaaggaattccatgagaaggacagatatgtctgcttaacaaagtcccaaatccaagaaaaggagaaagagctaaaaagagaatataggatgctgaaagaggctagaaaacaaagtggagcttcatggaataaccagagatgcatcattgaggctgagcctgctatatagaacaatataatcatcgtaagattatttctgaccattacttaattttgtagttaattacattatgcatctttttagtgttttccttttattgtgttgtcatttcctaaagccaagaagtttcgcaccaaatctttccctctatttgaggccttgggagaactttacgatggttagttctatcacaagctataatccttgttttcaatatcacaagttataatcatgctttcttgcttaccctttctagtactcaattttcttgtgtaggacatactgcagaaggaacctgtcacgcccggaatttctatccaaaattccaaacgcttacatgtgtgtgaaccctcgtccaggaatcagccgagggacacaataacaaattgataatagagtacaattattactctaattaataagcgaataaaatgtcattacagaggtagatagttcgtctcaatcaataaagatctaagcagcggaaaaataagataaacggcacagacgactccactccacaggcagcttgaccagggctacacctaatcctccacaccatcagcatcactgtagaactcttcctctgatgaatgattgcaaggtgagtatataacatactcagcaagccacgcaacaaatatggaagtgcacaaggataccaaagaatggcataatatagggctcatttgcaaaagcagcatttagcaaatatttgagaattataaaacagtagagtaattaatcatcaattttaatcaacactaaacagcacacccatgctgctcaggcccaaccatcctgaacaaccatacccggctgtacagatctatctccaaaccaggaatataccattccaaaccaggagctaaacaaattattaccagttatagcatcttttattatggtgagaagtgtgagactaatcacgaaagacattgttagacccgcccataaccgcgggcacggctattcgaatagttttactctggccagaggtgtaccactgtacccacaagacacagcaccacaacatgtcaccatgtgcctcaataccaccacggtacctcggaaaggagctgtgacagtaaccctcgtacaacacaatccaccacagcgcacctttcctggatcataatcacccccttataaacaaggcatggactccccagcgacccccgtgggcttatctccaccacttctcagtctggtgctccgcaatgaaccatgctatacaaaaggtaaagtcgttgcccacgctggcttgtggttggcacggttaatgtttcacaaccgaaactcgtgaaccggtccttaattgtcatgagcacggctctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaactaatatatatagcccaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaaggattgtttgggatctgtgtgacttgccttgctggccttggaactcttcaaaatcttctcctgcaaactcagactctccgaaaacgtcggaacctaaacagaaaagagcaaaatcaccaaaacagcacacaaaccagcatgaacagtacatgtagatatttttaacatgtagatctctattttagaaaaatttagagacttgaaccaactaaatccgagctaagatgaattagttatgtgttttcaaagattaaatcggattaaatcattcatttagattttaattgaattatgacgcaataatgaattatttttgaaaaagaaaagggaattattgcgtcagcggctagggttcgcggtggaccgggtgcacggcggcggctcacggaaatgaacggccgagatcgatcctatccaaaacggacggccaagatccatcggtccacgaccgggccacggggaacgacgacgatgacgtcggcggtgacgtcaccaccggcggcggctcgggcgtgcatgcttgccggcgaatgacggcatgacagcgcgaacggagggcacctatgggtagcggacgacacggcgaactcaccggtgaccaaagtagcggcggaggggcaacggacggcgccggcgatgaggaaaagggggcagagacgatcgggtcgacggcggcgacggtgctccggcggttgacaacgacggcgaagggacggacgacgacggcgatgagacggcgaccacgacgatgacctccccgagtgacggcgatgactggagcgacgatggcgcacggctagagcggcggcgacgacggcgacgcgaggctacacggtgctagggttctaccggcggcgagagacgaaggcgagggtggcgacgggtagcggaggacctgggggtgcttatatagggactagggcgcggcggcgaaggcccacggcgaccggcgacgcgatggaaagattagggttcgggagagagagacgaatccgattcgagatcgaatccgcgaatttccaaagcgatttaaacgatgtttccaaaagggaaaaggtagagtggatcacggggatcctttcccctcaattgatttcaccggaaacggaaagggacggccggatttggaaggagatggcggcggcgcgccgctagggctcgggcgatggtgcaaggaggacgacgacgacctgacaggcgggccccacctgtcagcgtccgagggcgctcgcacgcggctgctgcgggcggactgggccggcttgggccgaggagagggagagagaaggttttgggccgactttcgacccaaaggcaaaagagaacttttaaaaccttttccaatttaaattattcatgaaatgaaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacagaacctacaatttcacctcaattgagccattgcaacattcaatcattactcaagttgagagtgatcaagatgatcttggtaacactgagattatatttccagattatgaggacaccttggcttatcaagtacaagatgatgcagatgcaactgaagatgataatgcaaatgcggaaaggcttaaagagatgccgcatagaagggttgttgttgtaccaagaaacaaagaagaaaaagaacccaagaggcaaaataagagtgttggcgtagaaggacttatggaaaggtaccttgatatgaggaccaaacaaactgaagatgaggctgcacaattagcaagagaaaaggaggctcagttagcaagagaaaaggaggctcatttagcaagagaaaaggaaagtaatgatttttcaatcaagaggtgcatatctgttctgaattcgatggatgtgacaaaggcagaaaaggtcaaagcatataccgtcttcaagaatgcagagaacagagagatttttgtgagtgcttgtgatgaggatccagaatctgccttgagttggttaagaagtgagatggcttgaaaggtaccgcttttcttctatataaatcttttttggtctgctaggcaagtaagatgggcttcactctgtcctgtgtgactctctgttgttagttacatgcatgttgtttagggctgtaaaccaagatttacattatgggctactcacctttcttttattttcttgagctgataagctcactcaagtctgaactgatactactcttagcatctgaaaaagctaaacttaagcagtatagcggtgcaattttacttactttgaagcatctgctttgctcctgataaaagaatgttttttaaggtaccgtgtggctctagttatgtacttcattattctggatttttcacattttggtccttttaaaaaacttatttcgcaaatagacccctagaaaaacttatcccagaaatggtcctttttgggacgccagagtggctggcgccattatccaactggac

SEQ ID NO: 25391 - DNA, 1009 bp, Oryza sativa
ctccccctcccccaccacccatcgcctccattcctatttctctatattgcaacctttttatttttgttttattttttttggatgttttttcgcacttaggatacgatacaaccagctaaaaaaaattaatcttgaacggaatataccacttagctagatatccgaaaatagcataccacttagcctattttgcaccttcatcagaattagaccataacttctttagtaaatacctttgatcagcatgttaaatataatgcactctaccactatatgaaattacttaatctctaattcaaaatataaccacatgaaatgatagccataagttaaatagtacaaagagatgcagttttttttatttttattttatttttttgatatttttttcacacttaggagaatacaagaaccaaccatagaaaaaataaactcaaaacggacaaaatatgtgacttatagaattttccaaatctctaccgaaacggacaaaatatgttatttattaaaataggcgtaactttctcatacggactcggaattaggcaaataatatatccacggatatctacagaaaaagttatatccgattcttcccgctctggcgggttcggcgatattagaacctccaaattccgcttgcaagattgtgttttcgaggagatgtttttcggtagagctttggaaaatttcacaggccacatatttcgtccgtttgagtttattttttatatggttagttcttgtgagttcctaagtgtgaaaaaaatatcaaaaaaaaaaaaaaagttgcacatttctctcctctgcactagttcggagagagaggagaggagaggaaaaattctacaggtcacatattacgtccatttgagttcattttttctatggttggttcttgtgtgtctctaagcgtgaaaaaaatatcaaacaaataaaaaaaaataaaaaatttccggggggaagggcgccagccactctggcgcgctccccctagccacctcagcat

SEQ ID NO: 25392 - DNA, 750 bp, Oryza sativa
cacactgtcacactatgtgtataaatgatagaaatgataattacctagcagcattttattattcagtctattcaaaagtcatgtgaccttaatccatcctctattcaaatttcgatgaatgattttttagatacgtgtgaccttgagttgcccttaatttataaaacatatcttatgaacaaaatataatcttttatttaaataatatggatgcccacacatacgcgtgggccaccttcctagttattaagaacaaccgaatcagtagcgagttatataccgtgttattggaggaagtcttaatttagttaattatttgaaaaccctggttaaatgtgaaatagagaagctcgacgacaagttttgagatatactttattatttgatgacaaattatattgccgagctataggatgaactagaaaatccgcgcgccagttggcgcgctaactaatttgcaccttggtttttccatgtataatattttatttacgtaaaaatcatacacttatcccttaactggatgttattattattattattattattattattatttcatatataatgctttctcagaagttcagaagatccaattatgatagctgtgtttatctcaaagttgttgatggttcagctatatatttgcttctttatattgatgatatgttgatagctgcaaaagacaaatcagaaatagcaaagttgaaggcacaattgagtagtgaatttgagatgaaggatttgggt

SEQ ID NO: 25393 - DNA, 753 bp, Oryza sativa
cttgattagattttgccccatccggtactaggttactatatatgggacaaagggagtagttatgggtgggtgggttacaaaactatcgcaactcatgactttgtcgcatgcgttgtgatatgcattgcgctataatcgtccggactaacaatattcactaaacaaaattgttagtcctctctaatcgtattgtcattaatcatagaaaaaattaggggccttgatgcactttcatccacaaaaataaaagagagagaaaaaaagaaattatggatcagatctagagaaagaacaatggaggagctctggatttggatctgaatctgtcgccggtcctcctcctcgtcggcgtcgtccctcatcgccgagcagctgtgcctttggccctccttgcctcaccgagccgctgttgctagctccgctttgccgagccgcctccattggacctcctcgtcagtgccgagcctcgccgagccgccaccaggcggcctccttgccaaaccgcactgaccccgccgacatctttccgccttgccgagccaccgcctttggaacactcctcgcgaagccgcaccgaccctgacaccgaccctcctcctcctcctcgccacgctaccgccggccctccctgccgaaccaccgccggacctcctcctcctgtcctagttggcaacgaacccgccggcgggtttcccccctggtaggctctaagaagagggagagggagagggggtgagaggagaaggagagggg

SEQ ID NO: 25394 - DNA, 9643 bp, Oryza sativa
  unsure (1)..(9643): unsure at all n locations
atgcctcagccttcgactactccgagtggacccagcaggttggtggtgcggtttcggactgcgccactgtgtacagcgattgttgtgcgcgcgtatcggcggccttcattatgggccttctgcaacagttcggctgtgagcacgtcgccgagttccctaactatacgaagggggactgggaggttagtgcgcagaacgtttcgcccgcgctccgtgcgtggcgaaagtagttctggcagaaggacggccgatccaccgccaaggcgtgtcttctagagcaactggtgaaggctgaggcggcagaccggtgcaaagaagaggacgcggcggccgaagggggtggaggcgatgcccaggatcacccagaggtgtgaggccctccgccctttccttagattttcgtagttttccttcttctttttgtgtttgccggtagaggcgaacgatgtaaattcggtgagctgttcctaaccctccttactgtacccgaaaaaggccccttggatatttggaatatatgactcaatcttagccaccttttatggtcgacgcctgtggcgtatatgattacgccactttcgcattatgtaatatttgccctttttttacccgttcttactatgcaattcgtcttttgccctttctgcactgtctaccagggtgttcaccgaaaattgtgcattcggcccccttctgggagttggcaaagcaaaaactagaaatttgtggcgttgaagggtttgccgaaggtgcgatgcccagttcggcctgtttatcgcgaaatggtgataaacggccgcagctacaaggtttttaaggttgccggctagctgcgggcgcaccccgggcgaaccttagaagactgcgatcttgttcatacaagacgtttggaggatatggctcgcttttggcgaaatcatcagaagactgatcgggaggaggcaatctcccggcgtcgctacagtgtagtttgtgtttcgctcccttcccctcttagggtcgtgtatgatattagtagtgatgacgaacctagtgggggcaaagatgtaatttatctgtaagctgggctgtaaagccattgctcctttcttttatttgtaccatgttgatgggtttgtattcttcgatacatttttctttaaaatcaataaaaatgcgttttatttccttttcgctatttttgcattgtcacttcgcgtgctttcgttgggtcggaacgtgtcggcccctttgcgtatattagcgaaataggttttgacttttcagctttcggcttccgttttcgatccgttttgttctacgttgcaagaagcactcgtgctttccttttgattgagtgtaacggtgttcggttagttgtttcccgaaacaagttgttgcggtttcaacgttcagctagcgatgcttcggnccgnnattcgtttcgcgccccccttggcctttttcgcttgatcaggcgtttgccttggggtttttccacaaattatcaatcacacaaataaataaaaagaaggcctccatggtggataataacactacatccagttttttgtcttttttcattttcctctttttttctcttttttttctttgccgaaaggcttacatagtgccgaagggcttacataacgatatatacattttttcaagttggcgatttgggtgccacccgttctacacatagaaacgcttgagagaggcagcgttccaggaatggtcgaactcttcgccttccagtgtcaccagtcgaaaggatcccgtcctggacttgtgcttgatgaggtacggtccttcccacttcgattcaagcttgccaatggctatcgggttcgccttcttcgttaggacaagatgaccaggcaatagctccgtcggtcgaacttttttattgtaagttgccgaagtgcctgtggcatacttgcgcatgtgttcgagtgcttccactcttaccccctccaagagttcgagcgacaccttgcgcccctcttcgcccccagagaacatcactcttggtgaattagcctctagctctgtcggggtcattgcctcatcgccataaaggagcatgaacgggctgaacttggttggtcttgtgggggtcgtccggagagcccagagaacagatagcatttcctctggccatttgcccttcgccgccccctcaagccttttctttagtgcttctaggatcttaccgtttatgcgttcggctgccccatttgactgcgggtgcgcgtccgacgtgaacctgatttccaggttacgcccttcgcacatttctctgaacttgtcagagtcaaactgcttgccgttgtcagtgatgaactcttttggcactccgaaacggcaaataatgtttttccatacaaatttctgtattgttgccgaagtgattgctccaaggggttcggcctcaacccatcgggagaagtattcgacggccacgattgtgaacttgtacccatttcgcgccaccgggaacggcccaatgatgtccaatccccatctggcgaagggccagatgggtgagatgggccgcaacttatactggggcacggtttgacttcggccatggcgttggtagctttcgcacttcttgacttgctcaacacagactttcaacacggtgggccagtacactccttgtcgaaacactttggaggcaactattcttgtggcctgatgcgcgccacagagcccctggtgtatctccctcgccatttcctcgccttcggcaaaagagatgcagcgaagcaagggttgaagtacctcggagcgatatagctggcccgagaccatcttataccttgcggctctgagttgcaggcgttttgcttctgcttcatcttttggtagccagccagtttcaatgtatttcacgaacggagttcaccaatcgcatggatcttcgcccatattctcctgatcgattgccatgacctccaggctgtccatgggcacacttggtgcgtataggacttcaaaaaagatgccaggcgaatgtgggccaccataagcagcagattttgccaaggcgtctgcttcctcgttctggcctctaggtaaatgttcgactgttatgccggtgaaatacttttccataaaccgaacggcctctaaataccttttcattccatcttcttttgcctcaaaggatttgtcgacatggcctgccaccagcttggagtcggttcagattagcaagcgccgaatccaccagcttggagtcggttcagattagcaagcgccgaatccctaatgctttcgccttttttaggcctagaagaatggctttgtattctgccgcgttattggttgtgtcgaactgcagccttgcggcatatcgaatcggcacaccacttggcgaggtgagtactgccgcaatgcccgcccccttgtgcgaccacgaaccgtcggagtacatcacccagcgctgttcgacgggttcgggctcgggggcgaatgccggtgtccattcggccacgaagtcagctagcacttgagacttaacagcagtgcgggcaacaaaatgcaagtcgaaaggggatagctctgccgcccacttgataagccggccagtaacttccttgcctcgaagtatttcgcccaaagggtactacgttggcactatgactttgtgggcttggaagtcgtgtttaagcttgcgcgaagccatcaccaggggcgtacgcgagcttttccatttcaatgtatcttgtcttcactccttgcaatacttcggagacgaaatagaccggtttctggcctgactctgtttcttgcacgagggcagcactgactgccactagcgaagctgccaggtatagtagcagttcgcttcctggtgctggactgatcagagctggcgggctttgcaaatattgattcactcgtcgaacgctgcttggcatttgggtgtccaattgaatttttccgcgccccggagggccttgaagaagggcaaacctctttcggctgcctttgagaggaatcgactgagtgccgcaattcggcctgcgagcttttgtacttcacgtacgctcgacgggggcttcatttgctgaatgacatctattttctcgggattcgcctcgatgcctctttcagaaaaaaggaaatccaacaacttgcctgcgcgaatgccaaaaacacacttctcaggattcagtttcatacccgctgcgcgcaagttgtcgaaggtctcctgcaggtcggacgcgtggtcgaaagccttgcagctttttacgacgatatcgtcgacataagcttccacatttcaccctaactgcttgtaaaggaccttgtataccagcctggcgaaggttgccccggcattcctcaggccgaaaggcatcctgagatgacaaaaggtgccgaacggtgtgatgaaggctatcttggggatgtcggccgggttcatgtggatctggtgatagccggaatatgcatccaaaaaactcatgagttcgcagccagctgttgaatccacgagttggtcgatccgtggcaaaggaaaatcgtccttcggacatgccttgttcaggtctgtgaaatcgacacacatgcgccatttgccgtttgatttccgcaccagcactggattcgccagccactcaggatggtcgatctcttggatgaccccagccttgagcaatttttggacttcggcttttgctgcttcttggcgatcagcggacatcttgcgcagcttctgtttccttggcttggcatccggcttgactgccaggtgatgcatgatgagatctgtcgaaacacctcccacctcatcagggccctaggcaaagatatcactgtttttcttgagtacctctaggatgttcgcagcctcttcttcgcccatgtcgccccctagcgatacgagctttgtggggttggcgtcatcaatctgcatcttgattatcttgccgtgaggggcaggctttggcgcgtgcttcgcccggtcatgtggttcggcctcaacattatgcactgctctgttgattatggccagatcgcctttcgaagaggccgaagactgaagccccttgactacgatcactcccgccgggccgagcgtcttgagcttcggataattgtggtgggagatagcttcgaacttgttcaaggtcgcatggccgaagatggcgttgtagttgtacgggatgtccacaacgtcgaataatacttgctcttcgcgtctgttttcccctgtgccgaaagctaccagcaactgtgttaggccaagaacttgaactgcttctctgtcgaaaccacggagcgaggctggtgctagggtaagggctagagtggacaaccccatcttggcatatgcttcggcgaagatgacatcggccgaactgcctccgtcgaccaggattcgctggacctccaagccagctatctcggctgagatcaccagagaatcttgatgcgggaacattactccttcggcatctcccggcccaaaagagatttgctggttcagatactgcggggccccttcgcccaccgaagtgatattgtggaccgttcggagccgcatcttcttttatcgcttcgatagttggatcggcgggtcggcccttgtaatcacttggattactctgcgatgcgcatcttggtgctgttcggccgggggtgcttgttcttgagctgcttcacgaggtgcttcgacagctactccatgctgcggctttggatcttgcgcgttgccacgttgccaaatgttttggcattgctccgtggtgtgcgaagagcgtccatgaggcgcagtagaggtcttttcggaacttctttcggacaggctactgatggttgcctgcttgctgggtgtcgaactccttgcgaagggcttttacttcttcgacatccatcacagccttgcccgcgcggtcggttctgaacttcctccaggtcatgggggcttggccttgccttggcggttgtccctggatcgccatctgaggctggcgaacagcgaggggaggtggttcggcaacctgagcttgtgcttaggcttgggcagcggcgaaggaagccttatcacactcagcttgtattgcttgtcgtcgcttggaatcctcttcgccccttgcgtacccgtcaatgatgcgaagtaggtgctcaagggtctgtggctccttgttggcgaattttcttgtgagttcgcccttgagtaccccggccgaagcggcgtttatgacagacgcctcggttatgtcttgcacttggcaccgggcttgcgagaagcgatgcatgtactcccttatcgactcccccggcctctagcgaatgctgagtagatgctgctgcgtcttcggctcctcataggtgcctcagaagttaaggacaaagacatcgtgcaattgctcccatgagtaaatgctattggctggcaaattaaaataccaagaacgggcgatgccgtctagatcgagatgtattacctttgccttggtattttcgtcatcgtgagccgcttcgatcgcggactcgtaaatggagaggaattcctttgggtcaatttcgcctgagtagcgtgggacgggtgggaacttgaactggggtgggattggacgggtcttgattcccccactcagcggtagccccttttcgccccctgccctgttcacggcaccttgctgcgggtacggcgtagtgaagggcgaaatcacggctttcgcataaggttgggccatggcattcggctgcccagctccgattggtgatgcttgctgagccaccatggatgggtcgaacgttggctgggaccatgccatggcgacctggtttggtgcttggtttgctccgaagcctggcgttggtgcttgcggccgaacggttggtgcctgagcagcattgatgaagtcgaactgtggtccttgactccaaggcgaagcccccagacctgtctgattcgacggcaaccaactaggtgcaacttgacttgtattctcctctgggtgggccgaaggggttgtacctaaaatgctgtgaggttggctgacttgctgaaggaaagcttggagctgcgcctgcagagcggaagccccttctgccattgtttgtgacacttggccaggcggttgagggtgtacttgggcagcgatcggctgagctagtagttgcacgtgaggggctggatgcaccgctgcggtcgagggctgcccgacgaagtatactggcgctcgcgtaacttgtggcggaaggggctggattggtgcttgtggatagacttggggtgggacgtagcctaccgaatactggaggattggggccgaagcgaccttggaccgcctcgccgcctcgtacgcctgctgctgttcttgcatctggtgaagcatgtcttagagtcgtgtcatgttctgtcgcatggcttccatgtcgacttcggtttgtatttcggggtcagcgttgacttgtatagcggcgagagcagtcgaggccgctgccggctgcgacggagcggcttgaggcactagcagttggcttgctgcccgggtctggagtacccttgccgccatggctgccttcgccaagtcagccgtgttcggcacctgcgtagaggcggcaggagccgaaggcggtagtgatggcgcaggtgcggaggcagacgacgctcctccatcttcggcgacgcgcgccgaaggctctgctccctcttcggcggccatctccaccccggcttcgctttcctttcaccttgtaaccttctccttcactaccctcttcggtggcattcgctctcagtgttttcgctcggaggtccccacggtcggcgccagtttcgacaacagcttacgtcgaaagacgtggtcactcaacagtagttggaaaataagtaaagtgtattaaattgagaatttttcttgggatccccctattacaaggccctatgggactatttatagcccccattacaggttcttactactagggttttggttatacaggggaatttacatgggtacataatgtaattgaggttcatgggcccttgatgggccgccaggcaatcgtcagcccaatagcccctaggcttgaagggccgaaatggcttcttcggtcctcgcgtgggcgaacttgctatggcgaagtcgtctcccttcggcatatactcttcgccctacatccttcgcccaagaggccctagcccggcaaggtacccgcgcgattccccgcctctcgccgtctttgtttcatagccttcgccatgggggggcttcgccctgactaaccttgatgcctcgggcttgaatccccactggtcgcgtggtttcggcaggtttggtcgaagggcctcatgccataccgccaaaaagttgcaagtggtttctagctaagtccctgtttggctccaggatgtttctgaaggatattatcaggatgagcattctaagaatttgttgacacagctatccttttcccctgaatccagacctccattctctcttcgtagtggcattctcaagtataaggggagaatatggttgggtaataattgtgctttctagctcaagataatatctgctttgcatgacagtcctatgggtggtcactcaggttttcctatcaccgatagaaggatcaaatctttgtttgcttggcccaaaatgaagtctatgattcagtctgtggtgaaagaatatggggtctgtttacaggttaacttgacagaagcaaatacccagggttgcttcagccactgcctatgccagatggggccggcaggttatcacaatggattttattgaggggttacccaagtctcgtcattttgattgtattatgttggtagtggataaattgtccaaatatcctcaattcatgcctttatcccatccatcttctgcccttgatgttgctaataccttcatgagtaatgtgtacaagcttcatggtcttcctcagtcaatcatatccgatagagaaaagattttcaccagccatttctaggagcagctttttgccatatcaggactccctccgtcccagaatatagcaacctaagaccgaatgggacgtatcctagtactacgactctggacatgcctcctgtctagattcatagtactaggatatgtccaatccggtcctaggttgctatattctgggacggagggagtacacaattacatttgtgcaccgcttctcaccctcagattgatggacaaacagagcgtgttaatcgatgtctagaaatttatttgcgttgctttgttcataccatccctactaagtggaattcttggctctatttggctgaattctggtttaatacttcttaccattctaccatcttgtagtccccttttgaggtgttatatggttaccctcccggccactttgaaattagggatgattcttgctctgttcctgatttggatgttaggttgaaggagagagtatctatggttcagctgttgaaactgcacttgaacagagctcagcgacaaatgaagagttatgcagataaaaacgacagtttcagagaatttcgtattgttgatttggtctatttaaagttgcaaccatatgtgcagtctttagtatctaggaggacaaatcacaaactctctttcatatattttggccctttttagatattagataaagttggcaaagtcgtctattgtcttcaact

SEQ ID NO: 25395 - DNA, 4360 bp, Oryza sativa
  unsure (1)..(4360): unsure at all n locations
tggttaggctggtaatctcacgaacttatttactgtaaaataaaatgtggcacatacagtactagaaacttttctaaaaatgggtatagctaataaagcctgtatatacaacttataaaattcataataaaatcatgctaactctaaaaatgatgacactaattttgttgaactcatgagaacgtaaaattcactgcagtaacctaatacttcacaaaatttgtacctaaaatgtatcaaaagcttaataagacataattaacctagagctagcattaaactttaaaaattaataactcataaatgcaaagtgataaaatagaaaattccttcactaaaaatcatatgcacctatacacagtagtgaactcatgcattttagagcattttaattttttacatgttttggcatttatttgattactgttatttcttttagaggacaaattcgatatcagtgaggaaattggatatattgctgacctcagtgaggacattgatcaaggcaagtttttcctctccctttgaacatattgaatcccatgtgtttcgggctaaaagtgttcttttatagagatgcatgtgtaattataactattagtaatatgcccgtactaacgctacgacgatatttagtaatatgaattaaacaatcatatgctaaaagatacatattttagcaaaataagttcaaatgtctcaaaagctgaaaaaccaaacaatggtatatatattgttgtaatatatttggtctaaaaataatttcatattcctgcaaattatcgtacatgtcgtagtaacatggtaaatttgaatttaccaaacctaggggactgtgatgccaggatctactggaactctagcataatgttcatatcaagcagaacatggtgaaattcttcaactacttgcatacacaaaatgctcaaatctgttgattacttcaggtgatgtaatgcaatcacggaaaccacaaatctaactgtagatgcatgatttaccaacaagtaaataattgattgtttaaagaatctcaagaacgtgtgttagcttgctattcgtctatagcacatgaaatttactacgatggtgggaacaaaaatcatgaaatttatttgttgcagctctaatttcctaatgaacatgtacatccatcaggtatattttagttgatgcagacacacatgaaacatatattactcccttagatatgcacctacatagtgaaagtagtagaaagaactatccatgtgacaatcattaaaaccttgagaacaatctaatcctaactgataatatttctggtcatgcaatgcagtttgaaaatcattatctangcagactttagtattatgggtagcagcagcacaggtatagcaagatagtgactaaattagtacaaaatccccatctctgaaggacacgggaagacaacaataacctgaaaaatatcttcaagatattttctttggcttcattagaatgaatcctaaaaacctacacagctccttgttcaaatggtattcacatagacactgcttagaattgatcatccgacacaaattacttgtgcctgaataaaggaagtcagcaagattcaccgagcataatgccatagtagcatgaaatgcaaattgcagttcatgtacaatccaatcgtcagacttgcaggatacaccaactctgactctatattctttctgtttctgctctctaattagtgatagtgaaagcctctgttttgaatattatacaatggctaaatctagcaaagtaatcctgcaaatcaaacggcagaaaagttaatcaaaacaaaacgtcattcctccatcagaattaataaaaatccaacagggagatcgatcaatttgtcatagtaagtaaaaaaaaaagctagctagcaatagaacagagctattcacctattcttggccactcgtcttcatcagcacgccggcaccccgtctccactttctcctctccacagtgcctttcctccaaccctaggattacatgcagattacgaaaaaaagtgggactgcatcctgatctagtagcaaggaaccggatcaacagcgtgtgacggcgtctctcccacaacctcctccatcgtgctggcctccgatcgagaaagcatggtgccccagcggttgtgctcatctccggtgaccgcatcgctcgctccaggcgacgagcagcagcgatgatcgaacgacctcgagcggcggggagagaggggaggttagggtttagcgttctacgagaagctgggggtcagcggcgacgtcaatcgtggcggggcggtgtgatggtgaagatcgctggcggcgcgtgacggcgtgagagggagaggagagagattagggctgggggaggagcgatcacggtttgggcgtggttggggtgggaagggggtgctcatttgtggggagggtgaatctggagcattggatttcacagggataatctgaaccgttgagtaatgaatgaaagaatgagtgaaagtatttgtttaactataggtagattgactatcttcaaaattcggaaaatgatagctatatcctacttggtgcataaccaccattaaaaaccttgctaacttgctgtttgtagccataggaatatttagagtacattgttagtgctcaaatgaaactatttaagttttatgtgtaccctgcttagccatgcctagagcttttatgtgaatcacttctatattctgtttggacattcttaaaccttatggacagaggtgatgctctgaatatttgtgcactaaaatgatgaaaaatgtgaattttagacttgggcggtaaatggtatgcatatgacggtagttgcataccaataagaggattgttcgcatgagttgattaaggatcaaactacataacactcactcagggctgcagccaagatttagtgactgggggtgtgggtcagaattcaccagtgactcagccgacattggtgcggacgtgtggtcaacactatgtattggcgattagctataatagaaagaacgagaacccactggttaaggccctatttgttttaacttaagattattgtaatctagattattaaatcagattactctaagctggattataataagctaacataaaataagcagcgagttgtttgtttctctagattatgaaggcatctaagggtagtgggtctttagccacccaataatctggaaaaagctcctccagaggagattattagattatagtaatctagcttacaaattatgataatctacttgtttgtttcagcttactcataataatttagattataataatcctaagctgaaccaaacaaggcctaacattgggctctacaccttagcgacttggcttttgttgatggcagattggccctatccaatcacttcatatttgcaataaatgtgtataaatttgatatgttcacccagtcgtttctcgtataattatattttggattatatggttatttgccgacagcactaatatatgcatgtatgtaggttagtataatataaaaagaatcatttttaaactaggtcattaaatagttgttggtggctattaaatgtcaaatttatgccgccaatacctgcttatcttcttgagtccatttatttggctttacaatatatataatgctggtatgtccaatttatccctaccaagctccacctacacagcctagggacaatttggcaaaatgtgccttggtgaggacccacaaaatcaaaacaccagagtaattcgagagtaatttattatgaggagtatagccattttgtgaaaatgcataaaacccccaagagtcaggcaggaattgagaccgttccatttatcaattgcccaagatggtaagttagccactgttaaagttcacaggtacgagaatggttttgaataatttatgtgcttgcattatatcttggaaatttttattctacactagcttcttaaccttggatgagtaaagagctaagtgtgggcggtttgttggcagctataaaatgccaattttatgtcgccaatacctgcataatacttagataataaaatatataacatagtggtagggcttaattctggtatattccatgagtgttggtgtatattcggatgcaggtattaaaccgccaaagttgggaggaaatttagaccaaagtgaaaaagaattctatccatacaagagttgggctcctaaactccatcaaaacaccaaaaaatgggcccaactaccggaaaaagggataaggcaaagcaaggaggagacccagaccaaatctgggggccatctggcctagcccaggttcggccgaaccctggggatcgctgttgga

SEQ ID NO: 25396 - DNA, 765 bp, Oryza sativa
ttcataatttattcaaatactagattatttatcatgagttaatataatttttgtagaatttttacactttgttttgacctcattaaaattcaattcagttctcagcattccccttttcacctttttgccagaattaaaatattacgaatttttgagtgaaactttgaaaaatggaaactaggtaactcaatctatctccacaccagaaaacacatttttgacactcttgtagataggtcaatctagttacccaagaatgagaggaagaaaatgcctgcaaatcaactagtttcaatgtgtacctatgtttctaaccttcctttatctgtcccgtggacccagctcgacttggccccacctgtcactgacctaggctctccaccaagccccatcccacctccaggtcgtgcacccagctcaggttcataaggcaagcaggaaaccctttcatcttcttcccctttcttcctcccttgtctgttctcccatgagctgagctctctcctaattttctccttcccgaatcttcttgaaaatgcaagaatcaagccctgcatgtcacaccactagatccttgtgattctaagctttccatccatccaaatggcttgcacatgcatagatttgtggggagatcgagaagaaaagagaaggagcttgctgcttggtgcagtagcagtaacacttcgttttcctccacttggtgagcttccttccccatccatagcttctttcttaggttccctaatatgctgagcattccta

SEQ ID NO: 25397 - DNA, 2330 bp, Oryza sativa
gtactcatatactccgaaagtatttcaataccataaatgtatttagaagagtattttaataaaattacaaagcttacaaaagaggaaaggaaaactgctagagccatacccgaactcttccgaaggcttccggactcctgatttctactctattcctattccactagctagatactactaaactaaacttaagagaaatgagagagctattgcttgaggtgtgtgagtgaagtgagaaggtgaagtccttttatagctgaactatgacggttgtgatggttggaatggttggtaatagcctccaaccgtcattggggcttcatctcaatggaggcgagggaggttcagccgaacctggggccggttcaatccagcccaatttcggctggcggccttctccgttgttcttctccgcagacttgtgaatttttgcccaattcatcgtgtcaattctgagttcttggcccattcatacacaagtctagttcttgacatcgtccgattgatttatcgtctgagttgatgtcgattctcctccactttagtgtcattccctgcaagaggttagtatacctaatactagtggaatattattattctaacatatatatatgcattgcaagcatcactagttctcctctattttggtaatattgacggtcgaaactgatcaataacgaccgtcaacaaaaccccccaagcttgaacctttgctcgtcccgagtgaaggacgaaaggaaacaaaaacttggttgttgatcaggagttgctactatgctgcatatctcaaagatacatgtgtaaggtatatgtactctatctcagattaaataatctttggcacggtggcttacccttacccctgattcccacgagaccactgcttctccttgccttgggcggttgaaagacagaacaacaattagagcaccaatcacccaatttttattcaacttttatttcggaaggtttcaaatgattttgcaaaagaaagccaagttgctcaaatgattcactcagtctctccaagtgtatcaatttgaatttctcaccaaatgttgcctttttgattcctactctaaggtttgatatgtagagctcggtaggaatcagacatggcatacttgcattcacacttatcactaagtcaaaaacttagactagagcagataactaaacatattcaagatcaagatcgtgcaaaatgtgtgtgtggtatatggtggaaatggtatatgaggaaaaataaaagaaaaaatgcttctcatttgtgcttactttcttctcccaaaaatccttcttttattgattaggagagggcatggttacaatttttttttcatcatcatgctcatgtttgatggagcataactttatttctcataaccacgcctttccctccctttttttttcttttcttttcaggagaagaaagcacctgaaagcatggagaatttattttggtggtaatatggaaatggaatggaatattgcttagctcccagtgtaggaatttagcatgtgcataaatgtgggtgtatgatcttgatcatagagcatgagaagtatctacacaagtcacaagagtttgacaaagttcaatggaatgacaagtaaccaaaatgtatatggtttaatcatgatagcacatttttggctctggtaggaatttatatcaaatgaggaactctcaattttatcattttgaaagacaaaacatccggaattcaagtcaaactagtatccggatcacaacaactcatatttactatctcatatctcgcaacaacctagacttagatcagcaagtgtagctcatttacctcaggttcccggataattgttggctacttatatttaacttttgagagagcatttaccaagaatccatatataatagatataaaacagagcaactattcatcatttcaacaaagaggactagcttgtcttacctagcatgactcaaacctatcctatttttttggtattttctattttgcaaatttttatgttgttttcaagttttataagatgcaattggaaagcaaatatgcaattggaaagggaaatatgcaatgtgatacaagttacctcagtagggggagcgatgtctccctcccaagcttgactttcgctcagggtccttgataaggattgaacccctgaaaacgaaagtacgcctgaaggtcatcgtgctgttgctgcatcatgttgttgatgttggcgaactgagcattagcagattgttgccattcttgcgtttgagttatgtgttctgcgaggttgtactggatctcccccgtctgcatatcaaaggtgtccattct

SEQ ID NO: 25398 - DNA, 6969 bp, Oryza sativa
cgctggcgatgtgggcgacgtggcccgggagagagcgggaccggcggttgcggggtgcggcggcgccggctggaggttgggagaggacccgacaggtgggccccacctgtcagtgaccccgggtgagggaggaggcacgggcgcttgctgggccgtggccttcggccggcccagcaagggcgcgagagggaaagggaaagggaatgggccggcggcccattaggaaaaaggaggggaaaaagaaaaagaagaagggaaaaagaatttccagggattaaataattgctcgtgctcatttttaattggttaaaattatttctagagctctgaaaattccacaaaaaatcctgttagcatattttgacatgtagaactcaagaaaaatcccacatgtcgattccgattattacttgcattaattcaattagggtttctctcttgcattaacacaggtaatttcttgcgaccacttattaattcaatttaggcctaggagaagaacttcagggtgtgacaaacctaccccccttaaacggaatctcgaccccgagattcagaagagctggcgaagagatgcagatgggtagccttcaactcatcttccctttcccatgttgcttcttcctttgagtggtggctccactaaaccctgcagaacctggtaaccttgtttctggttcttctttcactggtctcaaggatgcaaactggcttctccacataagtcagatcttcttgaatatcgatgtgctctgaatcggcttgttcttctggtaccctcaatcacctctttaactgaggcacatggaacacatcatggatacccgccatgttggatgggagttctagctgatatgcaacttctcctctttgttccaagatcttgtatggtcccatgaagcgtggtgccaacttgcctttcgtctggaaacagtgtactccccggagcggagtgacacgaaggtatacataatcccctgcttcaaaagtgagctctcttcggcggttgtctgcgtagcttttctgtcgagattcctttctctaatagttctgactttctcctctgcctcagttagcacttctgtcccgaacagttgacgttcgcctgtttgatcccagaagatatgtgtgcggcacttccggccatacaatgcttcaaagggtgccatttgtaaactggcctggtagctgttgttgtaagagaattcagcataaggcaggcttttatcccaagctccgccaaaatcaagtgcacaggctcgcagcatatcctccaacatctgattgaccctctcagtctggctatctgtctgcggatggtaggctgtgctgaaattcaaacaggtccccaattcttcttgcagcttctgccaaaattttgaggtaaactgactccctcgatcagatacaatcttcttaggtaccccatgcagacacatgatccttgctaagtacagctctgccaatttttttcccgtatacgtggagttaaccgagatgaagtgagcaaccttggtgagacgatcaaccaccacccatatggaatcatgccctgacgatgtccggggcaaacctgtgatgaagtccattccgatttcttcctatttctactccgggatctagaggggttgaagcaatcccgtgggcctctgatgttctgccttaactcgctgacaaacatcgcagagcgcgacaaactccgctatttcccttctcatgctggcccaccagaatttttctttgagatcctgatacatcttggtactgctgggatgaatagagtactgggtctgatgagcctcagtgagtattaggtctttcaactctttgtcatcaggtacgcacaatctttctcccaaccagattgtgccatgttcatcctcgtggaaatcccaggcttttccgaccctcatattctttttcagctcagctatttcatgatcatttacctgagctactcggacttggtccacgagcataggccgtgcctctagggcagtcacgtactgtaacgccccgattttcgttcgggattaaaaatcaattaataatgcatttctagaaattatattaaaggttaaatcaatttaatcaagtgaaattatagaggaaattaaattttcctttaaaaaaatcattggccgggaatattttgcaatattctttgtgccccaaaaatactctccggatttttccgcaaattttcggagctcaagaaataattttaaataatcttccccttcctcccttttgggcttggcccaagccttcccctccactcccgtgggccgcgcgcctcctccctctctcggccggcccgcgccttgcgaaagtcttctttacgttccccggttttcctcccctcctccttcctaggccggcctcctccctcggcccactcggctctctctctccctcaagtctgctttacctcactcgcccgttttcccctctctctctccccgacaggtgggacccgaggccccacctgtcatcttcatcccttacctcccgtcgccccaaccgccgccatggccgccaaatcctcccacgtcgccgcctctcccgcgcgactccctctcccgcgcgtgcgtggacgcggtcgtgccccacgtcggcgccgttttcccccactctccccacgaaaatcggcgccggttaacccctccaccaccccacgtcggcgccccacttcgccggccgattccgccacgtccggcctcgatcccgccttcccgagcccataaaaagcacccccgtgctcccctcgttcatttccccttatttcccgggcccggcactctctccctcgctctccccacgtcgttcccgcgcgccgccacactccggcgaactccggccgccgtttcccgtcgctagggtcgccgccgcactactccgccgccaccgctggctttgccacctcaagggcacgctcggccgccgtttcttcctccccttccaccacgcgaaccacctctccaccgtgctcccgctctccatcggtccccggcgagctccggccacctctagccgccgccctagccactgccgcgccgcgccgtttgcaccaccggcttctccgtgcctcgccgcaccccggcctccgctccgtttccccatttaatcgccgcaaccacccttccaccgtgcatcccaagccacctccaccctacgccgccgggccgccgttccgccttcgtcccgaggagcgccgacgccgagctcccccgcctttccccgcccctcgtcgtcgcgtccttggtgagctcctcctctccctccttgcctccctcctctatctcccgtgcgtgctgccgcgccggtggccgccgccgttaggtcggccggccggcttgtcgctgccccgctcgcctaggccgcccggatccccttgccgcgccgcgccaccgctttcccgcgtgcgtcggccgtcgccgcaggaggctgcgccgccgtgagccgtcgttcggccgggccggcctgagctgtgcccgtgctcagccgcgccaccccgtggccgcccgatcatgtcacaccctaaaaatccaaaatatataaattgttgtttaaatggaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttcttttggctttgagccgaaagtcggcccaaaaccctctctctctccccggcccaagtcggcccagtccgccgcagccgtgcgcgcgccctcgctcgctgacaggtggggcccgcctgtcggagtcgtcatctacctccggccgccgccgcccgaaaccctagcgccgcgccgtttatcttttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtcacaagttggtatcagagccccttgaccctaggttatgccaaatggttacccatagaagccctctaaaaatattggaaaagtagaactgttctcctccccttctcttttaattaaaccaaactaatggcacatgcatttcataatctcttttaatggttctcattcaaaatttattccagtgttattagtactgtacatctattactgtactaatggctcaattaccagcaaaagatttacaatattgttttatttaatcttactgcaacgaaataaatttagcatgttgattttataactttcttttatttcttttggaacctgttgttcaaaagtacaaaatttgtgaccttgtttccaactgtttcaacttatcttgcaagattggtttactttatttacttaccttttactttgattttcgaactttattcaaattaatccaaaaccttgtgctattaattggataaatgtcttaactccctccttacacttgtctttagatgccgcgctacaagcctgagtacttgtttggtgttgagggatttgtccaggagttgcgtacgatgtcctttgtcataggatttgggactgctcctttttatgcccagattcctcatgatcgtcacgaagaaaagtgccgagtcaaagtcaccttgaacagtaatagtgaagatatcccctcagtgatgttcgaagctggaggaagaaactatatccatgcatgtcaggaggtggcaaggatcgccataggagagctccgtgatcgctatagtgatcagttggccgacacggagtatcgctatcatcctcgccaaccacaaggaagtgaccgtggcagttaccttgagactgagggaattgagaatgatgctaccacaaggcatttggttgatatgctgtgggctatggatgaaacccgtgcggagactgtgttagcagctcaagatcgtgaagaccggaatcgtggtaagatttgcaagctagaagataaagtggatcgtttggagaaggaactagccgcgttgaagggagaagcaccaccgcagaaggccagggttcgtcttaccgcaagaaagagagctctatttgtccctcgctaccaattggcgccaaaggtccgtgtggtggaaaaagaagttaccccagccctagcagatcctccggtcgtcaatgtaagtgatgatgaaggagaagaatcaaagcgtacccattccaagattgagtggggagctactcaagatgatgaagatgagccgaacgagcctttaatcaactccgatgctcggaagacctagaaagccttgtcaaaccgttgtcttagatcgttgtgttagcttgtttgtttaagtttggttgtgtgtgtctcgcgtgtgatttacatcagtggtgggatgtaagtacatgcgtttgtttgctttcaagtgttaggtagttggtgagtttagtggtgtgagagtcttcagtttgtaataatgaaactcacttaagatcaataaaagttaaattaattttctgtcctaagtagttttccccggtttctcttcttgtgacctgtccatgccagatggtgctcactcgcagcaacgggaatggccccaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtaaggccgcctactttctctagtaccactaatcctgttgaagctggagattggctgcatgccatagagaagaagttggatttgcttcaatgcactgatcaggagaaggtctcatttgcatcacaccagttgcatggccctgcctctgaatggtgggatcacttccgcttgaataggactactgctgaacctatcacttggcttgagttgaccgctgctttccggaagacgcatataccatcgggagtggtgtctctcaagaagaaggaattcaggtcgctcactcaggggtctcgctctgttacggagtatctgcacgagttcaatcgtctggctcgttatgctccggaagatgtgcgcaatgatgaagagcgtcaggagaagttcttggaaggacttaatgatgagctttcttacccactcatgacgggggattatcatgatttctagaagttggtggataaggctattcgtcaggaggacaagtacaatcgcatggagcaaaagaaacgccggattgctcaattcaagacacaacaggggaataatcagaggccgcgtcttactttgggaccccagtccatgccacagggaggttcttcgtctgttgttcgtccgcaacgtcagatcttcaacaacaatgcaggcaacaacatcagcaatcaagctccacgccctgttgcagtttcgacacagcaacaacctgccaagagggagcaaggcagcaagcccgtggtgtgtttcaactgtggagaaccaggacattacgctgacaagtgtccgaagccccgacgcgtgaaggttgtccctacccagagcaactctaccgtaccagtatcaaaggccagtgtcaaccatgttgctgctgcagaagctcaaggtgctccagatgtgattttgggtacgtttcttgttaacttagttcctgcaacagtgcctttcgattctggtgctacacattcattcttatctatgagttttgcgggaaaccatgccatggaggtagaagatcttagacgtcctttgatggtta

SEQ ID NO: 25399 - DNA, 14160 bp, Oryza sativa
cccaagtaatcaagcactctctttgcaacgtagcccctccgtcagaatagaaattcaaggagtaccatttgtggccaatcttatcctgttagaatccaaagaccttgatgtcatcctagggatggactggttagccagacataaaggtgtgatagactgtgctaacagaaaagtaactctcaccagtgatgatggtcgagttgtaactgttcatgcattgtcttctgagtctttaaggtcaagtctgaaccaaataattttgaaagagattcctatagttcgggggtatcccgatgtgttcccagatgacttacctggtatgccacctaaaagggatatagagttcagaatagatttggtaccaggaacaactccgatccataagagaccttatagaatggcagccaatgagttggcagaagtcaagaggcaagtagacgatttgcttcagaaaggatacatcagaccgagttcatctccatggggagctccagttattttcgtggaaaagaaagatcatacccagaggatgtttgtggactatcgtgcactaaatgatgtgactatcaagaataagtatccgttgcccagaattgatgatttgttcgatcagcttaaaggtgccaccgttttctccaagatagatcttcgatcagggtatcaccaattgaggattaaagaggaagatatacctaagacagcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactctcgaaccaaagaagagcatgaagaacatcttcgccttgcactagagaagctacgagaacatcaactgtatgctaagtttagcaagtgtgagttttggttgtctgaagtgaagttccttggtcacgtcatctcagcaggaggagttgccgtcgatcctagtaatgtggaatccgtaaccaactggaaacaaccgaagacagtttcagagattcgcagtttcctaggcctcgcaggatattatcggaggtttatagagaatttttccaagattgctaagcccatgacacggctgcttcagaaagatgtgaagtacaagtggtcggaagaatgtgagcagagttttcaagaattgaagaatcgcttaatatcagctcctattttgattttgcctgatccaaagaagggtttccaagtgtattgcgatgcatccaaacttgggttaggttgtgttctgatgcaggatgggaaggtggttgcctatgcatctcgtcagttacgtccgcatgagaagaactaccctactcatgatcttgagttagctgcagtggttcatgcgttgaagatttggcgtcattatcttttcggtactcgtacagaggtgtataccgatcacaagagtttaaaatatatctttactcagccggatctgaacatgagataacgaagatggttggaattaattaaggattatgacatgggaattcattatcacccgggaaaggctaatgttgtagcagacgctcttagcaggaaaggctattgcaatgctacggaaggacgacagttgccattggaattatgcaaggaatttgaaagattgaatttgtgaattgtcagtagaggtttcgttgcagccttagaagcgaagcccactctaattgatcaagttagagaagcccaaattaatgatcctgatattcaaaaaatcaagaagaatatgagaagaggaaaagctatcggtttcttggaggatgagcaaggaactgtatggttgggtgagagaatctgcgtccttgacaacaaagatttaaaagatgcaattctgaaagaagctcatgataccttatactccattcaccctggtagtaccaaaatgtaccaggatctcaaggaaagattttggtgggcgagtatgaagcgtgaaatcgcagaatacgtagcagtatgtgatgtttgtcagcgagtcaaggcagaacatcagaaacccgccggtttgctgcagcctttgaagattcctgaatggaaatgggaggaaatcggtatggatttcatcactggtctacccagaacgtcatcaggccatgactctatttgggtgatagttgacagacttaccaaagtggctcatttcatcccagtaaaaacaacatattccggaagtcggttggcggaattgtatatggcaaggattgtgtgtttgcatggagtgcgtaagaaaatagtgtctgatcgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtactttagacttcggtggaagttgggataagaatctaccttatgcggaattcttgtacaacaacagttatcaagctagtcttcagatggctccttacgaagcactgtatggtcggaagtgccgcactccgcttttgtgggatcaaacgggagagcgtcaggttttcgggacggatatcctaagggaagcagaagaaaaggtgaaaatcattcaagaaagattgcgtgtggcccagtctcgtcataagagttatgccgacaatcgtcgtagagatctaagttttgaagaaggagattatgtgtatcttcgtgtcacgcctcttcgaggagttcatcgtttccacactaaaggaaaattggcacctcgttttgtgggaccttataagattgtcagtagaagaggagaggttgcttatcagttggagttacctcaatctttggcaggagtccataatgtgttccatgtttcgcaattgaaaaagtgtttaagggtacctaccgaagaagctaatcttgaacagatagaagtccaagaggatctgacctatgttgagaaaccaatccgtatcttggaaacaaatgagagaagaaccagaaatcgagttatccgcttttgcaaagttaattggagtaatcactcggaagaagaatcaacttgggaacgagaagatgagttgaagtcagctcatccgcatctgttcgccagttcttccgaatctcgaggacgagattctgtttaaggggggtaggtttgtcacaccctaaaaatccaaaatatataaattgttgtttaaatagaattattagattttattttaaaagcctagaagagaagatttaattttaattaataaattccaacataaaatggggccagataaaatttcattaaatactttgcttaattctataattcctagatttttctgggatttatttgagctaaggaagtatttttaataaatggaattgcatttaaggaataatttaaattgaaaaaggtttttaaaagtcttctttcggctttgggccgaaagtcagcccaaaaccctctctctctctccccggcccaagtcggcccagtccgccgcagccgcgcgcgcgccctcgctcactgacaggtggggcccgcctgtcggagtcgtcgtctacctccggccgccgccgcccgaaaccctagcgccgcgccgccgccgtttccttccaaatccggccgctcctttccttctccggagaaatcaaaagaggggaaatgtttcccgagatctcctctaccttttcccttttggaaacatcatctatttcggtttggaaatcgatggattcgagatcgaatcggattcctctctctctcccgaacccgaggtttccttcgcgtcgccggtcgccgtgggccttcgccgccgccccctagcccctttaaaaggatccccggtgtctcctctacccgtcgccacccttgctttcgtctctcgccgtcggaagcgtcctagcgctgtgtgacctagcgccgccgtcgtcgccgccgctccagccgtgcgccgccgtcgttccagtcgtcgccgtcgctcgggaaggacgtcatcgtgatcgccatcgcgtcgccgtcctcgtccgccccttcgcagtcgctgttgaccgccggagcaccgtcgccgccgtcgacccgatcttctccgcagcttcaacttcgacgccgtcgccgtccgttgatcttccgccgcttctttggtcaccggtgagttcgccgcgccgtccgctacccgtgggtgttctccgttcgcgccgcagcgccgtcgttcaccagcgagcttgcgcgcccgagccgccgagccgccgccggtgctgacgtcatcaatgacgtcaccgctgacgtcatcgtggctgtttgccgtgagccggtcgtggaccgatcgatctcggccgtccgtttcggatggatcgatctcggccgtccgttctcgtgaaccgccgccgtgcgcccggtccaccgcaaaccctagccgctgacgcaataaatcccttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgttaaaaatatacacatgtactgttcatgcttgtttatgtgctgttttggtgtttttgctcttttctgtttagattccaacgtttccggagagtccgttttcgcaggagaagattttgaagagttccaaggccagcaaggcaagtcacacagatcccaaacaaccctttgagcatgttgatcctatttaaagctattgtttctattcaactattgtatctattttcgaatgtcattgggtggaattaacctattctttgttatggcccttttgtacttgattactttattccttgataccttgggtgattataattggactagttgagctttatatatattggttcaactagatattagatataattgcttagccatgcttagaaacattagcacactattgggataacttatgactcactattatgtaatgatggcttaatggtagttcacgatggtcaatcgtgatttgttaattaattacttgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtaaagcatggttcattgcggagcaccagactgagaagtggcggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcctgcggttatgggcgggtctaacaatgtctttcgtgattagtttcacacctctcatcataataacagatgctataattggtaataatttgattagctcctggtttggaatggtacattcctggtttggagatagatctgtacagccgggtatggttgttcaggatggttgggcctgtgcagcatggatgtactgttcagtgattgattaatattgatgattaattactctactgttttactactcttaaatgtttgctaaatgctgcttttgcaaatgagccctatattatgccattctttgttatcctgtgcacttgcatatttgctgcgtgacttgctgagtatgtcatatactcaccttgcaatcattcatcagaggaagagttctacagtggtgctgatggtgtggaggattaggtgtagccttggtcaagctgcttgtggagtggagccgtctgcgccgtttatcttttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggtgtgacagatcagctcgggctgatctgggccgtcggttcccatggaccggcggtggaccaccccgtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattctagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagttcccgtcgttttggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatatgtcctttgtcaacattgggtaataaatcgactagctcatgttacttatgtgacttagctagaactatatgcttggccatgcttaattaccactagctcagttgatggggtaattacagttttagaccttttagtatcagaatgagctgcgtgctcgagacatctggccatgcttcatggtcgtaattatccaactaaaatgcgactgaatggtgggctgtgggtgcatggttttgctagttgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccgatatgtcgtggtggcatgtcggtgcacggaaacgtgtcgtggggctgtgtcttgtgggtacagttgtacacctctgaacagagtaaaactattcgaatagccgtgcccgcggttatgggcggtcgaccagattcaccgtgattagtcccatcttaatacatgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagggagtacaaggggataataatataggggttaagttttgcagtaacagcctttaaaagtcacttagttgcccaaagccattttataaagacgatcctagagccacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgttaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatatgacatctcgactaccgggccgcagctcgtgtagccttcatttgccctggagaatgtccatcgacccccgacttcatccatctccaatccgtgtactttcgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccatattccaacaattccatagtgtccaaatgatatgagaattcccaaagtctaaagttataaaaccacctaatgttacctaattagatcgcgaagcatctacctaaaattaaactagtggtgtcataagtagagtgtccactagttgaggttttgtttattctagggtgaacaaggtaataataacaataacaataatagtatggtcataacaaaggtaaataggcatggctaaataaaacagtgataacgcgggaatttaaataaagcgataatgcattaatttaaattaaaataattttgtaaactgggattcaatatgctcaaggatgatgtgacttgccttgctcactttcccaaacgccggcttcaacttccacgaagagcggatcttccgaagctgcagcgtctacacgaccaacggaaaagaaaaggcttttactctaataaactccaaacaacaacagaaacaaagcacaaaaatgggttcttgacttcttaaggaaaaattagagacttgaacggtccaattccgagttcaaatggccaagatatggtcatttgaagtttatatgctctttaaatggatatttacgaatttcttcatttaaattttaattaaaaacgcatttattgcgtcagccgggagaggggcgcgcggaccgggtccacgggaagtggggcccacgcgtcagcctctcggtccacggtggaccgggcgcacgcggctggcggcggtcggcgccgtgggtcccgcgcgtcagccgcacccgcgggcgcgggcggctgacggccgggcccacctggcagccgcgagggcgcgcccgaaggcggcctcgccggcacggccgacgggagcggcgcgcccgcgccccgatggtcaccgccggcgaccatcggcgcggcggagcagcgcccgagagagcggagaggagggggaaacggaagggacggtccacggctcaccccgagacacgaggacggcggagacgacgaacggagtggagaaacgcggcggcgcggctcgggatgacgatgacggcggcgctccgacggtcggcgagcgaaacggaggcgcggacgaggtcgacggcgatgcggcgatgccgagggaggtggcgccgagccgggaggaagaccggagcgacgacggcggcgaaccggagcggaggaaggcgacggcgcggttcgggatgccgagggcgacggtgctccggcagccggcggacgaagcggagcggcggacggggtcggcggcaacacggcgaagcggatggaggtgtcgccgagtcgggcggaggaccggagcgacgtcggcggcgaaccgaaggtcggcggcgacggcggagagagaggagcacggcgcgagcacggatccgacggcgagagcgagcggcgagcggtggaaacggaagagcggagctcggggagcaattatatagcaccgagagggggagaacgcggccggagaggaaggaaacgggcgcggggatctcgggctccatagatgtcgccggcgaggattacgggatgaatccggacggatccgagggagagagagaggggaaatcgggggaaacgggggagggaaacgcggggaataatttccccctctttaaggcgcgcgggcaaggcgggatgcggcggaatccgcggcggcggcggcgctagggcacgggcgggcggcggcttcggcgcgaggaggaagacgacgggtgggtcccacccgtcagcgagagtggagggcgggcccgcctgtcaacggcgcgcgcgcgcgggggaggccgatgggccgtgggggaagagagagagagggagggactgggccgagccggcccaagaggggaaggggggggaaaagaacttcttttaagatttttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaatacatcgacccaatgcactgtagtccaggtgggttggttgggcctgttcaacgtggtgtagcgttgatcagtggagatttaatgttactctaattactcaaccgttttactgatttgctcaataaaatgttttacaactgcctttatgcaaatagccacaaacccctccttgtatccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgtcgttctgtttcggtgcgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacacgtacccgtgttctacaatccccaagttgagatgttcaagctcctgttgcaattcattacacatgccttcggtgcataaagcattgcagtagcttttcctgctcaaggcatctgccaccacattggctttgcctggatggtagtgaatgcccatgtcataatctttgattaactccaaccatcttcgctgtcggagattcaggtcaggctgggtgaagatatatttcaaactcttgtgatcagtatagacttcacagtggttgccaatcagataatgcctccagattttcaaagcgtgaaccaccgctgccaattctaggtcatgagttggatagtttccttcatttggacgcaactgccacgaggcataagtgaccactctgccctcttgcatcagaacacatccaagcccgtggtgggacgcgtcgcaataaacttgaaaatctttcgtctagtcgggcagaattaagaccggtgctgatactagcttcttcttgagctcctcgaagctgctgtcgcactcagctgaccatttaaatttgtcatctttattcagtaactaagtcattggtttggcaatcttggagaaattttcaatgaaccgacggtaatagcccgcaagtccaagaaaacttcggattctgagatactgtctttggtggggtccacttggtaactgagtccacaagcgaacaaacctaaacatgcaaactaatagacaattactaaacagaacgatatgctaagggaaaacgagcctagtgctcggaacggctcctgcggtcgatggagtcgaaggcgtcctcttgctcatctcctggtccctctgagcggctcctggagtcctgcacgtacgtctcgccactgcccggctctgagctactggaactgctgctgtggtcgcggctgccactgggagtagcaggcaaccaacctccactgccactggctgggcccctgtaggctgaagctggagcatcggtgaagacgaactcaggcgcgggagctgaagatgatgctggtgctgaagctggggctggagtgggagctgcgggcgctataggaggtgctgaaggtggaggaggcgggttcccggatggtgggttcctgggcaccaactggatgcgcacaggtgctgtagtagacttgctcggcatggtgcggatgcgggctcctaccactgctggacgtccctgcagcctagcattctccctcttgaggcgagcgacctcatcctgcaggctggcaatcctgactagcttctgattgttgagggccttggacgccttgtgaagctcagcatagaccctgtcgtagctgcacatcacccctcgcatgtgaccaaaggtggtgtcgacctctcccctgcaagacctgaaggtgctggtgtcatcattggcgccacggcggggatagtagcggtaggcggtgctacgaaggtcgttgtcgtgcaggtctcgcagtcttgccatcatcatgagagtagcttcttcacaggcatgatcaaacgtgcccccactagctgtgaccgtcatgttgggcaggtaggaagggatgccatggacctccaagcgaacctgatgcggaaactcgccactgagggggtgaatcctggtgtactccggctcctgggtaaaaccaatcacgaatgccatgcaggcgagctcggcgacaaaacctcccatgtcctgatcactgtgcgtgttggggcggttggccatctatagaagataaaaggagggggaatcaatgcatgctcaaacccaaatgtaagtaaacgataaaggactcaagcaagataaacaaataagagcagaattttgtgcataggatattttgcatgagcgaataaatacgaccgacatagttaagcaataaggtagtgcataaattagatacataataataatagtagcataagtaaactttgcaacccatattccttagttaggacctaatgcatacctcctattaaatccgaactgactgacctcatttgaacaacgagcgatcaagatttttcccatgaaccaaaggaacaaatccaaattttcccgaaacaaaatgcagcggaaaaataaaagataactggagctaagccttgacttggattgcagcggcaacaccactccacaggcatcctcgacggcacggacgaagcctactcctcggaatagccaccatctgacgcatactcaaactctggggttggggaaaagtagagcaagactgagtacaaccaccatactcagcaagtcataccggaatagggcgtatgatgcaggatataaccaaaggatagctagagcggttcatttgcataaagcgagcatttataaatagtagttgaaagcagtaaaaatagtcgtaataattaatcaatattaaccatccactgtccaacgctacaccacgttgcaacaggcccaaccatccacctgaactaatcaattccattagactaaactaggatgagactaatcacggtgaatctagttgaccacccataaccacgggcacggctattcgaatagttttactctgatcagaggtgtacaactgtacccacaagacacagccccacgacacgttactgtgctctgacatgccaccatgacataccagaaagaggccgtgacaggacctttcgcataaccccctctagccaagcacaccacacctcaggtttcacccccgtccccagcgggcaacgggcagtcccctctcgtgcctaggtgaatcggaagcgacagaggccgtgtagggcccgccccgctccat

SEQ ID NO: 25400 - DNA, 4212 bp, Oryza sativa
ttcttttaagatttttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttttcttcttgtctgacttcttccgtcgcatcttttataacaaacttgcctagcaaaacttctccactctggactgcttggctcaatctcctgttgcagatggaatcttctcttcacctgacttttccctggttgaacctttagctgacttcgactgggttgcggcacttgaagatggggcttcagttccagagctttgcatagttcatatctttggagtcaacctcatacaagttacccacttcatgtcatgcgtcgacatcagctttgtcattactaggatatcatgtttggcaacttgcccctaactgcctcatattagctttcctggtctccgggtgatagctacttctgctatttgatgcaagggtcgataactttacctttgaattatgcttcccaagagagccaacttatcccacttgatatactttaacgtcttcccaaatggttttactgttggacttcttattgtctgatcgttatccggccaaattttgaagcttcgtggttagatgtgattttactctgacctctgtagactatctgcgaacatatcacttggttcataactgggaatagctcccacgaacaagcaactcagattcactttcttcatgttcagtttactttccgctattctcttcatgttgtcatcatttagcattcaacgtattcctgtgcacattcagccttgatgtgttcttccccattggactacaatcaggggtcttccttgagcggtgcagagtatgtttctgtttatcaatcacctttcggcctacttctctcatgctggagaacatctttgccaatctcttttatcgatcatcttttggcttatctcgaacaggtggtattctttaatgtggattgcggacgcttctggggacgacgaggtcctttggctcgctgcctttcggtgaaaccttgatgtggtttgtcaaaaagctgcactgactaccttcagggaaatacattgcttgctatctgtatctatgccactaaggtttagtgctttctcgagatggggagcatccatattgttcttctgccatatcacctttgacccttttctgatacctgatagactaattaccaaccatcgactattatgttctcaaatattgatgtcttctggatcttcttaactgttgcaggtatatccgaacttatcaatgtagaggcatggcgggtacccttatgggtttcatccaccaatccttatcttgatttgtaaaagtgtatccaaacttttatccccaactactgtctcattagctttttaacccaacacagtgtaattggttttcttttccatcaacaggttggttattaactcgaggttagaatatagttcctctgacacgagaccctaggtctcctttgtcagtaaccagttacacacatgatcacatatccgcatcttccaaaagaatcctcttagaacttgtcggtattacacattccccccttattacacgaatacaaggcactgctttaaacaaaaagggaaggtgcttaccatcggtacattgtatcctcaacaggaatcatccataaacatagcaagctcactgttttatagacatgaatatatttttttttattacatgattgctgtagactcccggttacagtgataagtagctaactgaaaatcacaaacatggatactcattctgattctggagagatatagctggcgtggttctagtgactgcattatccttgattggttctgtgatgatgtgataggactgcatattgctatcattcacaggagaagcttccttctgattgctggttgaagcggatgacggtcttctgcttggtatcgccctttgcttggcctggagtaggtcggggagagacacaacttcttccatcgacgacaattctttgctggggctgaaagtgagcattgacaccttgtggtaatgcactcgctggagttggagctgttgcaacgcgagccataggactgctttgggatgcatggatgacaattcgctgaggagcaagcttctgattgcagggagctgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcacatagtggcacacgagctggggacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccactctgtgctagtaatgatcatcttacggacttcatcttcggttcgcattggtgtttttcttttctgctgaggacgctcccttgcatagtgcccttgctcatcacacataaagcaaatgttacttgctccttttgggtcaacatgtggcacgtcaccatgggtccttcgggatgctggcggcatgctgacttgtggtgtgagtgcttggactgcctccaactgcacttgaggttgtgtttgactcaggttcagaattggcgtctgatgctgctgtagtatctctataagcaatcggttctggttaatcaggtgttggaccagtgtcacacaactggtgtctggtgcttcatccactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacaactaacgacactaccctatagggcggcttaaggttctgcgacgggttctccaagatcttcactcctgcttcacagctggcttcactgcttcctccacttcgctagcggatcctgcagtcttccggagcttcggcaaacaaccgacgatgtcttcttcttcactgacctgaccatctagtactagttgaaatccgaagaaggaagaaggcagtaaaccttttgcaaatagcattaggggaaggagaaaaaggaactttcgcaaatagttttatttataaaatatgtccttaggttttatccatttggcttatcctacagtcgagatggctctgataccatcttgtcgcgaccgggaaaattgccttttcccgaacgctagtgtattaatccccgtcccaggaaaagccggggtacaccatacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttttcttactgaagaggggaaagattgagccagcaatgagt

SEQ ID NO: 25401 - DNA, 585 bp, Oryza sativa
  unsure (1)..(585): unsure at all n locations
ccaggaaaaagagaaaaagaccaccactcacgcaccgacagctccaacatatggacctcagaggaggctggcacggaaccagtcaccgctaagcgtgaccggccgcctctggccaacagagggactacaactgggatcgcccaagcctaaccctaacaaacaaacacagaactgcactctaaccacaattttgtgattgagggagagagggtgcaagannnnnnnnnnnnnnnnnnnnnctatgccttctgtcgtggtcaacttgtataagctagagcgccgacacaagaggactgaaatctagagcaagcttgcactggttgtctgggcggttttggttaggggttgcctagacgacgtctccagggaggagtcatggaaacaccaccgccgttgtccgtccaggcctcaaaggagagccgagactgagtttttacccggcaaaacccctagaggtgatgggacgtcacgacaacaccctcaagagggaatgcaacgctcgaaagcgatgttgttgctggcccaaccaagaccaggctgggttttcacccatcgtccgccacctgtctatccaccaatgtcgcc

SEQ ID NO: 25402 - DNA, 439 bp, Oryza sativa
cttccatacaaatttctgtactgctgccgaagtgatcgcaccaagtggttcggcttcaatccaacgggagaagtattcgattgctacaattgcaaacttgtacccatttcacgctactgggaaagggccaatgatgtttaacccccatctggcgaaaggccagaccggtgcgataggttgcagctcatactggggtgctgcttggcttcggccatgccgctgacaggtttcccacttcttggcttgctcaacacaaacttttaacatggtggaccaatataccccctggcgaaacactttggaggcaaccgttcttgcggcttgatgcgcaccgcacagctcctggtgtatttctttcgccacttcctcgccttcggcaaaggagatgcagcgaagcaaggattgcagcaccccggagcgatacaactgccctgagatc

SEQ ID NO: 25403 - DNA, 532 bp, Oryza sativa
acacaaacctaggagagttagtagctcaaagctagcatcatgcagtgcagggcacgtcttggcaaagcatgcgagcacgcgacacctcttactcgtgagtaaatttactctttttttttgcgaaattcaatgtgatgacacgttggatcagccattaaattctaatcataatcgcaggatcagcgcgaaatctgaaggcgacatgatcgcacgaaggttctcgtgcaggggatttcctgtgcacctgtttcagttgcttactttagaagataaatttcggccgaatagggcttcggtaaatcgacattggatgcaatttttaacttgtttttgccttttgaggtttatgttcttgttaatttgtccttgatgaggcactattttttttctataataaatgattcaccggattattttctatgcttcgaaaactacgttctcttaaaaaactttcttctactttattgctataagatcacttgacttgagctatttatttagcttatttcttataaattatataacattccta

SEQ ID NO: 25404 - DNA, 242 bp, Oryza sativa
gcgggcctcgccgccgtgctcctcgccgccgtctccgcgttcaacctgttccgcctctacggcggcggaggcggcggccgcaagagcagcgccggcgccgtctccggcaatggcgcgaacacgtggtaggcaaggctagtttagctgcttcgatggagtttaatttctttgtagtttcagaattacattaagcgagactggctcactgacacgtaattaagttcgttaaatcgttggtaata

SEQ ID NO: 25405 - DNA, 455 bp, Oryza sativa
agcatgacttgccttgctctgctgctggagggacctcggcgactacctcaaagtacaccgtatcgtcgggagaaccggaatctaagcgatgcggcggatggcggtagcgcggcagcgcacggcggcacggccccaaagcgagacggcgtggcaaaaacggcagcggcagtatgggagatagagagagggatgggaggggagttcctcaccgatggcgaacggcgcgacgagcggcggttgcggacggcgagaggcggacggacttcgagaggacctaaggaacaaaatgggggaagttagagaggaagaaagagatcatcgagggcgggaacgtctgccaaaggaggcaaccatggctgaactcaccggcgcacgaagcggacggtgttccggcgactgacggcgacgatcgggcggtggccggaatgcttcacgcgatggcgaatgcggtggtg

SEQ ID NO: 25406 - DNA, 1927 bp, Oryza sativa
  unsure (1)..(1927): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttactgaaggggggagaaagatagagcaagaatgagtacaaccacagtactcagcaagacacaccggagatgcataattaatgcaagggggggtacaaggggataataatataggggttaagttttgcagtaaacagcatttaaaagtcacttagttgtccaaagccattttataaacacgatcctagagctatacaatattattaatcaaggtcgtggacccacacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcagaattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactatcaaaacccaaccacgcacctcgagcccagcctaaaaccaatttggggattttgaatagaaggagcggtgtgaagccaattccacaataaccaaaccattccatagtgtccaggtgatatgaatattcccaaagtctagagttgtaaaaccacctaatgttacctaattaaattgcgaagcatctacctaaaattaaactagtggtgccatgagtagaatgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaataatttcgtaaactgggattcaatatgctcaaggatgatgtgacttgccttgctcgctttcccaaacgtcggcttcaacttccacgaagagcggatcttccgaagctgcagcgtctacgcgaccgacggaaaagaaaaggcttttactctaataaactccatataacagcagaaacaaagcacaaaaatgggttcttgacttcttaaggaaaaattagagacttgaacggtccaattccgagttcaaatggtcaagatatggccatttgaagtttatatgctctttaaatggatatttgcgaatttcttcatttaaatttaattaaaaactcatttatt

SEQ ID NO: 25407 - DNA, 5363 bp, Oryza sativa
  unsure (1)..(5363): unsure at all n locations
gccataaccgtcattaattacttgcctatttaaggagctcactctctccattcctccacacacctcaagcaagaagttcatttcatctctcaagtttagtatagtttctagagtatagtggaatagaaatagaatagaatcttcagccctcagagtctttggaagaatttgggtatggctctagtagcttttccttcttttgtaagacttgtactttatttcgaatactcttctttatactactctggtattgtattactttccgagtatatgaataccagctttactatatattcaaatatatttattatgatgctagcttatctgggagatgcaatggtgtgggtataatgatcgtatttacgatggctctatgtcatgatgatgatattagagtagtatttggtaatttaagcgtggtgtttagattactggatataattatttggggttatatgctgtggaagcgaggtgggccgctgatggtgacagctcagtacgggtattcctccgcgcgtgtatatagtcctaagttaatttcctggggagggtactcctccgtatttagcctcggttgtatggtcaagacggattgtcgtaaggaactcggcaatcaggggtggcttctcgaaacaccaagagggcatcagatagagggtattagctaagtagtaaaataattaggatgtacgtataatatgtatgtatactagaagtataggaatatgatgtttctatgttctttctacttagcttagataatcatgagtaagaggatgaatgcttctgcttagtgtcactctaccttatgaattatattaacccctgcttagactttggttattacaaataatatataaattattactacggttctctctattataatcttcccaagggattaaacaaatacgatacccttggaatactctcgggtgaaatgctaaaatggtatatccgtgcgcttgcagatgaaatctgtaaccataatataccaggagtatttctgcgccattactgggaattatatttgtagtaatatcattaagaaatatcatcaaatagttagggggtgttgcctacataattgtacaatagcaagtgtagactaaaatgactatatactagaagtatagaactgatgcttttcttattcttagtccacttagcttagattattattcatcggagcctattttaacacctggctatgaaatttgtcccgaattcataagtatggtttgggataaatctttctctagtctagaccaggaaaacctctaccatcacctccgagagtttgagcagctgtgttcgtgcctcctgattcaaggcatgacacatgagactgttaaatggaaattgttttcgttctctcttcaagagagcaaaacaatggtacatttacaccgttgggagtgtgagcagtagctggaatgaattgcgagacagattctgccttggagggaatagttaggggtgttggctgcataattgtacaattgtaagtgtagactaaaatggctatatactagaagtctagaactgatgcttttcttattcttactctacttagcttaaattattattttagtgagagtattctagttgttcttctgcgtgccaacctatctttatccttgaattgatcaacccctacattagacttcgatatgcataactgacaaaaattagggacaatcgctcgtttgaccctattttgaagtttaatttccaatctgaccctactttttcagatttgctcatttgaccttgtttttcaaaaccgtacttgccgactgaccctactttcactcccccgtcaaatttcatttaattaaaagaaaaaataaatttactagtccgaaaatgactaaaatgccccctgattctacaacattgtccccaaccttatctaggcggctgccacacacacggagggggcgatgcctgctgcatgcgcgaagggggtggcggcggctgtggcgtgcgtgggagggagcggccacggcggcgcgagcggaaggtgggagcggcggtggtggcgcgcacgaaggacgggagcggcggcgcgctcggagggcgggagtggcgtttgcagcgcgcggagagagagcaacggcggtcatcgcggcagcacgcgctgagggtgggagcagggtggcagcggctcgctcgtctcgtggcgctgagaagggaggtgtggttcgccgctgtgccgcgcagtcgatgcagtgctgagaagtgagaggccagcggctcgccggcgttcttcatgatggggaggagaggcagcggctcgcccacgcacggtgctgagaaagtataggctagctgctcgccggtgctctttgcgattgaggagcacggctcgctggtgtgctgcatggtcatgggggaggctgcatctcacctagtgcggtgcacacggggacctcagcataaggcaggcaaggggcatggctatgagacctccatggctattgcttgcccatcttcatctcctctttgttggattgctgctcaggaacattgttagacactaatatactacatgtgtgtgtttatttcttcagtatatgcaatttgggatggatttgttaaatttttattaaacttaattcatatatttttgtcaaataaaattttttttcaaacatctaccaacttgaagtgaaagttatcaaattatagtaaaataatacaaactgtagtcaactttgtcaaatcaaagtcgaatttgtcaaaaagatgacaaaaactaagtcaaatttatcataaatctatcaaacctacaataagtacataaatttttcgcaatatctttgccacgaaaaaactggaccaagctaacaaaataaccaaaaataggtgacaatgagaaagggcaaaattggcattgtgatttttgtttacatggataagtgctcttgacagaagagggtcaaaccgtagcttcagttttgaaaaagagggtcaaatgaacaaagttattataacagggtcaagttggtagttaacctttaaaataggatcaaatatgcaattgcccctaaaaattattagcatagtactctcttatcatatctttcattgggattaaacaaatacgataccatggaaatacttccaggtgaaatgctacaacggtatatccattcgcttgcggattatatctgtaaccgtaagaatactgagtaatatttcgagcaccattactaggaattatatttctagtagtgtagttaagaaatgtcacgctcagaaattcactagtaatttccgaactaatttgtgcatgaaatcctcgtccaggaatcagccgaggtaacaaactgataatttaatatacagattcattataataataacgttacatacttacaaaagaaaagaaaaacagcagcggaattacggtctatcaaagctccggctccactcccataggcagctcaactaaggtataagccaaacgtcttctccatctggatccttttcttcaactgaggtttgattgattattgcaaggtgagcatatgacatactcagtaagccacacagcaaatatgcaagtgcacaaggataccaaagaatggcataatatagggttcatttgcaaaagcagcatttagcaaacatttgagaattgtaaaacagtagagtaattaatcattaatattaatcaacactgaacagcacacccatgttgcacaggcccaaccatcctgaacaaccatacccggctgtacagatctatctccaaaccaggaatgcaccattccaaaccaggagctaatcaaattattaccagttatagcatcatttattatgatgagaagtgtgagactaatcacgaaagacattgttcgacccacccataaccgcgggcacggctattcgaatagttttactctggctaggggtgtaccactatacccacaagacacagccccaaaacatgtcaccatgcgcctcaataacaccacggtacctcggaaggagctgtgacagtacccctcgcacaacacaatccaccacagtgcaccattcctggatcataatcacccccttacaaacaaggcatggactccccagcgacccccgtgggcttgtctccgccacttctcagtctggtgccccgcaatgaaccatgctatacaaaagataaagccgttgcccatgctggcttgtggttggcacggttaatggttcacaaccgaaactcgtcaaccggtccttaattgtcatgagcacgaccatcaaaactatgtgctcacaacccaccattatcaagttttaattggcaagtaattaattaaccaatcacgattgaccatcgtgagcttccattaaatatccataagtgatagtgaagcatgatttatcccattagtgagctattgtttctaagcatggctaagcatctattataagcatctagctgaaccaaaacaatatataagggtctagctaatcaaattataacccataggaaaataaagtcatcttcggccataattaaatgggaaaggctcaccacccaatgacattcgaaaattaatgcacaggttgaataaatagagaattttaatataggatcagcatggtcaaaggaattgtgtntgggatctgtgtgactgccttgcaataatcaatcaaacctcagtggaagaaaaaggatccagaaggagaagacgtttcgcttataccccagttgagctgcctgtggaggtggagccagagtttcgctagaccgtaattccgttgctgtttttcttttcttttgtaagtatttacgttattagtatgatgaatctgtatattaaattgtcagtttgtgtaccccggatgatttctggagagggatttaatgcacaaattagttcggaaattactagtgaatttctgggcgtgacaagaaatatgatcactcactaaaaggcatgttagcatgcaagttcttgcaaacatgtgaccgaagtgaaaaaagagagttgcgaagtcgaacacttgtctgttggatagtatagggaggagagaaatactgcgtaacatggatcagtacttgtattgagcctcagggggccggtatatataggagtacatggggagaagataaggaaggattacagatatggaaggagtccacacaaatcaatcctatcctaatatgactctaactaccatatactctagcatccccccgcagtccaaccgtgagcaacgcggacacttggactagagaagaaactggcaagagtgctcaacacgggatagccctttgtgccatagtcgatgtagccaaagcgaagggtgcgagagagccgtggtcgatgaagtcgtgcgtagagtagctgtggtcg

SEQ ID NO: 25408 - DNA, 624 bp, Oryza sativa
aatcatacgccaatgtcggaagagactagcagagtaggcctccgagacggtcgcggcacgagaacggcgtagagggagaattgccggagcagcacgcagttgccgaagaagagcgaagtgtagtcgaggaagatacggcgatgctagcgatgaatcatgctggatgaagttgaaggcgaagtagtaggaccaacggtctagacggcgtcatcggtagccatgtaaaggtagttggaccaccggcctagatccgcgacagtggcaacttggagatgcggcggcgatgctcgaagtagataaagaagacccgagtggctgacgatgaccagtggggatgatgagggtgtcgaagcgtgaacgacgatgaagacgatgaaagcggtgaaactgcggtccgagaggacaacacacctgcagctccatgtcaatgaaccggcgagaagtccaccggtgatgaagccatgctaaggaggacgcctcttgttggtatttcttaatgacattacaagaaatataattcccagcaatggcgcagaaatacttctggtatattatggttacagagttcatccgcaagcgcacggatataccattatagcatttcacccgagagtattccaaggg

SEQ ID NO: 25409 - DNA, 10709 bp, Oryza sativa
gcagccccggccttttcgaccacggcctcggccttctcttcctcttccccttcctcattgccatcacgctctttgacgtcgtcctcgtcgtcggcgtcggaatcggaggtagcaggaacccttcgcttcctaggggcaagcttcacttgcccgcgcgtccgctttcgtgaaggccctacgtcgtcgtcgaccttgtgggggttcgcccagggaggcaatttgccgttataaacccggttcgcccggccgaccgcatatcgtgtcagcagttggctatactcgacgactgacacgtcgtcgatcatcttccgggcttcggcattggcctgattgagggtcaacactgcaaaaaatagagggtgcagccacattaagcgtcgaacgaagcaaaataacgaagcgcaggcatgcatagcgaaagtgcagtcttaccattcgtcccctcagggacaaccaatttcggcagaccatcaacctcttcgccttggtcaaccgtgacttgccatgactaggagaggggaaaatgcggaagcatgcagaactcctccaccaagtcacgacagctaaggcgggagcaaaccttacacagcagagcgaaccgcgcctccatagcgccgtccacggcgatcttgggtttccggttcggcgcgatcgccctgcgccggcaccggagggccttcgctgactcggaaccagcttcaaaggggatggtgtggtaaaaccacctcgccattgtcacgcccagaaattcccgaatagaattccaagcagaatgtgcattaaaatccccatccaggaccagccggggtacacaaacgacaatatcaacattcagatctacgtcttacaaacatcacaaaagtcttacataaatgcagcggaaagaaagaaagacaacaggagctaagccttgactagaactacagcgggaacaccactccacaggcatcctcgacggcacggacgaagcctactcctcagagaaacctccatctgacacaaactcatactctggggttgggaaaaatagagcaagactgagtactacccactgtactcagcaagtcataccggaataggggtatgatgcaggcaattatcaaagaagagctagagtggttcatttgcataaagcgagcatttataaacagaagttgaaagatttaaacagttgtaataattaattaatattaactatccactgtccaatgctattccacgttgcaacaggcccgaccaaccacctaaactatccaaattcaaaagattacactagggtgagactaatcacggtgaatctggttgaccgcccataaccgcgggctcggctattcgaacagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccaccctcgcctggatgcgtcggctagagaaaagctacactacaagcccagccgttgcccacgctggcttgtggtaagtatgataagttcttccagggcatcccgcgaaccggtccttaactgccatgggtgcgaccaacaaaaccatgcacccacagcccaccatgtgatttattttaattaaccaacaccgaagcggtgtcactactccaacattaccattagaacctacagtctaaacattaataggattttccccattgtgtactagttgaactaagcatgactaagcaattcctagtccaaagcgtattcatgttataacccaagctaacaaaggagcatggtatcaaaatagcatggctgtaacagtaggtaaacatcccatactaacattataaaacaatgcagtatttgaagaaaaacaatagagcatttgcaatataggatcaacatgttcaagtgacaggcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcattgtgtttattactataaaagaaaaaccttaaatcatttattgcgcaataaatcccagggctgacgtcatcaagggggcgcggcgccgacatgcggggcccaccggtcagcggctcgggagaggggggaaaagggcgccggcacgcggggcccaccggtcagcgactcaagggggagggcggttcaccgcggaccgggaccacgcgggtggtccaccgccggtccacgggaccgacggcccagatcgccctcggggtcgatcggacgggcggcgacgacccggctcggcttggctcaaggccggcctaccggccgcggcgatgacgacggcgtgcgcgcgcgaacgcgttgccggcgacggcatccggcggcggaggcgacggcgcaaaggcgacgcgaaggcggcggcactaagcggcggctaggaaggagagggaggggaatggatgggagaggaaacctcaccgagggtggccggcgcggaggaaaacgacggcgaacagcgacggcaagccacgggaggacgacggcaaccggcggacgggtttcggggtgtcctaaggaaggaagagagagagattagagagagggagatgaaccacggcgaccggcattcatggccgaaggcggcggtaggggttgaactcaccggagcgcgaggggatgcgaattccggcgacgaaactcgacggggaaggggcggccggggtggagcttagcctcgcgaacccgacggcggtgacggcgcggcgcggcggcgaccctagcggcggctagcggcggccggagtagcggaaacggcgccggcgggtggttgcacggcgcgggagcgatggggagcacgagggagttcggcgagatggggaaaaagcgagaggaggcgacggggaagcctaaataggggaggggagccccggacgtggccggtaggggcgggatttcgccggccaacgtggggagtgggggaggagagagaggtgggattcgaaaatcgaatcccggccatctcgggcccgggcgcgggcgggagggagaggggagtgggcgcgggagatgcggcgcacgcgcgggcgtggccgacatggcccggaggaggcggaggcatgggcgcggcggcggttgcgggcgcggcggcgccggctggaggaaggggacgggtccgacaggtggggcccacctgtcggcgtcccgaggagagagggaggggcggcttgggccggcccacaaggaggacggcgcgcgcggcggggtggactgggccgatggcccaagaagaggaaaaggaggggaaaggaaaaaaaagaaaaagaaaaggaagaaaagaattccctgggatttaaaatattgcaagctcgattttaaaaggttaaaattatttcgagagctctgaaaattccactaaaaatcctgttagtgaatttcgacatgtagaactcaagaaaaattccacaagccaattccgattattatttgcattgatttaatagggtttactcttgctttgcaccggtattttcttagggtctcttattaattcaattttaggcttaggaggagaacttcagggtgtgacaaacctaccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctggttcttctttcgctggtatcaagtatacgaaccggcttctccacatatgttaggtcctcctggatatcaatgtgttccgaatcagcctgttcttcaggtacccttaagcacttctttaattgggacacgtggaacacgtcatggatgccgatcatattggatggaagttctaactgataagcaacttctccccttcgttccaggattttgtagggtcccacgaagcgtggtgccaacttgcctttcgtctgaaaacggtgtactcaccggagcggagtgacacgaagatacacgtaatcccctgcctcaaaagtgagctcccttcggcggttatccgcgtagctcttctgtcgagactgggcaatcctcaacctttccctgatgattctgactttctcttcggcttccgctaatacctctgtcccgaacagttgacgctcgtctgtctgatcccaaaagagaggtgtgcggcacttccggccatataaagcttcaaacggtgccatctgtagactggcctggtagctgttgttgtacgagaattctgcatatggcaagtttttgtcctaagttccaccaaaatcaagagcgcatgctctcaacatatcttccgagatttgattgactcgctcggtctgaccatcaatttgcgagtgataggccgtgctgaaatttaaacgagtccccaattcttcctgcagcttctgccagaattttgaggtgaactgactccctcgatcagatacaatctttttgggtactccatgtaaacacatgattctcgagaggtagagctccgccaaccttttgcccgtatacgtggtatgtactggtatgaagtgagcaaccttagtgagtcgatccacgactacccagattgaatcgtgacccgatgatgtccggggtagtcctgttataaagtccattccaatctcctcccatttccattcctggatttgaagaggttggagtaaacctgctggtctttggtgctctgccttcactcgttgacaaacatcgcagagtacgacgaattcagctatttctctcctcatgctgacccaccaaaacttttctttgaggtcttgatacattttggtgctgcctggatgaatggagtactgggtctgatgagcctcggtgagtatcagatccttcagttccttgtcgtcaggtacacacaatctttctcccaaccagattgtgccgtgttcatcttcgtggaaatcccgggcttttccgactctcatgttctttttcagctctgctatttcagaatcatttacttgagctgctctgacttgatccacgagcgtaggccgtgcctccaaagcggctacgaacccgtgttcaacaattcccacgttgagatgctccaactcctgccgcaattcctcacacatgccctcgatgcatagagcagtgcagtaacttttcctgcttaatgcgtctgccaccacattggctttacccgggtggtagtgaatgctcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaggtcatgagttggataattcccttcgtgtggacgcaactgccgcgaggcatatgcaaccactctgccctcttgcattaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcatgggtcgggcgatcctggagaagttttcgatgaatcggcggtaataacctgcaagtccaagaaaacttcgaatctgcgacacggtcttcggtggggtccatttggtaactgactctacgttcgatggatcaactgccacaccctgagctgtaatgacatggcccagaaatttgacttccgtcaaccagaagtcacacttgctgaacttggcgtatagctggtgctccttcaacttctcgagtaccagacggagatgttgctcatgttcttcttcggactttgaatagataagtatgtcgtcgatgaataccacaacaaacttgtccagaaattccatgaacactttgttcatcagattcatgaagaatgcgggtgcgttggtaagtccgaaagacataaccgtgcactcatatagcccgtaccgagtggtgaaggccgtctttggaatatcctcttcccgaattctcaactggtggtagcctgatcccaggtctatcttagaaaacactttagctcctttcagttgatcaaacaaatcatcgattcgcggcaaaggatatttgttcttgattgtgacctcgttgagtgcgcggtaatcaacgcacatcctctttgtcttatcctttttctccacaaaaatgaccggagcaccccaaggtgaagtacttagtcgaatgtaccctttctgcagctgctcatcaacctgcttcttgacctctgctagttcgttggccgccattctgtacggtctcttgtaaattggagcggttcccggtgccaagtcaatccggaattcaatctctctcttgggtggcatggtagtaaggtcttcggggaacacttctggatactcgcagactatgggtatatcttccaatttcctcaaattcttctccacagtgtccactgggatttccgcctcaatctgattcaaagagaccccttgctttggtgagtctggtgatttgtacactactgtttctcccttctcgttggtcaaggtgactgtccgattcgcacaatcgatgactcccttaaacttggtcagccaatccatcccaagaatgacatccaggtctttggattcgagaagaataaggttggctagaaatggcgatctttggatttctattagcactgaagggctaaaactgactgaggttgaactatttcccggggtatgaaccctcattggtgtgctaagctcttctttccttaacccatgcatcccgacaaacttctttgaaatgaacgaatgcgttgcaccagaatcaaaaagtattgttgcagggattgagttaacaggaaacgtacccagtacgacctctggtgctgcttgtgcctcctccgcagatgcgtggttgacacgggcctggataaaccttggcccggcacgcctaggcttcgggcatttgtcagcgaagtggccaagctcgccacagttgaagcaggaccctggttttgctccagtctccttcttggcttgcgcggacgggcctgactgtgccggtgccattggtgggcgtggagctgcaccgcggttgggctgacctccatggtggttctgactgccactggcgccctggggaaagttgctagggttgaacgggcggtactggtggacgatcatggtggtaggtccaccctgctgcccgggagcgaagcgcggcctctggtgacttccctgaggtgccctgaactgagcggcctacctcttcctgtccatcttgttgcgttgatcctcctgacggattgccttgtccaccagtctttcgaaatcggcgtaatctccagatatcaactggttggttagctcatcatccagacctgctaggaatttttcctgcttctcggcgtcagtacggacatcctccggtgcatatcgcgcgaggcgattgaactcatggagatactccgtcacagtcctgttgccctgatggagtgcccgaattccctcttcttttgtgccacgaccccgtctggcacctgcgccttcttgaagctacggcagaactctgcccaagtgacttcagtacatggtgggcgggtggccatgtgattgtcccaccaagctgacgcaggaccttgaagctggtgtgtggcgaaagcaaccttctcctgatcattgcactgcaggagattcagtttcttctttatggcatggagccagtcattcgcctccatagggttggtggtgctggagaaggtgggtggcctgacaagtagaaactctggcaacttggactgagggggagggggaccaaactgctggtgctgctgttcggcgtgctgcagcatcctctggtgcatctgctggtgctgctgctgcatctgctgcatcatggctgccatcatctgagtctgatgtgccatcacttgggctagcgtcggattctcgggaagtggtggcggaccattgccggaattgctgttgggatgcacaccctcagtgcgctcttcaccgttgctgccctcgcctgttgcgcggctaccattcctggtgtagaccatctggaggaaaagcagacgggggaaaagaagaaaaatagaggctcaaggactaggctttattatataggaatttaaactgcaattgttctgatctgaattaaaacacttaaaaagcaagcaaaaatccttattaagacagccatatcataggcacatgatatcgaccgttgactgacccacaagcaagcaacctaaacacacaaactaacaaacaaatgctagacagtcgataaactaatggaaaacgagcctaatgctcggaacggctcctgcggtcggtggagtcgaaggcgtcctcctgctcgtcaccaggtccctctgagcgactcctggagcttggcagataagtctcgccgctgcccggctctgagccactggagctactgctgctgagatcgcggctgccactgggagtagcagacaaccaacctccgttgccactggctggacccctggcggctgatgctggagcgaaggagagagcggacgcgggagctgacacgtgaacgggagctggagctggtactggagctgcaggaactaccagagctgcgggcggaactggaggtgctgcgggagctgctgatggaggtgggttcctgggcgcaagctggatgcgcacgggtgcagtcgtcgtcttgcggggcgtagtgcggatccggactcctcctagagcgggaagaccctttaactgagcattctccctcttcaggcgcgctatctcgtccttcagagcgacgatcctcatgagcttcccatcattcaaggccttggacgccttgtgcaggtccgagtgcatcctatccaatcccctcatcacagcacacatgtgaccaaaggtggtgtcgttctcgccggctgtcggacggaaagtactgacatcagcaccgctggctcgacgagggtgaaatcggtacgccgtgtcgtggaagatgtagttgtggcgctcccgtagtctggccatcatcaggtatgctgcctcctgacaggcgagatctgctgtgcctccggatgcctcaaccaccatattagctaggcaggtacccacgtagccgtggacctccaggcgaacacggtgaggaagctcgccactgagcggtggaacagtcgtgtactctggcgcgttggggtagcctaccaccagcgtcatatgtgccaactctgccacaaagtcaatcatgccttctccgcggtggttgggtgggtggccggccatctagagaaaacaaaggagtaggatcaatgcatgctcaaatccaaatttaaataaagcaattaaagactcaaataagagaattgaataagagcgaaattttatgcatagatcgttttgcatgagagcgaataaataagacagactcacataacgataaaatattggggaaattagatacatactaataataacagtaagagcataaataccttgcaacccatgttcctgagctaggacctaatgcatttcacccatcaaatcccaactgactgacgaataaatctcaatagttttactaaaaccctggactgacttgttttgacaaatctcacttaaacgagcgaccaagatttttccccttgaaccacaagaacagatcccaattttcccggaacaaatccaattgcaaagaacatatgcaatgaaaaggatttagagggctcttaggtttttccatttggcttgtcctacggtcaaggtcggctctgataccaacttgtcacgcccagaaattcccgaatagaattccaagcagaatgtacattaaaatccccatccaggaccggccggggtacacaaacgacaatatcgacattcagatccacgtcttgcaaacatcacaaaagtcttacataaatgcagcggaaagaaagaaagacaacaggagctaagccttgactagaactgcagcgggaacaccactccacaggcatgctcgacggcacggacgaagcctactcctcagagaaacctccatctgacacaaactcatactctggggttgggaaaaatagagcaagactgagtactacccactgtactcagcaagtcataccggaataggggtatgatgcaggcaattatcaaagaagagctagagtggttcatttgcataaagcgagcatttataaacagaagttgaaagatttaaacagttgtaataattaattaatattaactatccactgtccaatgctattccacgttgcaacaggcccgaccaaccacctaaactatccaaattcaaaagattaca

SEQ ID NO: 25410 - DNA, 10214 bp, Oryza sativa
aggaggggaaaggaaaaaaagaaaaagaaaaggaagaaaagaattccctgggatttaaaatattgcaagctcgattttaaaaggttaaaattatttcgagagctctgaaaattccactaaaaatcctgttagtgaatttcgacatgtagaactcaagaaaaattccacatgccaaatccgattattatttgcattgatttaatagggtttactcttgctttgcaccggtattttcttagggtctcttattaattcaattttagactcaggaggaggacttcatggtgtgacagggcaccacataccataccacatggtttgcacggtctcggctgaagctcctatctcacccttgcccgtgaggggcttgttggcggtatggcatgaggcccttcgaccaaacctgccgaaaccacgcgatcagtggggattcaagcccgtggcgtgaaggttagtcagggcgaagccccctcatggcgaaggctatggaacaaggacggcgagaggtggggaatcgcgcaggtaccttgtcgggctagaggcctcttgggtgaaggatgcagggcgaagagtatatgctgaaggatgcaagttcgcccctgcgaggaccgaagaagccattccggcccttcaagccaaggggctattgcgccgacgatcgcctggcggcccatcaggggctcatgaacctcaattacattatgtacccatgtaaatgtccctttcataagggcaaccatataaattcccctgtataaccaaaaccctagtagtaagaacctgtaatgggggctataaatagtcccatagggccttgtaatagggggatcccaagaaaaattctcaattttatacactttacttcttttccaactactgttgagtgaccacgtctttcgacgtaagctgttgtcgtttcgacaacacaactcaccaggctcatgtgcatatttactggaaagagcatcagcagcaacattggatgctcctttcatgtaacagattttaaattgtaaatccaacaacttggtgaatgctttgtgctgctagggggtgtgtaacctctgctcactaagatgcatcaaactgtgatgatcagtaaggattatgaattcagcgtgttgtaaataagacctccagtgatccacatctagaagaatagctaagtactccttttcataagttgataaacctctagatttcacacctaaagccttgttgacatgaacaataggatgaccttgctgacaaagcacagcaccaatccctgcatcactgccatcagtcgcaatagtgaatgtcttagaataatctagcaatgctagcacaggaactgtcaccagagctaacttgagagcctgaaatgcttgatcagttgcaggagaccatacaaaagaaacatccttcctcaacaaatgggttaaaggtttgctgattaaaccaaaattcttaacaaattttctataatacccagccaatccaagaaatctcctaagtttcttgacagatgtaggcactttccaattgacaacttcctcaatcttagttatcagtagtgaccccttgaccactaaaatatgcccccaaataagccaactgatcttgggcaaaagaacacttactaaacttcactctccattttttttgactggaacttcacccggagatgagacaaatgagattgcatatctaaattgtaaattaaaatgtcaccaaagaagaccaaaccaatttttttagtacaggggctaaggtgttaatcatagcattttgaaatgttgttggtgcacctgttaacccaaaagacatgaccctgtattcatagtgaccagaatgggtttgaaaagcagtcttgtgttcctcaccctccatcaacctgatttgatggtaaccaaccctaagatctagtttagagaaaaacttttgatccaaccaactcatccaatagttcatcaatgacaggcataggaaacttccctttagtagaaatcgcaaactctccaggtgccatccgtcttcttaactaacagagctggagaagagtaagcactggtactaggttgaatcactcctcaagagagcattttagaaacttgtctctctatctcatccttctgtgcaaggttatgcctgtaaggcctcagacacacaggtttagaattgggcaataggagaattttatggtcacaagctcttttgggtggtagtccatgaggtgctgcaaaaacctgctgaaagtcttgtaagagttgtcgaatatcaggagaaactgactgaagctgatcagtagataattcacaaagttggatgacatgcatgatggatcccaaattaagcatgccatgtagctgctcatctgtgatagaggtacaatgtatagcgtgagactagatgctttgaagcttcatcaaatattttctatgttgatattccatccatttagcagcccaatcaatattcattgtacccaaagtaaccaaccaatccatacccaaaatgtcatcataagctcctaagggcaaatgtttgaaatcggttttaaatccttggccttgaacccaccagtcacaatgaggaataaactgagaacatagtagtagtcccccatcagcaatcttaactgattataccttggataaggattgaactcccaaaaaatctatgtgccaaactgctgtcaataaatgaatgagaactcctagaattcaccggcataagaactttagtgccctgaacccaacctctcaacctaaaagaagtagctgattcggtcccactaacagcttgttgagatatagccatcaaatttccctcatctagttcttccaactctgcttccacaaaatcaacatctgggtgtagtatatccaagagttcctggaccacatgcaattgcactgaagtagcaaacttattatctctaccccaacgttcaccacaagtaacacaatccttttgctcttctataagctttcagggcagacaatctgtcatctcttgatttagaaaagtcaagccctcttatcatccaacacaggagaatgaatacctttaaccacaggacttactggagagaagacttatagtagtgttgtctgagaactataggagtatcatatttcctatgattgattggtttagatccttccaagatttcctcccacaagagcaagctgcatctaggtcctgaggtttctgtaatagaactattgacctggtcacaaagtaattaagaggaagggaaccattataagccagcaattggtgcataatactatcaaacttttcaacatattctgacatactagagtcctgcaaaatgtgaatccactgtcgaatcaaagtttcttgtttgtccttagtgaatctcaggcacacctgatcagcaaattcctaccagctaacacccacaaatttggaccccatagactgacgccagaatgctacattcccaaaaaaaatttaacccagcaactctgacccaattcttaggatgaaccccatacacctcaaaatattcttcaaagttgtttttccacaactgaggactgttgccatcaaattgtgaacaagtcatggatggtacactacctcctaaccccaaaatcatagcagaatcgactgcatctacaggtgtattgtcacatcctgattttcgttttaggatttataaattatttaataaattatatttagaatttgtattaaatgttcattaatttacaagtgaagttaaatgtgggaaataaaatttcctaaatataaagcatggatggatttaatttttattaaattctccatggttaattatactctctggaattttctcggatttttcggagctcaattcctaattttaatcatacaaagaacatttcagtaattacccacatattaaattaatcattaaatggtctgattatatactttttaagtactttgagtgtccaagtattttcatgatttttcttgaaattatttgagcattggaagtatttttaacaattcaaaggtcattttagtgattaatttaattggaaaagtaattaaaatcctttccttagctttgggcttaatctggcccacctctctctcccttagcccgatccagcgcctcccctcttctctgcgcaagtctaatttgctatcctccttcaatcgggccgaggaaatgaagcccggcaggaagtctgctacagtgtcgcccctaacctccagccggtcgatctcctccctgccgtgcccgtgtacagcgccgcttcctccaccaaatccgccgcatcccgtgctccgtttgcaaaattagttgaggggaaatattcctcttatcctcctctatcctttcccccaagaatcggactttatcccgaagaaatcaacacggaatagaattcgttttcgagtttatctctccaactaaccctcggattttccggcttcgattcctctcggttggagtccgatctcttcaatccaagcctataaatagcatcccctagtcgtcctctttcgtttgccccatctcccgagctctctcgtgccccgtagtgccgccgccgcgccacccaaaccgccgccgtcgccggccggcgaacagccgcctcgcgccgtcgtattagccgccgccgccgcctcctcacgtcgccgtcgggtgcgcgtggaagaggggaagctcggccgccccttcgccgtcgccaccggtcaccggagagccgccgccgccgcacaagctcgtcgccggtcgtcatccgtcgtcgttcgtcgcattggttagtaccggtgagatcgcgttgttctcctctacgcgtaggtaccctccaaaagtccagtcgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaattcatctaaaatcaaaatctacatgttaaaaatatccacatgtactgtttttgcttgtttttgtactgttttgttgattttgttcttttgttttagttaccgacgttccggaggagagtattttcgttgaggaaggttcggaagtgtttgcggaagctcaaggcaagtcacacagatcccaaacaaccctttgagcatgttgaacccgtttaaagctattgtttgatttcaacttatgcattattttcgaatgtcatcgggtggtgagcctttcccaattaattaatggccgaagatgactttattttcctattagctagaaccttatatattagtttgggttcagctaaatgctatatatatataattgcttagccatgcttagaaacattagcacatgattgggataactaatgttacactatcacttatggttatatttaatggtagctcaggatggtcaatcgtgattggttaattaattattgccaattaaaatttgtcaatggtgggttgtgagcacatggttgtgaaggtcgtgctcattacaattaaggactggttcgcgaactactgttgtgagacattaaccgtgccaaccacaagccagcatgtgcaatggctttaccttttgtatagcatgattcattgcggggcaccagactgagaagcggtgagaagtccgtggaggtcgctggggagtccatgcctctggttatatttatagagggggtgattatgatccagaaatggtgcactgtggtgagttgtgttgtgcagggggtattgtcatagcctctattcgggtactttccagtatcgcgacgcatggtagacatgatgttgaggctgtgtcttgtgggtacagtggtacacctctggccagagtaaaactattcgaatagccatgcccgccgttatgggcgagttgagcaatgtttttcgtgattagtctcacacctctcacaataattattgatgctataaccggtaataatttgtgtagctcctggtttggagttaggtctgtacagccgggtatggttgttcaggatggttgggcctgtgcagcatgggtgtgctgttcagtgttgattaaaatttctgattaattactctactgttttacttcttttaaatctttgctaaatgctgcttttgcaaatgagcctatattatgccatcctttggtatccttgtgcacttgcatatttgctgtgtggcttgttgagtatgtcatatgctcattcttacaataatcatcaaacctcaaaaaggatccagaaggagaagacgtttggcttataccccagttgagctgcctgtaggagtggagctgaagccatcgctagaccgttattccgctgctgttttcttttcttttgtaagtatgtacggttatttttatgatggatttgtatattaaattgtcaatttgtgtaccttggctgattcctggatgaggatttttatgcacaaattagttcggaaattactagtgaatttccgggcgtgacatgtgtgatccaattcaggagaaggtaaggtgggaaatagcacctgtaggagacgtaggagcagaaaatggctcacgggaagcctgctgaaccacaatctgcagcttctcgaccttgtcttgcaattccaccaccgaaccttggagttcatccacgcgtttctccacgactgtaaaatgagattccaccaccaccttgagagccatgaactcaattcggctcttctcctccgactgctccctgcgcttctcgctctcttcccacttgcgatcggaatcctccatcttcttcaagagtagatctagcttgccatcctgatcgatgactttggccgccatcttggtcacgtaccttggcttgtcgtactccaccgtgatgaaacctggcgttcgatctcgcttagccagttgagggagccaaagcttttgcgggatcagatcatcgaagcaatcaattcccacctctcctaggaattacaacaaaatgaggggaaatttttttcagcgagactctgataccaaattgttagcaacccaacacccaatcactcaagaacatgcaagaacagtagatagttcaccgaatccgataggagtaccgccgccgccttcgctaccgttcttttctttcttgttcgattggaaaggaaatagagtagttatagtattacattccagtctctctctctctctctctctctctcgctcacattactccttgtgggtcgggaaggtgctcatttggcccattccagcccatacactttaggattacatttacgaatacgacctatcttttctgtagaagtctgatgctcccactccagcttgtcgctcccctatatatcatcaggcaagggtaggttcctgacaaagaagcttttgaggaggttaaacaacatttgttgaaagctcctgtagtgtccttgccaaacttttcaagacttttgtggctgaaactgatgcacgtgacaagaggattggggttgccttgatgcaatcacgccatcccataactttcatcaacaaagctttagggaagaaagcacaagcattgtcaactaatgagaaagagtgtattgtatggcaatcttacttgctgtggaaaagtggaaatcatacttgcaccataatgaatttttaatccagtctgaccacaaaagtctaacacatccgagtgaacaaatgagcaagtaagactgaattaaaagaggttttgtgaagttgatgggtctaaataggtctatagtatcaaatcaagtagaaaaaagggtgtgataacgtagcagaatatgctctatcaaggagaggatggatgatgaataaatccaagtgttagcaccccgagatggatggagaaggtgatagaggcgtaccacaaggacctagcaactaagcaactactggttgaattgagtctgaatcctgaagggaaggagggtttccaaatcaatgttaaacatcatgttcctagctatagctgactattgcatcatataccatattaatttctaagttttcgcaatccacaaccaacagtggttcaatcaattacttcacccagaaagatgtacgtgttacagtactacggttccttgccttgcatgcaactatacgatgtccacatgttgattcaatccacctgtccacaccttgctgccctcgcatgtgcatcgcttaccccgatgccctccatcctcgctccactaagggtgtgtttggtttgtggtcaagcagggatgggatatggctatccattttttcagggatatggccatccaattttttgtttggttggatgagtgggataagctaaatttttgtttggatggaaggataagatgtggatatggtgatccatttttctatttggtaggaaggatgagctcttacactcacctattggatgaaatggtgagaatacccccttggttcacacttatttgcatttacactatgtaagaaggaacatatgcattgtaagtttctttttttctctggttgtaaatgtattgtatcatatgtttaatttttggataataaagcacatcttaatatattcaatgtcatgatgcagatataaatttaagtttgattcctacactggtagaggacaaatattatccaaatcatgtccatacatagatgagggatatagataaatacaacatatcaaaagacatcaaaattgacactcataaaccagatctgaacaaatacttcaatgagcaaaatcatcagcccccttaatccatcaacccaccatatctaaattaatccattaaccattgcaacgttgagtagtaggaggaaaaaaaaatctcagcaggacgtcgccccattcagccacatacatcgtcgccggacggttgcctgcaccaccaagaccccgccgcccccgcggccaaaccctgtcgcctgcatggccacgccgccggacgtcgccgcccgagccgctgaaccggtttgccgcctgcgccataaccgaacgccgtcgtccgcgcggccgcccgcgccgccgaaccctgccccgcggccccgccttgacatccttggcgccctctgttacaaaatcctcaaatcttcatgtcctcctcgcgaagcccatcaccatcacagccgagtttattatacacttgaaccattgtttttcaattaaatcaacggtttaagtcaacccatattggctatgttttggtgataaagaattacagaaaaattacatatttgacccatatttattttcaatatattaatatatgcatgcatcatttttttcaggcctcccctaaattaaagaaaccctggaaatttttctcgacaaagcaaaatataagtataattttgggagtgactattagtcagttgcctgaaaaaaaaataattatcagtcgatctctatgtatcgtccgatcccatccaatatctgatcccgccaggataaaaaaaaacaggtaaaacatcttgaaccatggaccgcttatcatcgtgaactggttttcggatctacattgttcgatcggttcgaatcttttgtgttttttatgctggttattgatttggctggagtttgtttcgtgctcttttgttccatttgtatgtgccgagcccttagcaatttagaagttatagtgtaatatgcctagcccttagcagattcagaagttataatgtaatacgaggtcttttacggtgacctagacacaggatcaaatgcaaacaagcagtttaatcttatagtgtactacgccttaaacagcccatgggactaatacaaatcatacaagcttgacattatacacgaaacaaccacaagaaaaaaaatagaaatgaaacattccccaaaaatcaacaacttgtactaaacaaaacattagttcttattagagactcactgcaatcccaaagaataattatttaccaacttcatcagacccaggcatagagcaaataaaatataacaatggagatcacagtaaatatttcattagatgcacacttgcttcaagttgggttcgcatcccctgcctttgaggccaaaggcaaagtttgccgttgctgccatccagcacatccagttcctattcgtggattgcatgtttttttcctcaatttaagatgattacaggcgattagttgataatatcaattatgctggtcccatttaaaagataatcccttgatcaatattg

SEQ ID NO: 25411 - DNA, 5510 bp, Oryza sativa
ctgcggtttgtgatttttattctcggcaaaatggacatgtccccggtgatcacagttctttgtgcgttcagaaaaactagaaagaaacacgcgctacgctgcgtgcgatgatgattgtattaacatacaacaatgcataataagtattctcctgcactttaatgtgtaaagagcagtgcatagtcaaaatctttcactgccaatgtacaaaatgcatacatgactcatggccaagcaggcctttatatgttactgcaacctaaaagatgatacatcaatataagaactgggctataaaatgaccaccttatataaaaactaaataaattgataattgcatctttcatgtacatatacttgcatagcttaacaattcagacatactgtagatttctcctgcttcgtggaagaacacggatatatcattgtaatatctggaaatccagatgcccaccaattcctgacaaagcataaaggtaaaaataaatctatttgtttgggttaattaaattcaagatgtgtcaaaattgacttaagagtcaatataacagatcattaacactggtcatatgtaaattgagatattgaggtatatttgaaatgggattttttttcataaaaaagtatttgtagctatggttaggaaatactgtagaatcagactgcaagtggtagagatgaaccatgtgctgattttgaacaccacctacaacaaaaagaagcaatccatgaaaattggtcaactaagataatgtccgcaatagaaggtcaaaatgaccacataagacatcataataaagattggataggatctatgtgttagtataaagcaaaatgagttaactaaaaagttcgcatgtaaaccacaaagaatgagctgaatagaagtgtactaattattgcagtagcaacttaaggagcagcaaaaaaaccacatttagctcatcaaatattaccaaactattgatgatccaatactgaaaatgaaactattcctcagctaatcggtcctgcaatgcaacgcaagaaaaacctaatccaataactcctaataaattagataatatgttttaagttttactaatgatgaattagatatattgctggactttaacatattttcaaaaacatggtaaatttatctcctagagttggatgtaaagattaaagttagactttctatgcaataagatgtactatacagttcatgaactgaacaaatttatagaaagcacgacctaggaggacatgacccatgaggtctagagaacttttgggttattcataatctctagatcaagattcatggtactaaatgtgtaatcctctatgtggaaactgcaaaatagtcctggcatgttatagtatccaagaacaattttcgtaaactcctctcgaaaaagtaaaaaactgaataattgctattacagctgaatacataacttgtatgtttagagaataagttatataggtgacagaatatgtgcgccatacaaagaggagaacatggggagtccatgtgaacggttcaacttagtactgcaagcactcgtgtaaacaggtaaaaccgatctatatagactaccgagcagagaatgaagaagcacatctagactttcccgcatgaccaagaagaaaaaactgaacacaacttgcttcacatttgtaatttgggcatgcaaaaacaaatggtttgctcaacatagagcaaatgttctagcagcgagaacaattgggttgcaaagacaaaaggaagatctaacatggagcaaattttatagtagcaagaacaattggttcgcggagctaattcaggtaagaattgctctcaaaaacggtaggatttagctatctaaggtatgctcaaatctgacaacatggctgcagaggcaaattagtaaagataataattcacattacactcagtaaacaataattgaagaacttgatgggttttaccttgaatcaaaggtttgatgtaggcaagcaacctttaatatatagaagctaaactcttaataatcatgcggagtgaaataagatgtagtgagataataatatagcttgttatcatgagaagtactccgtcgtatacatgggctgctagcaatccctggctgcgccaagctgccattgcatggatggccaagcaaaccagtttagcagagcttgttgtggcactccgtcgcaggctgcatttgcacagccacacatgcctcttggagaacagcacattcgtatgggctgctaagtagcttgttcttctccatatcaaaacatcaaggagagcattccagcgagcaaaatgtagatggatatatgcactcaactacaaactttaaaatttaagggatccatttggggaaaactcaccggggttggcagaagtttcttgagtggattaagacatacgtgctaactccaactatttgattgtaatgaatatacaaatgatgaggacaacaatcatatgaacacggccatgcctgaactaacaaaagcagaaacatatatgcgcatcttacctgcaactggtagaaataaaatccaagcaacctatggagtaccagcagatcttttgccattagataggttgctttgaaccactgctgcaagaaaaaaagggggatcgaaccaaaaaaatgaaatccagcaagatgagagagaaaattagatggggaaaattacctgttgtaaatgcgatgagatcttgccgcagaaaaagaactgatgcgagggggagggagcgcactgccacagagaaaaaaaaaaggtggagggcgccgtggggggattcgcgtgcccgtgccttgcccccatccttaccaagatgtgaccgtcctcactggcagatgaggatggtggccggtggcggctcacgttcctcttctccaggcggatggattttttattgcagatgcggcgacctgattggaaagagcggcagtggcggaagcactctgttcacgattagaggagggcgacattgcggcggcagcacacgtaagggaagaggcgggaaggcggtggcgaggcagagttaaaagaggagaagaggcggcgacggcttgcatcccctccaccgcggaggcagaggtggccaaacgggcggcacggcccggcccggcacgggcacggttccggcacggcccgtttcggcacggcccgctaggcacggctgatgaaacgggccgtgccgtgccggcccacgtgccgagccgccggcccaagcacggcccgtggatggccgggccgtgcccgtgccggcacggcacgcccgcggcccacgggccgttcgggggcacggcggcccgtgtgcacagtttttttttttaaaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaaagaaaaaatggtatttttttgttgtgttgaaaaatttaaaaatatagattgtgattcattattatgaaataatttaaaggtaaatccacacttgcgaaaatattgcaaaagaatttgttaaaaatagtaatgacctttattgatgtttatatcattacaggatacaatgatacatgctgcggtgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaatgttagagtagaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctaaggttatgagattgctgaatgtaatgttcaaaagcaggggactccccaaagttcaggggtaaatcttgcctggcgattaaccggacaagagattcccgagcaaccatgggatcgtactccc

SEQ ID NO: 25412 - DNA, 5777 bp, Oryza sativa
catggcgcttgaggtgacctgtaccaccagaagaacgagcagataaaatttgcctacatattctacaacgggctttcgatacgggcccttccgtcggggcatgtttcctttatctcgtcgaagctttgccacacaccggaggtctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttggaattttttcggaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccgcgggccgtgccgtgccggcccgctacagtagccgggccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctacgcggaggagaccggggtcgccgtaggtagagggcacatggacggttagatcgagcctatcgtgagatcagacggaggacgttggcgggaactgtcgcgtagttaatagaaagcgtggggttttttctgcaaaagatcggctgacgtggtgtgctaacttttcaccgatcctacggggtttagagaggttaatatacttacacacgtttattcttttcattattcgttccaaattgtactatagaagacaaatgtattccttagaagaaatataagtactccttactatagagggctaatgtactacatagtaaattattatatatatgtttttcgaagaaaatataattttcgggctatcttctttgacatcacatttaaatttactgtcatgcgacttaattcataacatgtttattcttcttatcattctactccctccgtttcacaatgtaagtcattttaccatttctcacattcatattgatgttaatgaatctaaacatatatatttatctagtttcattaacattaatatgaatgtgagaaatgctagaatgacttacattataaaacagaggaagtatataattttggttccttgaaacattgactagaaaagaaattgggtatttcatctatagtctttttttagggatatgtagctttttttttatttcatttttttggcagctatataattcaaatgcggatcatgcggatcgtacattggtcatatattctcaacaagttgtaagtatatttaactagattgttttcactaatattacacattgacaattactcttttaagctcgcagcaacgcgcggggtatcaactagtttatattaggaagcaactaaccaacccaacaccctatttttctagattgagaccatccacttctgcgcctattttcctggatcgaccaagagggaaggtttttccctgtgtgccattaaaaaagatggtgtctgcccttgtgccactaaaaagtttgagcctccctttatgccatcgtcgaattttatcgtgccctccacaccatttcgtcgctattctgtttgggtttaaccatttggtagctctgacatatgggccgggtagaaaaaatgtcgctcctgccctttcactttttcttctccctcgattcccctcttctccctcaggccgccgccgcgcaggcccgaccggcgcccggccgccgcccagccggggcaccgtgccgccgtcgcctcggcccggtcgtcgtcgtcctgatcctcgtcgtcggtgcgctgttcctcatcctcggcccgaccggctcctccagcttcaccatgccgcggatccgcacggagttcaacgaacccgtccacgttgcggtggcggctccgcctccgccgccgacgcagatgcaagccggcgtcaacacgagcggcgaggaggacagtggcctcctgccgacaacctccgcctccgccctgacggcgcgctcgtcgtgctccacgtccagccgccgccgagcatcgccgccgggctcaaccccggacccatccccttcggcggcccgagtaagcaatctcttgcactcgtcttcgcggaaatcaggacggacacttggtcctgtggctgtgagctgtggttcttgcgaattttttcggtcgagctgatggcttcctggatgtgccgcgcggctgatcaggcgaggtcgctggcatcactagtagcaagcatcaatagtcctcgccgccgtcgttgtgctggtcctggcataactagtagcaagcattactagtagcaagcatcaacagtcatgaacaccagtagcaagcatcaatagtcctcgccgccgtagttgtgttggtcgtcgtcgtcgttgtcgcagcgctgccgccgccgctgtcgtcgcagcgccgcccccgtcttcgtcgtcgtcgtcgtcgcagcgttgttgccgccgtcttcgtcgcgcagcgatgccgccaccgtcgtcgtcgcagcaatgccgccgccgccgtcgtcgcagcgctgcccccgttgtcatcgtcgtcgtcgcagcgcccgtcgctgtcgcagtgccgccgtcttctcccctccgctcctttgctgctgctgctgctgctgctgcatctgaggggagagaggagagtgctaggagagagcatattggaccaaagtgcaactaagtcattttacaacggaatggtgtgaaggatgcgataaagtttaactatggcagagagatgcttgaatattttagtgatacagagacaagcaccatctttcttaatggcatttagggaaaaacctcccaagggagagggcacaggcggcggcgacggtggcagcatcctccaatggcgggcaacgaccaacgggtgatattggttggagacggcggcgctcgcgggccgccgctgtccaatgcgccgcgccatggagatccccaccaccggccgacctcatcctcgccatctctctccgctgcctggttgccagacctagccagcctcccctcggctcgtcagccccctgcggccccgcctcgacgcccctcctctgccggtcggcttcaggctcgacgacgccccaagatccagtctccacgagctctgcccgagagtgtcagaccttcagcgtcgcgtctgtacatccgccgggcgccggctgagagcgtccatcccaaatcatttttgctgtcgttattgttcaactggaattgttctcatgattttgttgccagcctaggtgaaatagagcaatgctacacgtactaaatttttcttactaaacttttactaacaatcatctcaaccgtttaatttaaatatatagaagttacaaaaaaaaaatctaaatgcactcataacatgacacatcagtgttagtaagaatttaataaaaaaaaagttagtacgtatagccttttccggtgaaatacatccaccgcagcagtcgacaatcgatgccgtgtctggatccgctcgtctccatcggcaacgtcgcctctcggtcaatctccaccgtttcaggtttgcagtcaacaagcgcataataggagcgtttcaggtttgcagtttcagagtgccaacatcccgcttttacttgcttcatgtttgtaatagtttcatatttgcagtttgattctaaactacccaaatcttttccactgcaatcgatgactgattttcttagacatctgtagatgtctcttcacaccatataatccttgataaaattgcttggatctcattacaaacggttcaaagtgatttaatctcagaattttaggattatgttttttaaatgtgcacgtgctccattatgcacattttgtgctattttctttgtttgatcaattcatgggtgttgaagctctgcttgtttccatgttaaaaactagagttcatctatttattaagaaatcctagttttatcagtattaatttggtcaaatttgagtgcattaaattggaacagatgggagtacatattcagatgctatcagataacatcattatactttgggcaggtataaaaacaaatgaacagtggccagaatttcgaatttgagctccaaaaaaaatattaatggatttggtgcctgcgtcaggtttcaggcttggatttgtccggacgagctctctacgactgatgatcggctggctccggcggcatacgatggaagaatcttggcgactaatgtcctctgcattgtgattttttggacgatgagtgtgtgtttgtaacggtgatggcatgaccaattacacgtgtacagtaaaatatttactgactatatatcaggcctgatgactgctccctccgtcccacaaaaattcgattcctagggtcgatcgtttgtcccacaataaatcgatttctatgccagagattgagaaacactaattgcatctttatcatttgccctgtgttgtcttgtccaccacccaccaggtgaattaaaaagaaatgaaatcaccgtatcatctccagtgaagggaggctttcaggaagtagtttggcacgaatttcacatgaacttttttttaatgaaaagtgctaatcgtggttgtacttaatgagggtgttttggtcctttgttgcttggactaaaactgcatcaggcatcaggcttctagggttcgactttatctgggatggaggaagtatgttgtaatttttctactcatgtaaggctgtgtttagttcctgaaaatagttgaaagtttagggaaagttaggagttcatgtgtgtaggaaagttttagatgtgatgtgatatgatgaaaagttgaaaattgggagtgaactaaatacggcctaagtaaggtccagtaactttgtactcccttaatgattggatgatactaatacatgtcagtaactcttttactccccttcacgactggatgattctaatacatgtgagcattcaagtgattgtagtaaaataattactaaagggactttcttaaggctcacggccactgtgaggctcaattaagtatagtaaaaacatgtcatggtaaatattcttgcgagtaaaaatattactaaaaggtattaaacttatgaaaatacctaggagtaaaaatattacgagttgatcagcctggatttttcacattttggtccttttgaaaaacttatttcgcaaatagacccctgaaaaaacttatcccagaaatggtcctttttggggcgccagattagctggcgcc

SEQ ID NO: 25413 - DNA, 763 bp, Oryza sativa
ggcgcaagcgcggcggcgtggcaataggagggcgccagccatgctggcgccgccccagggaggagccgccgcctctattcctgtttctctgtatggagttgcaacggtgtcatttttattttattttttcggatgttttttcacactcaggatcacgatacaaccaaccacaaaaaaaatttaaactcaaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatataagttaaacagtacatagagatgcaatttttttatttttatttcatttttttgatatttttttcacacttaggagaacataggaaccaaacggacaaaatatgtgacatgtataattttccaaaactctaccgaaacggacaaaatatgtcatctattaaaataggcgtaactttctcatacggactcggaatcaggcaaataatatatgcacggacatctacagaaaaagttacatccgattctcccccgctttgccgggttcggcgatattagaacctccaaattccgcttgcaagattgtgttttcgaggagagaagtttttcgatggagctttggaaaattccacatgccacatatttcgtccgtttgagtttattttttacatgg

SEQ ID NO: 25414 - DNA, 6141 bp, Oryza sativa
ctttgaagtactactaatacatgttacattatcatttttaataatatgtttataaaaatattgaaaacattgccacatgaatgtgtttatattataaatatattattatataccatttttcatatattaaattttagttatttttatatagacccatcctatgatgtcatatgtctttctgctgactatgcagaatctattcgtggcgggcacagacacaacatcaaccatagttgagtggacaatggcagagctgattcgacacccagatatcctcaagcacgcccaagaggagctagatgttgttgtgggtcgtgataggctcctctcagagtcggatctatcacatctcaccttcttccatgctatcatcaaggagacattccgtctacatccatcaacaccgctctcgctgccacgcatggcatctgaggagtgtgagatcgcaggctaccgtatccccaagggtgcagagttgctggtcaatgtgtgggggatcgcccgtgacccagccatatggcctgacccactagagtacaagccctctcggttcctccccggtgggacgcacactgatgtggatgtcaagggaaatgatttcggacttataccattcggtgcagggcgaaggatatgcgccggcctcagttggggcctgcggatggtcaccatgacagcggccacgctggtgcatgcattcgactggcagctaccagcggaccagacgccagacaagctcaatatggatgaggcgtttaccctcctgctgcaaagggcagagccattggtggttcacccggtaccaaggcttctcccatccgcttacaatattgcataaagatttacgagttgaatataattaacgaaaagttatttccgtgtgtgtggcatcaaataaatagagggtatgaacttttgtcatggtgttgcatcattgttgtatgttggtagattggtttttcacgagtatctatactccttataaaaaggagtagtggtgatgattctgctaccaccccactaccaactcttatctttttttaaggacatctaggattagtgggcccatatgtcattactctcaccaacttttattcttgtgaaaggttattaccgtgcgaataaatagtgggtttgaactgtcgttgtgttatatcattcgatgtatgttgattggttttgtttttcacaaggagtatacatatattaagggacagaataattgtcagtcgctaaaaaaattgcaatccatcagtcgatctgtgtcatccgatctagaatcaaagatgtgaatctttgttgggccgtgggttaatgttcttactgggcaaattcgatgaaactgttacagaagttaatgttgtcgttgtcttgcatataatataatccgaaccgaaaaaatattcagatttgcactataattacgtgaaacttgcactaactttgtgcaatttcaacttatgatatgtgcatgcaacatataaataaagtataaaacataggaaatgcactaatcaaaaggtgcatcaaactgcaaacttgcggcacaaagggcatcaaactcgcttggttcagcactccggctgctttgcttatgcaaattcatacacttctgtacggctttcctgcctttgctgtcatatttggaaaattcgtcgccacacatgtgcagttgcatgctctatctaatgctctgtaaatggcatatgcgcttgctccatttggaaccaaaatattaatatcagaagattattgttcagtgtgaaagcaatatatacaaatatgtacctcaaaaagtcacttagtgtataaacctccgataagtgcaagaaaaaataagttgtatattcaatatactggaacttgcatcaattataaatgtgtcattctgtatgaagggttgtccaaagacttgtgaatctgatttagtagctttgtgaatatgatttatgagatggtaaatatgtgaactttgctacatatacgatagttcaaagagcagaactatctgaagggcagaggctgctaaaaataaatctaaagtatagtctcctgcgatgtttgtcaaaaacaaaaatattgctccaaaattgagccgctattaccagccactgaaccataaaggtcagatagacggaaaaaaaaatcccaccgcatgtgtaaaattgtggcgggttatgcttgatttgccaagcatctacacagaacgaaaaaaaaaacagagaagaaaatcaattattacaaaacattataattaaagttgcatattatggagattatgggtaccatatatccatatagacatatatccatataaacagcttatccgactaaagatatatcgagcattgtcgaatttacatcgtccggtgccatttgtgaccatcacatgattttggattagtggaatccatgcatggataaaaagccactgaattcttaatatttacatatgatcacaaattaacaccattcggtataaagtctgcgaatgccgaacattgggcaagggagacattgttgagtctttagcatgccaactatagcctgaaacgtgctcatcataccacataaacaggcaaccaaatgtattacacatcccaagacacttgactcaaattgctaaacctctataatatctcaattacccaaaattcttacttatgctcagctaaccccagaaaattgctatctttgcactttcatctaagccaagttatcaattacataaagacattacttatatacaaatatagacaaataacttagctacatacatagggccaaccggccaaatgttaatgtccatcggaagcatgtctacccaaattaacccacaagcaacagactaggggtagaccactagatagggccatcctaaactggcaaacggtaccgagcacttatctacttgcagtgaagtctaaacaaagatatatgaacaaagtatgagtcagtacattaatgtactggcaaagctagcgcacaatcaaacctacatatatgaaggctataattcaaagagaggctatatgttgtctcaattttcgcataaagccaattttgattcacaaatattttgcaacgtatttaaagtaaacatttgcaatatgtaaagcatataaatcacagcatggtgttaacatctatgctaatataaaaaggaggagttgtgcctagcaatcctacgggtgaaatcatcccctctcatctcattcgtccatcgacgatcgactctaatcttatccatccgttgtcctcctcgccgattgcaccgattccgcacccacgcgatgacccgtcgcgcaaatccccgccgcgctgactccgccccgcgattccccgccgcctcctcgcttctcctccctccgcacgcatcctccttcctcgcgacgggccagcgccgccgcaccgccggaccagcgccgccatcccaaatcgcaaacagccaaaccccaccaggcagacccggaccagcgccgctacgcctccggccttccaccaacgactccggtgctaccaccggtgccggcacgatacggacgccgctattcctcccacctccttgccgcaggtcgcgagtcaccgcgattggcacctccttgccggacaccgcgcgacccccctagattcacgcccaagctccggccgacggtttcctctcggctctcgcgacacgagaccacgcatttcatcccctgatgatccccttccgtgcaccggtaactccatctcgatccccttctcctccgtgaatgacagatcaatgtcccctcttctccataccgtgcgtggctagcgctatggagcacttctccaactgaaccagccatcttctcatctgcgccaccaatgcaccctcaatctccatggccagttggccacacactcaatcttcgtcgtcgcagctcctcctgtcaacacctgctctccgtcaacaaaccaccggccaactcatgtgagtcattaaatttctttgatttgtttgtggtcgactgctatgagatttatgctatattggtaatgctaaccatgggctattgtaatgcagctctccagctaagaacgtgagatgtcggtggtaatttttagccgaccagagatgctggcaatcttgcggaaacaacaggcatggtgacagatttctgttctttttttacctatgaggagattgttgaaagctgttttttttttactaatgcaatctctctgcatatatttctgatgctaatcaggtgttaaatcttttctttatgcacacaagatggtcgatgaaattacccaatgcatgacatgcactgaaatgcttccctcgcattctacaactactactgttatgacttatgacaagttggatgttgatgattggaactttgggagactgtcttgggaggataagaaccacagaaaccgctttgctttccttgcgctcgggtgtgcacaattattacgatgtgccagcaactgaaatgagcggtcaatttgttgttgtgcacttgtccacgttgtagagtggctgttttctattctctggttgaattggaattttttttcctcacttgtatctgttagtacgcaaggaattgcccacagccaatgagttacagggaaatggaacttggagatacagatatatacatactggagatggctctgttagtagcttcagaggtgatggctttggggtgtccaccaacctcgagatcacaatacatactccaaaggcttcaggtacaacaaagtattgcctttctttttttttactgttcagaaggaattatgaaagtatttaaattgagtataaaaagatatggtgttgctaacttcaagaaaatgtctcacccaatttctgcttttcctgtctggttaaacaattaccccttgtagagcaagtgagcataaagtagaggtcattatatttttctttttgctgcaattatgtttccaaatgaattaaattatgcctgtacaatttgttcacaggcaagttcataatttttcaatttagttcagttctcagtttccatctgaatatatggatcatcataacactggcaaactgtatatacagctctgtggcatgaatttgttggattcatgctattgatccttggctcggtcaatttatttttctacatgtgtatatgcactgagaagagtcaacagaaaggaatgatgagtaatgaggcttgaaggaataatagtctgtaaggtgatgcatttatattagtttaacaaacaaagggaagattgattcatgcatattagtttagcaaacaaagtgaagaattgatgcgaaggatctgatcatgctttggatctaaataccaaattgatactttcttgtttggggaaaacatttttttcctgttaactttgttaaatgctttagtttatggtttttacacaatgcctttattttatcactggaataatgtgaaactattaagttaccaaatactctgttttcttaccagatgatattttacgtctccagctcactttgtgcactcttagtatttgcattgcattgtgtcttccttagctataaatgcagcaatctgaaagaaactatattgaaatgccaaagtaggaaacatctaatatattatggagtagaatagtatatatttgctaataaagaattttttatgacctggtttaagttatatatagctttcttcaagaatataaattttataatcatctctccatttgccaccttatcttgaagaagtttagttaccgtcatccttaggaatcgtaatttgttgatcaaaataattttcgtagcttctaatgtacatgacttaaatttaatttccatccccagtatagccaacatgaaggctcataactgtggattatgaaggaaggttttgaggtgctgaagcaaactaattagggaaatattcaatatatttctggtatttgaagttggttcgtgcactgacatggttggatctatactattgacagaagtgatattgggagtcttttgttcaattggtagtgtccaccaacaatgacagtgatcgagaggcaagttgtcgtccatgtccagagattaaaaagaataacctctattatttgaagtaatcggcattgaacacggtgattcggtgaaaaatacaagttggt

SEQ ID NO: 25415 - DNA, 1475 bp, Oryza sativa
aagatttactgccttactggtagtaaggagcatgttttttctaagttgctaaataaacatgttttcatctagaccagcatggttcatgctagcatattataagggatatgtttctcaagtataccatgcaaaattaatttcactcaatcatacaaccctaagggacaatgatttgattaaggtaatgaacgaccaaaattgtgcgtggatcggagaagaggacgatcaattttaattaccttgaggctggaagaatctgagagcgaacttgttgcgctccaagaccagcttcttgtctaccgtgagtgtgtcagtggtatgcaaacgcagtcaaacagagataaagtacataaacttcttttttcataaccaaactcgcattcttgaatgcaagaaggcgctgctggaagagcaggaattgttcatcgtacatgttgtcatgacaaaccatcagaacatgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgggtgtattatagatctgacgatctagttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttatcatggtcttccgagtacttttaccaaatctgaagactgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaa

SEQ ID NO: 25416 - DNA, 2253 bp, Oryza sativa
ctttacggggaataataattggtccagtctttgagcatagaagatagactcatgactatgaatccatgtggaatgtatccggaacaagtcccaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaaaacagtgacaccaatcaaaggtaatgaagttgcataaccatggaggcgaagaaacagtcggtgatgacaaaagccaaccgacgatgaagacgtagacgcgcatcaacagtgatggcgaaatccaccaatcatgaagatgaagaaaatagttgacgacgacaaacgcaaccgacatgatgaagatgacgatgtcggtgatccagccaatagcagtgtagcaaccaatgataatgacaaagacgctcatcagccatttgcatagtaggtcaaccatgaaggtgaaataataagtcggcgaaaacataatcatccattagcaatagcggagatgtcagggccgatgaagcagaggtgctggtgatgatgtcagtgacaataatccatcaaattaatgttatagctgttgtagatgcttcacttggaggagagttgatgttgttgtccaactcgtccaaaccgaaatatttcaagttgttgaagtagaatgtctgctctatatattatcaaagatgaagataatgactcctggagttgactcgttggttgatgaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcatcacatgccgagatgtcgaggctcacaaagacgtcgtggttggtgaagtagcaaaacttgcgaagtagcagcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaagataaaagcactagtcggcgacagcataaccagtcggcgacggaagacgatgatgttcatcagtagtggtagctgtctaaaccagacgtagaggtgagagcactagtcagcagcagacgtagacagcttgtgttgaagatgatgacgcatattagcggtgacggcgacgtagccaaccgtgaagaagatagcatcagtcggcgtcataacaggccagctatgcaggcggaaacaccagtcggcggtggacgaggcggccggtcggtgaagacgtagacgcccaacaacggcggcataataggccagccgtgcaggcggaaacaccagtcggcggcagcgaaggcaagccggtcggtgaagacgcagacgcccatcaacggtggcataaaggccagcgtgcaggcggaaacaccagtcggcgacggtggaggcaggccggtggtggagtcgtagacgcccaacaacgacggcataatggccagccgtgcaggcggaaacaccaatcggcggcggtggaggcaagccggtggtggagtcgtagacgcccaacaacgacggcataataggccagccgtgcagacggagacaccagtcggtggcggcgaaggcaagccggtcggtgaagacgtagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaagacaagccggtcggtgaagacgtagacgcccaacaacggcggcattaaaggccagccgtgcaggcggaaacaccagtcggcagcggcgaaggcaagccggtcggtgaagacgtacacgcccaacaacggcggcataataggccagccgtgcatactgagacaccattcggtggcggagaatgcaagccggtcggtgaagacgttgacgcccaacaacg

SEQ ID NO: 25417 - DNA, 17539 bp, Oryza sativa
acgaggcggccggtcggtgaagacgtaaacgcccaacaacggcagcattaaaggccagccgtgcagacgaaaacaccagtcggcgacggcgaagacaagccggtcggtgaagaagtagacgcccatcaacgtcggcattaaaggccagccgtgcaggcggaagcaccagtcggcggcagacgaggcggccggttggtgatgttctgactgatccattcatagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagcagtccatcaatggtgacaaaaacaccagtcggcgccagtggaaccaagccagtggtgtaaatgatgaagcccattaacagcggcggagtccgccaaccgtataggcaaaaacaccagtcagtggcggcagaggccagccggtcggcgaatacgtggacgcccatgaacggtggtgtgaccaaccaaccgtataggcgaggacaccattcggcggcaatggaggcaggccggcggtgaagtcgtagactcccaacagcggctgcataatacgccacccgtgtaagcggaggcaccaatcggcggctactgaggcaagccggtggtgaattcatacacgcccaacagcggcggcataatataccatccgtgtaggcggaggcaccactcggcggcgacggaggcaggccggcggtgaagtcgtagacgcccaacagcggcggcataataggccagccgtgtaggcagaggcaccaatcggcggcgacggaggcaggccggcggtgaagatgacgatgcccatcaacggtggtgtgaccaaccgaccgtataggcggggacaccagtcggcggcgacggaggcaggccggcggtgaagatgacgatgcccatgaacggtggtgtgaccaaccgaccgtataggcgaggacaccagtcggcggcgacggaggcaggccggcggtgaagtcgtagacgcccaacagcggcggcataataggccagccgtgtaggcggaggcaccagtcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgtataaatggctcaaggaaaggaagggaaaacttccaaagcaaaaaccaagttgggcaattattaaattgattccatcgctctcattgataggaaactagacgcaacccctacctggcgcgccaactgtcgaaacatgaattcggcaattataaaacggggtagctcaccagacctaaaagtggatggatgtggagacaaatgatttagacatgttcaggccctctccatgagaggtaataccctacctcctgtttgggatttgaaatccgccgggtgtattatagatctgacgatctagttgtctcatgccccctaaagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagaacatatatcaaggaagtttaccaattgaaaattatattcagaagtcttgcagggaagacagacattatattcacggacattactcatcgtgataacaaaatctgatcagctaaaatattcaaaattgacaaaaaaattttcttgtcttccctaacctgatcgttagttttaggcaaatgaaattgacaacataaatattccttctcaaaggaggagtgtttatatttctatgcatgtgtgtttaattgttgtggagtgtggatgaatataaagagctatcaggtttctcagaactggtatttggaaaaaataacatatcctagctatatgtttagtaagacaccaagaaaatggaaaacaaaaacaaagcactatggccatgatctatggtagcagctaagaaccctggatatcatgttatctgaccttaatatgctctatggtttgccaggtgatggtaaaagtatgtcttgtaaaactaatgacaatgcaatgcatgtcattgatatactcatgtctcgtgttaagtgatggtagcatgaacggatgggttaaataaattgataggctaattggaaacttggcatgaaatgaagtaatgaactggagagaaatgtaagcactataaagaagaggtaagcttatatataatagccaccggtgctacggtacaaaatcatccattgtggcatgtttctaagttatttttagatatcctaacaatgccatcatattcagcaagagggataactatttttgttcagagcttggcttcaggattcatcacgacaattgatttttgctctacctaacccgaatatgcaatctgtaacgaagttatttggtaatgggagagacaagttaaattctaattgtgctcacagaaaaaaaattgcagtgcggcacatctaaagagggggaaatgatacaactgaaaagcacttcagaatattcagggcattcgtcatcatcgggtaaaatccatcaaacaaaaacaacaacatagcgttcgcaggtgaagtgaagagggaggctctgtgggctagggtttttagggatgggaattggctaggtgcggcggaggccaacgttggaggcggttcgtgaatcgccggagaagggcgagaggaggggagaatttccctagaatgaatgctagctttttcgctaaacacccttggaagatcaagttttacagttatgtcctttgaaccatctctaccgttgattcataatccaacagatgcgggcgcgaaccgatccttggaatagcacgtggccacgtggcgcgtttcaaagatatgtaaactttgcttctaggtttagccacgtggcccaatgagatggtagtgtttgcaccctgaaatcggtattctagattcgagatgaattcctaaggtaatagtacatatgaactgtgcccatgaaaaattcagaacttagagctgcagtttgaagatctcttcagtattgtgcccttctcaacacaaaatcatactaacctgccagcaggaccaacaagcccaaagattcatatctcatcacccgtcacaccaaacataaaaaaaaggggaacggatgcatacctctcgtcccctgatgcagaacgatgattggcgcaggtgaagatggcgtcagctgcgtggaggttgcaaccgcaccgtacatgaggggagtcttctttgtcctcctactttggattggaaaaagctgatggcgcacacaagatcgttcctgagtcatggctccgccgtctacctcctaagcacgccttagggagagggagggcagcgcctaggccaccacgctggcggtcgagcagtgagcaggcgacagcgatggacatggtggaggggaaggatgcggcggcgtgatggtgatcctgattgtcgtctcctccccagatctgacgaggccgaggacggcgagggcaggacgaggatgcccttgggcgtgggatgcgggtccatggctggagccgtgtgctcttggtctcctgacccctgacactgacgataatggtgcggattaggtcggccagcggcgcagacaaccgcagcgatcagcgagcacggcgcacggttgatggcccgggctcgtcaccacgcagcctggatgcgtcgcccgcctcccggaggagtagtcggcgctgggggaggaacaacgaccatgagcagctagccacaggactccacgaggtagcgggcaagcacctccccttgccccagcatggtcggctgggatttcagcgaatccatcggttgggcctcatttgatttggtggacggcggcacgatgaaccgtggaggagccagattccggcgacggcaatgcattcatgacgactttggagcagcaccctccatcgcgacgtagttgacgaagaagaggcggatcggggaacatgttgccaccacgaagcaatcgtcctcgctgtcgctccactctgaatctggcgacaactgagctctatagtgcagcgtagaggacggctgcgaccaacgagcactgtgcacagaggatggccagggtcgccgctccaaatccggctccagtgggactcagcttcggtgacttagtgtaggcaattcacaacgtgacataccatgcatctcggccgtccaaaataaatccaacggagatggcacttgggcccgcctgtaggtcgaaatatcgccgcccgccgcccatccagccatcccgcgtccgagacagcgcccgcccccaatctttcccgcacgcttgcatcgctgttgtgcctcgcccgcgtccggccgtcgccgcgagcgcgagccagctaggaggctcgccaccgctacgcctgccctaggccgtcgtgctcgccacgactggggaggggtccgggcggccaccgcgcgaggccaactccctgccctgccctgccgcgacccatggagaggcactaggccgccaaggccctgccctgccgccgcgaccgggggcgcgtggaggcggccggccactaggcctaacggcgcggtggtgcaggcgggcggccgcgcagcccgagcccgacgcgtggaggaggggacgtcatggaaaagtcgcccaggaccaggatgtatatggaattatgaatctgatggggcggctaatgggcgggtgatcgctccaggcgacctctttgtgcatgaaatgagaatgccagaatgaggctgtcgctttgaatgatctgatattctgtaattctgctcccattttttgtctaacggtgaatcaccaacaattctgaaagtcccatttggaattgtttaatgcaaaaagtgaacggtttttcagctgaaacagaaaggtgatagccgtgtcccagggcacaggaagaggtgcagcgttctccacaaacacaaccaccagtgactcctaccctgaacgaagatgggcggtggtgtcacctctcgccggcgacaaagtgggcggccgaccggtgcgggctctggatgcgggctcggacactgaaatctatcgtggagtcgaggccgccgaaatcaggacgtgcggtgcggcaggagcagcgcagcctcctccacgcactggactcaggttggtgggccgcccacctgcatcagcacatcatcaggcccggtggccggccgcctccacgcgcccccggtcgcggcggcctggcgcctctctgggatcacaacagcggcgcaggtgcctctccactcgcggctggcccggcggcctggcgcttctccggtcgcggcggcggccggacgagggcgaggtgaagcgccggcgtacgcggatctgagggcgagacgaagctgagtccgtctcaggctaagcgcgtcttgtgcgcgtgcgggcctcctgataggctgaaaccgagatatttcgacctgtaggcgggcccaagcgccatctccattggattcgttttggacagccgagatgcatggtatgtctcgttgtgacttgcctacgctaagtaaccaaagctgagtcccgctggtgaggcgcgctgacagcagtgcccgctgttgttgactggatcgccgatccggaaaaaaaggacgaatttggggaaatggatagatggtactccctctgtcccataatatagcaacctagtaccggatgtgacattttatagtacaatgaagctagacaccctgctgtccagattcgttgtactatgaaatgtcccatctgggacatgactacatagagaccacactctatattgtcttaaccagagactcatcttagacctggttgcatactagtacacctaatgatacatgttttttttcttcttatagattttccttttaaattatttatccgatttataatccaattacaccattgtgttcgttgcaattaaatctttacaacaagatcttacatgattatattttgataaaagaaatatctatgttgtaaattagttttattatatatgtacttttatcatatatataaattacttctcgatttgattaaattacttattatacaatcataatgttgtgagttgtttattttattatcttttttagtcaattccataatttgtgctgattaaatttaatttttagatagactcacgtttttacatctgtaacggatctacttttaatgccatgacaaagttactttctttttgtcttaagttacttctataatatatgtaaattacttttaagctttagtgaaattacttttatatgtctaagaagtaatttagtgaaatctaaaagtattttagatatactataaaagtaatttgtaatttttcatcaaaatataatcatgtgagatcttgttgtaaagatttaattcttacgaacacaaccgtgtaatcggatcataaattggatgagtagtttaaaagaaaattttatttgaaacataggtgataggaatatattttctacttacttgatggagactagtactacaggtaaggcatctagatagggtctctcgttagcacttaaacgagaggcctcttgatttagattttgcccccatccggtactaggttactatattatgggacaaagggagtagttatgggtgggtgggttacaaaactatcgcaactcatgactttgtcgcatgcgttgtgatatgcattgcgctataaatcgtcacggactaacaatattcacttaaacaaaattgttagtcctctctaatcgtattgtcattaatcatagaaaaaattaggggccttgatgcactttcatccacaaaaataaaagagagagaaaaaaagaaattatggatcagatctagagaaagaacaatggaggagctctggatttggatctgaatctgtcgccggtcctcctcctcgtcggcgtcgtccctcatcgccgagcagctgtgcctttggccctccttgcctcaccgagccgctgttgctagctccgctttgccgagccgcctccattggacctcctcgtcagtgccgagcctcgccgagccgccaccaggcggcctccttgccaaaccgcactgaccccgccgacatctttccgccttgccgagccaccgcctctggaacactcctcgccgagccgcaccgaccctgacaccgaccctcctcctcctcctcgccacgctaccgccggccctccctgccgaaccaccgccggacctcctcctcctgtcctagctgccaccgaccccgccgccggctctcctccttgtaggctctgaggagagggagagggagagggggtgagaggagaaggagaggggtctgatggagggatgttcttcaagattaaattcaatactataaagtaatatccgtaggattgctacgtaatggcatattgacatcgtgagaaaaaaacttacctagcatatgcttagctaagttggtacaccaaaatactaaattgtcaagttcttgtactaaaccgcacccacttgtcaagttgttgcactcgaacgttcaattcttaagttcttgcactggctcgcacccaccagccaagttgttgtatcgtgggcaatgttctaaatctctggctatagcggcacgctatagccggagatagcggataggaagggaaatagctaggatacttcacttttaatgctatgatttagcaaccgctaatagtggcatttagctagagatagccgatgaaataggcttgacttaggctaaaatagtcgctaacataggccagaaaaattggaaagctaaattgaaaatgggcttttgacatgcgtggcccacaaaattcagcccaaaatcaaaccctaaatcccccactcgttctctctcctaagtcccctcaactctcatccgctcctctccccaaaagcgacggcagcggctatggccaagagtgacggcggtggtcgcgaccggtaggcggtgaccctcggcggccaggcgtcggagttgaggagtagaggattcccacccttgttgtctctcactccctcaactctcaggctctcctttccccaaagagcggcggcagcggcaatggttgtgtccgggagcggcggcgggcaccgtttgcgaccgacgatagtggcggcgctaacggtttgacctgcagcaacagcggctcctcccctcgagaagtggcggcgagctggcgacattgaactgctgcaccaacggtggctgctgcttcccctggcggcggcagaggcttttccccgacgatggtaggcaccattcccccatttcaccattcctcctctcccccgccctgaggagcattacctagctacatgtctttgccgtagcaacatacagccatacagtcaaggatttagcccaaattctatcaaatttttgaatctttcttaatatctttgaaaaccactaaatgccttagctacagctatagccggctatagctgctcttagctattgtagagctcaaccgctaagaggcttagccggagatttagaacattgaccgtgggtgcaatttactcaaaaagaaaattatatcaccacccgcacactgacaacaccaacacacagatccaggagaaggctagcaccagaccggccaccgctaggccaacaacggaacacaactgagatcatccaaaacccgacccttgcaaccaacacaaagctcaactctatccaagtcttcagcatttaggaagagagggtgagagagaagacaaaacacctctccccctaggccctccgacgcggccaacttgtacaaactaggatgccgccacaagaggatgagaatcaagagcgtgcttgcaccaattgcttggggggtttcggcaaggggatgcttagacgacgtctccaagaagaggagcgacgaaacacctccaccgatgtccgtcaaggtctcaaagagagccgagaccgagctttcgcccgatagccatcgagagggcgagacggcacgacaattccctcaggaggggaatgacgctcgaacgtcatcgttgccggtccaaccaaggctgggctgggttttcacctgccgatctatcacagaagcaccatttctccaccgccatctaaacctccgctggtgtgtgggcaccattgcaccggcgccccccgccggctagtgtccgcgcgcttccaccagttgcgcctcactaggccatcggccaccagcagaggcctctctcttcccgctgcgccggccaccgcctccacgcctgcaagccacatcgcgccgcacttgcaatttggttgcgcctccacgcaccgcggccacctcctccgccaccagccgcgcctcaccggcctctgctgtcgccagtcgctccactatgcgcgagctgcctccagccagccgttgctcctcctcctgccagcgtggcatcagccagattgcttcaccgcctccaccttcgcacggccgtgcgaccacctccatatggtcgagcctctgcctccacacggccgcgccaccgcttccgcctccatacgaccatgctgccaccagcaccacacggccgcaccttgccgccttgtcgcctgggggtcggagctcggacaccctgccgcctccacgtgcttcaccaccgccagcggctcgggacggcacccacgctagatccacaccaggagagcgccggatccggcaccgccgctgccgccttcagtcgtcattggctccgcctcctcaccacgtcactgctgtggttgtcgtcgccttggaactaggtcggggttgtcggctccaagcgtcgcgacctcgggggagaaggccccgcgccgccgtcgtccttgcggccgcgtggtttccatcgggccgcttgggcggcggcgaggaggaaggagggcggcaaggggtggtgtcgcggcggcggctcagtcgcccctgccctaggagcgacgcgaggcccagtgacctcagaattgcacaacatccaatagatatacaatacatatattacaatctatattttaaatgagaggataaatcaaatcaatctatactcttggataatttatgctagctgtatttaccaccagtattttttaccataaaaattctcaacaagaggtaggttttgaccgtggcctccctctcacatactgtacatgcatatttccttatgtaccacggtacagtaaaagaaggcatcttcgaaaattgttaagtagtgctatctatgttcctctatcacgatgacacgtgggctcctctttctcttatcatttcctatttcaaaagaaccttatctattagaagttgtctgattttttttagtaatgatctcatcaatttattggatggttcagagtttcggatcatttcaccagtaaagaaataatcttttataccagttgaaaccctccccttttaatcccggttaattatagcaaccgtgaccagcaaattgagactaaaaatctcgatctttaatcctagttgccaagtaaaaaaaatatgggatatgaaattcgaactcaagatctctcaccttaatcctcatgcgtgttatcatcccacctactctacacatctaactttaatagagatgttttccttctgaactaactttgaggacatctctagtaccagttagtaacaccaaccggtactaaaaaatatatctttagtacggatcggtgttaacaagcggtactaaaatgcatctaaaaagatccactagtattagtcttggttggtgctaccaaccggaagtaaacatgtatttctaataccggttgataacacaaaccaagattaaagatatttttagggacttggtcttttagaactggtactaaagagttttagtaccagttcttaatgcatccgagatatttgtgtgtatggggcattgtataaaaggcgagttatcctgtagtaattttttcatattcgcgcgcactcctatgcctaacaccctcctcccgatgatcaccctccaacctacttattggaacggtggaactatgcaagaaaaaccggccatcacatctcatctcaagacttgagaactaaccagacttgagaattaattaactgttgcatccacacgatcgggcccccgcgtcggcccccgcgttgggcgactcgggcagtggaaccctagccaccgccgccacccatcttcgcccccttcctctgcctcgctgccacctgagtgagcggctggcaaagccggcggctcacgagaacggcggcggcggggctcgcggcaggcacaaaggcggaggccggccagagcggcgctgatgtcgaggccggcgcacgggtggaggtgctgtggacggagagcgcatgggagaaggtggtgcagacagcccgatgcacggtggatgacgggggccagagatggaggcggggattggggcggcggcggtggtgggctttcaccgcatccgtgagcgcgaagcaccggtggaggcaggcgaggagaaggcggccggcggcagggttgcagcagcggtggcggcgaggcagcggcggccgtggtgggcaccgccagatttggacccccttggccagatctggcggctgacggcagggacggcgggcgcacgtgctggcacgcgagcaatgccagcagccggaggtggatgtggggagaggaaactggcgacgggctgggctgcttgtgcagagggcacgtgatggcaacgggaggtcggcatggtgacgtcatcggttgcaaggagcacagcgctggtggcatggaggcgtggatgccttggaggcacggctggtgacggtgacaggccgttgcggtgcatggaggagaggacggcgtggtgacatggccggcgacggcggcggtgcgggtagtgccgagagctttcggtacgagcgacggcagaagtcgtcccgaccgttggtgcggagcgccgacgctgtgactacagggagctggcggcagggaggccggtgaagctggccagtggttggtgccggttcagtgcccatgagctgatggaggtttcgatcgtggcggagcattgcggcgacattggtggatagacaggtggcggacgatgggtgaaaacccagcctggtcttggttgggccagcaacaacatcgctttcgagcgttgcattccctcttgagggtgttgtcgtgacgtcccatcacctctaggggttttgccgggtaaaaactcagtctcggctctcctttgaggcctggacggacaacggcggtggtgtttccatgactcctccctggagacgtcgtctaggcaacccctaaccaaaaccgcccagacaaccagtgcaagcttgctctagatttcagtcctcttgtgtcggcgctctagcttatacaagttgaccacgacagaaggcatagggatagaacggttcgatcttgtcttgcaccctctctccctcaatcacaaaattgtggttagagtgcagttctgtgtttgtttgttagggttaggcttgggcgatcccagttgtagtccctctgttggccagaggcggccggtcacgcttagcggtgactggttcggtgctagcctcctctgaggtccatatgttggagctgtcggtgcgtgagtggtggtctttttctctttttcctggttacgatcttgtaattttttttcctgctctgtcactatgaacttcgtattgtcttgtacgagtcgttaaaaaaaacagaaaaaagagttgagaactaccgccctaccacacagatggtaacgttatatttcaaagagtttctagcagctgccccttttcctataatattcaattttcttaggtagtctagactttcatctagcttttgaaaatgtgtagctataattcagaaaataaattagacaccgaaactgaaaaaaaagtaataatcagttttgggatctaaaagctgactactatggccgtgtttagttctttggccaaaatttttttaagtatatgaagacaaatttgaagtattaaacgtagactaataaccaaacaatttatagattgtgcctataaactatgagactaatttattaagtctaattaatccgtcattagcaaatgtttaaggtagcatcacgttgttaaataatgacgcatttaggctcaaaagattcgtctcgcaatttacatgcaaactgtacaattgtttttttttcgtccacatttaggccaaaaatttttagatctaaacacaccctatagcacaaaatgttgagctcacctaaaagcaaataaaactactacaacgtggcgtgtctcccagctgccggggtagctacagcgcgcggtggaaagacatgctcagcacaatcaaccaatgagcgtacgcccagcacaggtcattcaatgagcgtgatagcgatagccataggtgctcgtgatagccatacgtgccacgacccacgaaccgcgaagcaaacatgtaacatcagtctctggaattctggccaaaatttagtagtactcgtccggtttaatgtttttttatagctgaaataaacgtatatcatgattagattctttatacctcaagtaaatatatctcaagtaaatatatatctggatcatataaaacctttcattcattactagtaatatgtccgtgataacgtcacatctcacctcaagacttgagaactacccaatcaaaaaaaaagactttagaactaccgccctaacacacagatgataacgttatgtttcaaagatcgagtttgtagcagctgctccttttcttataatcctcaattttcataagtagtctagactttcatccttttgaaaatgtatagctataaaattcagaaaataaattagacgcggaagctgaaaaaaagtaataatcagttttgggatatacaaagctgactactatggccaatttttttgaagtatatggacacatattcgaagtattaaacgtagactaataacaaaacaaattacagaatgcgcctgtaaactgcaagatgaatttattaagcctaattaatccatcattaccaaatgtttacggtagcatcacattgtcaaatcatgacgcaattaggctcaaaagattcgtctcgcaatttgcatgcaaactgtacaattggttttttcgtccacatttaacgctccatacatgtgtacaaacatttgataagatatttttgatcaaatatttttggatctaaacacactctatagcacaaaatgttgagctcccctacaatcaaataaaactactgcaatgtggcgtgtctccctgctgccggggtagctgcagcctgcggtggaaagatatgctcagcacaatcagccaatgagtgtgcgcccagcataggtcattcaatgagggcgatagcagcgggatagcgacagccataggtgctcgtgatagccatacgtgccacgacccacaaaccacgaagcaaacatgtaacatcagtcacatctcatctcaagacttgagaactacccagtaaaacaaaaaaaaaagacttgagaactaccgccctaacacacagatggtaacgttatgtttcaaagggtttctagcagctgccccttttcctataatcctcaattttcgtatgtactttagactttcatctagcttttgaaaatgtatagctataaaattcagaaaataaagtagacgaggaagctgaaaaataattaataatcagttttggtatttaaaagctgtctacgatagcaaaaaaaatgttgagctcccctaaaagcaaataaggccctgtttagatgggactatttaagtccctatcacatcggatgtttgaaaattaattataaatattaaacgtaggctattaataaaacccatccataatcttggactaatttgcgagacgaatctaatgagcataattaatccatgattagcctatgtgatgctacagtaaacattctctaattatagattaattaggcttaaaaaatttgtctcgtgaattagtttttatttatgtaattagttttgtaagtagtctatatttaatactctaaattagtgtctaaagacagggactaaagttaagtccctggatctaaacaccacctaaaactgctacaatgtggcgtgtctccctgctgctaggggtagctgcagcgcgcggtggaaatatatgctcagcacagtcaaccaatgagcgtgcgcccagcacaggtcattcaatgagcgcgatagtgatagcactggctgatagcgacagccataggtgctcgtgatagccatacatggcatggccacgaaccacgaaagagacatgaaataacagtctctggaattccggccaaaatttagtagtactcgcccggtttaatggttttttttatagccgaaagaaacgtatcatgactagatttatattgtttatacctcaagtaaatatatatctggatcatataaaacctatctttactagtaatttatccatgataacgctacgacgtcaccatagtttggttaataaattatattattaaattgcatgttattcgagttactttttctcggatcagttcaaatgagtcaggtcatatatcaaatatatttaaagaaaattaaaaaatatcatattatttgaaatgttaacttaatatgtaccatgaataattatatataatcacttcaaatattatttaaggatgatacatatccacgcgtccacacatggcagtaaaaaaatgatttgagctccggagtgaaaataacatgaccggtggggtaatgaccgtcggcacgacttttcattaagaagaataaccatcaaccaaactagtcaagaaaagccacaaacacttagagcaagtttaatagtataacccactactaacttcaaatcatctatagctaattcatacaataattgcttactatactattaatgtctggtccacctgttatacacacattacgtcttggagtccgtgctgtagctggctatagatttgtagcccgttgctctgctctctctttgtttatctctttcaaatatgtttatatgtttatagctcgtttatagccttcttttttacctgatcttgtgttccttatggattggtccttaccccgtgctttgaggccctgcctcgtatgcacataaagttgaaactcaataaagttaaattcaataaggtctgcacacattcaaagttgtttctcaaacaatatcctagtatcccacacagtcgacctgttctgatcggagccgacatgcatggttttaattttttttaatcttccaccgtattattatgaccatttatttaagttatttgataggtttatttataaaatattcaatttatttcattcataagtagatcacggtcgacgtctgaggtcacgactatggtatttgcatggtatgaggatcgtcggtaccagggtatatgcgaggtaaaagagacagacacaagccggtgttgctctttattcatatgaatcacacaagtacaataattgggataacctatctagctctcgccgacttagcggtatacataaccaacatgtagtcgacaacagggcagtcttaact

SEQ ID NO: 25418 - DNA, 3186 bp, Oryza sativa
ggatgggaagggaggagggggaggagaggaggaaggggaggagttggaggagaggggatgaggaagagagttagagaggatagatttgaggagagggggagagatttgatctgggtaagttgtaattgtggaggagaggataagtgatagggattatatactatgtgttcaattttagtctcgggactaaagattatattgatctttagtcccggttggtaataccaatcatgactaaagcggtaatctttagtcccggttattgaccccaatcgggactaaagatccttgcccccctgacatacatctgataggggttagtcaaccgggactaaagatcaaaatttttataaccgggactaaaaacaatctttagtcccggttctttttggaaccgggactatcgtggattttgccagaccgaccaaagatggtttctccaccagtgcttcttcctcgaatatgagctcatcaagatcagagatagcgctagatccctcttgtcagcctccgcaggcaccacacggggtctgtcaagacttatccctgatgttgatgtctggcgacgtgtgttggcttgtgtattgtgtgtcaatctgttgttgtgtcctctttcccccctagggtgtcttgtaagttacacgcgacttatccgatccggttacacggagtggagatcgtgcaggcgtccggatcaagcatcatgatatctatatataagttgagccgccgcctctacgcaacatacgtgaaatcaatctagggtttgccacctcctctatactgcgccgtcgctcgtagtctactccatcccactcgtcgatgtgcaccggcgatcgggtgagcagatctccagaaccttcgtcttcgacgtcctgcaccgggagaaggcggcaataaggattttgggaagcgcttcgcgcgattgccccctatttgaccacaacagctcatcttcctcctcgctcgcgtgctacgtgccatcgtcaacgcccgcaaccgcgagtacttcctgctgagcaaccggtctttcggtaccaacgctacgtattcagcatattgtgcatatttgatctgttcatgctttactgtctagtatacatgtgtagatcttacgatgtgtttacactagtttacatttgcaatatcatgatttatttatggaataaattaaatcattatgtgcttttaaattcaacaattcatagggattgtactaattccaacaaaattatgtataattcctgcattctaatgagatcttaccttagctagctttgtaccttagttcaaaattaattgtgctaatttacctccttctctccttccaagttataactattttttctttttgccttggcctgtctcaattcagctccggagaactagcatatggctgtaggttatcaatagttcagctctggacgtctctcctatgcataaaactaggtgattccccgcactttgctacgggaattactaagcaactttcaatacttgagggtttttcagtacttatcataatacttgaggttttttcaatacttatcataaaacaaacaaatgatacgcgtgatttaatgtagaacatattgataagtatgtgctgcgcccactccctctctctcctgcccacgcccgcgttcgagatggccgggattcaatttttgaatcccgcctctctctccacctccacctccccacgtcggccgccgaaatcgggccactcttggccacgtcgaaaccccttttcccctatttaagcaccaccgccactacctctctctttttccccatttcaccgagctcccctgtgccctctttcgctctagcagcgtgcacccaccgccgccgccacttttccgctctccggccgccgctagccatcgcaagccgccacgccaaacctcgccgtcgacaccaccgcattcgccatcgcgtgaagcaccctggccatcgcccgatcgtcgccgtccgtcgccggaaccccgtccgtcccatgcgccggtgagttcggccatggccacccccttcggccggcgttcctaccctcgatgatctctctctccctctctaacttcccccattttgttccttaggtcctctcgaagcccgtccgactctcgccgtctgcaaccgccgtccgtcgcgccgttcgccgtcggtgaggaactcccctcccatccctttctctctcccatactgccaccgccgttattgccgcaccgcctcgcttcggggccgtgccgccgtgcgccgccgcgctaccgccgttcgccgcatcgccgccgccgtctgccggtcgccactttcaactactgtttataaatgctccctttatgcaaatgtaccgctctagctatcctttggttatatcctgcatcataccccctattacggtatgacttgctgagtacggtggttatacttagtcttgctctacttttccccaaccccagagtttgagtatgcgtcagatggtggctattccgaggagtaggcatcgtccgtgccgtcgaggatgcctgtggagtggtgttcccactgcaatccaagtcaaggcttagctccagttatcttttatttttccactgcatttatgtaagacttttataatgtttttaagacgtggatctgtatgtcaactttgtcttttgtgtaccctagccagtcctggacaggggttttaatgcacattctgcttgaaattctattcgggaatttctgggcgtgacagatctccagaaagaaatttctgggttcgagaaaaataggttttgggaagacatttctggtgctccaatttgcaagaaatctaggatgaatgatgtccataatcctatacttaggctaatgcacaaatggattgctatgactttgtttcctagaggtgatctgagacccattaggggagatgaattaattatcatgtttgccatggttagaaagatcaaaattgctcctgtgaaatgtatgataaggcaatggttagaaagtataaagttctctgctcctgttgagtgcacttctctgattactcggatagcaaaagggctaggggtcgttagcaaccaaattgcttttatctcagccgctcgtccacgtattgatgaggcttatctagtgcaagggcatattctgaaacatggagtagatggatctttgatatacttttttcccggttgt

SEQ ID NO: 25419 - DNA, 515 bp, Oryza sativa
aggtcatgagttggataattcccttcgtgtggacgcaactgccgcgaggcatatgcaaccactctgccctcttgcattaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcatgggtcgggcgatcctggagaagttttcgatgaatcggcggtaataacctgcaagtccaagaaaacttcgaatctgcgacacggtcttcggtggggtccatttggtaactgactctacgttcgatggatcaactgccacaccctgagctgtaatgacatggcccagaaatttgacttccgtcaaccagaagtcacacttgctgaacttggcgtatagctggtgctccttcaacttctcgagaaccagacggagctgttgctcatg

SEQ ID NO: 25420 - DNA, 604 bp, Oryza sativa
  unsure (1)..(604): unsure at all n locations
acgcaccgacagctccaacatatggacctcagaggaggctagcaccgaaccagtcaccgctaagcgtgaccggccgcctctggccaacagagggactacaactgggatcgcccaagcctaaccctaacaaacaaacacagaactgcactctaaccacaattttgtgattgagggagagagggtgcaagannnnnnnnnnnnnnnnnnnnnctatgccttctgtcgtggtcaacttgtataagctagagcgccgacacaagaggactgaaatctagagcaagcttgcactggttgtctgggcggttttggttaggggttgcctagacgacgtctccagggaggagtcatggaaacaccaccgccgttgtccgtccaggcctcaaaggagagccgagactgagtttttacccggcaaaacccctagaggtgatgggacgtcacgacaacaccctcaagagggaatgcaacgctcgaaagcgatgttgttgctggcccaaccaaaaacaggctgggttttcacccatcgtccgccacctgtctatccaccaatgtcgccgcaatgctccgccacgatcgaaacctccatcagctcatgggcactgaa

SEQ ID NO: 25421 - DNA, 4522 bp, Oryza sativa
ctgtgtattcataaccttgtacaccttatgtttggaaaggaaaacttttcaacttctgttaggaaaatgtcagtttttcatatgacttacgttagtacatatgtaactgaaacaatgccattttcagtgtatatggctcgttatttttatacctctcaaaccataaatgtaaatgagttgattcttgttcctaaaattaggttatcatactctctacctactgtaattaggccatgatatatagagcatgttgcatatgcatatttatttgaatcttatttgcatatttgcctcttattggtagattcggagaatttgaaatacgtggagcaagactcacaggttgagtgtgtttccgcacagcaacacagcaagcgtctatggatattgaacctatgatttcacaaaacttatttgcttgcaaaaactatatatatgcataagtcgaattgccttaaaatgtccgtcacgggtatagttgtttatatccaagttcatgcattttccttcctttaatatattgttgccatgtaaccttgtcaccttcaattgtaaatgggggggatggtttattctatcatcgaatgcttagccatgcttaggtctactgttgttagaaatcgatggatggagccatcggatgaacttattcaccacccgcgatttatgggcattaaaatctgattacctcactcaatgattaatatggaaacatgctttagcttggacgtgtgataaggcgatgacgggatggtcattttccctgatgcaagtagccttgtctgggttgttaaggaccgaacatgttgacgtctattcaagcaccatacgtacttccacacaccttatttgggaccggcttgtcttagtactatgttgcactgtgctcatctacgtcttgctggtcattcgtgagggtggttttccctttggattgccccgggtgtgcctgattttggcagggggtttctcccgcgatggtgagctggccacatcacacgcacgtggctaagtcgacgggggcctaggcgtggtttaggtggttggggtgtcactaggaaaggacatgttatgagcttgtatcacttgtaggtcacacctgtgtgcgtgtgaagcatttgatccttgttcatttcgtgtgggtaaagttgtacacctctgatcagagtaaaactattcgaatagccgtgtccacggttataggacgatcgcttgatgtgttagtcagtctatgttagcatcaaacttgggttaaatggctggtttagtcatggatatggtgatagttatgtttggaatccatggttgggcaacggtagcccatggatggtgatgagagcaccggttgtgctcatttgtgattcaatttcagatttacttgcttgctgtcctaaatttcggattatgctattttgtacaaatgttatatttgcaacttactacttgctcaacaaaattagctctatgcaaaatctgaaccacttagccatttcctttgatgtagaaatttgcatactcctttgtactatcatatatggtgtaagtcttgcggagtacctttcgtactcatgttgctattttcaggtgaggatgccggcgttgatgttgtgccctactactatcccaccaagggtggcgagggtagcgagtagttgaagttcgctcttgccccgattggttgcccttgtggggttgttggcacaccacaggtttttcttttgcttatgagaaattatgaaacttccgctgctatattttgtgttgtatgatgggcttgtgaaccccgttatgaaatatgtaccttgctgtccttgtatctagatttatgcatttgtgatgtttatcaattgcttgcgatgaaagtgcgaggctagtcagttttctggggactagctgagcatgagtatgaattttgagcaattgagatgttgtagagctttagcattttgagtcaagtctcctgagatgtgtaacacttttggtcgctgccttcgtgtggtttgacgggcatgtctcaggctgcagttgactggcatgctgagtccgaacaatatctcctttgctcatgattcggcattgcggattttatatcgaatggtgttaaattgtgatcatgagcacattgaggtatgagtggctatttatacgtgtatggatcccactcatccaaaattatgtggtggtcacgaattgcactggacgatataatgttcgagtgcccacatgcgggatcattgttcgctatagcccattaatttatagtgattactttactgtttagctagcgctaaagtagttattaattgcatagacgtagagtctgggtaattaatttccggtgattgcttcgtatcccaccgtaggtttgaggtaggcgtaaaggtggtgacagcccttaaatacactaaagtcctccctgtctgggtatgcagtagagcaacatctttgagcagcgggctggccagtgcctaaagtatcacgttaggattaaattgagctttccgtagacatggtttctcactaggaaatcctctttaccctttgcctacatttgcttcatgtccttgggtgaacctgaagaggagctgaacacacacgttccctgaggaaatcgataccttggaatacttgagggtgaactgctacatcggtatcttccgtgcgcttgcggattttatttgtgacgttaagaaataccaacaatagcaccaattataaaatgagtaattaattatatggatgacacagcgtcacatcccttcatctgttgtagggacttgtgaaccacatcgatggtggatagttaataatttcaacttacaactaatcacaactgattatacgaaatatatagttaatgtcacacccggagttttcccttttttgtagtttctaaatcattgctaaatcgtctatagaaaatacgttgttaaccaagagaaaaccctaaataacaaagtgtttaataattggaattatcagggagattttttttttgaattctcattgctataaatcattaacgggatgtatagtggaatattcagagtaagggaaataacaaaagttaatttaaaatgtcaggagttgaagtaataataattttcttgcccgcctttggccatgaaccgtgcctggttcacttatccgttagtctgcggttccattttgtataacgagccgagtcagaatccgcttctagttccgtgtctcgttcttttcctaaaacggcaccgcatcaatttttcttttcctttccctttttggtcgccattttcggttttcccctccacccccttcctgccgcgcgccgtgccctcccaccatcgccatcgtcgccgttgcgtaccggtaatccgcactccctctccgtgctatggccgccgctattctccatctatgtatattctaatctactccatcctaggtttcgtttagcgtcgtcgtcgtcatcctcgcagggttaccgtccccgctgttccaaacccttgccgttgccgttgttttcctcggtgagaaatcttttccaacccttctttatttagatggtgtcttgatcgtttagcgttaaccctaaccgcatgaccgagtgtttgtcgcgttgttgtgtcaccgcggtaaaccctagcaccgctgccggccaaggcgccgccgctgctgtgtgtcgtgccgtgtaccgccgcccgctgccgccgcgccgctgccgctactgccactgcagccgagccgccctgctgcgccaccgccgtgcgccgttgctgctgccctagccgcgcagccgctgccgccgctgccgggtgccgtagctgagcatcgccgccgctgtcccgtgtcgccatcgctgttcagctgctgcccatagctcggtagttgagttgcttagccgctttagtacatgcgagtctctaccggcctattgtttgccataccgggtcattgccgcaaaccatgcttagttgccgactttgctgcagccgttcgctaagttgctttaggatcattcgcacgtagtattgccaaagctttagtccgttcggtcgttctgagtcgttctttagtttagagtcgttctgagctgccggttccgttcgccggtttggttgacggtcccgtgtcacgatgtgttggctggttgagtcactaatttgtgaggcttgcttactggtgatatatttccattgatctatttctctatgggcattaatatgtaataattgattaaggtttttcggttgttagtaattacacagctcatattgtaaaattcatatctaaataatctgagctccgttttaacccattcaagttgcagtgaattcattaaaatgtatagaatccattaaaattgatttcttttactatttcagtagccttattgcttgtatttcttgtataatttgtttgtcgtatagattccggtagttccggtgatccagcttattttgaagtggttgctgaggttccatctgttcaagagcaaggcaagtcatacatacaacattgaacatgttgaacctatttt

SEQ ID NO: 25422 - DNA, 10088 bp, Oryza sativa
gtaaaagtcgaatttgaacttgcatgtttgtgaagtgatatattacatattaacctatcttgtgattttttttggaattttttcataattatttaagtggcatgcaagaaacgggtgtacgttcacccgagagattagaatccatcctctagagtccacagcatcttcctcctcctctgtctctcttttctgccttccagatccagtgcaaggttgaaagtgactgattaaatcttagcaatccttttttctggtgacggcgacgacagaagaacatgcagagcggccaacaccaccggacaaccgcactactgttggaactaaatgggcaaggcggctagctcgacgcaacacactggaatctgccgccaaaaggtagggacgaggccggcctccgtatgatgagattcttccaggatccttccttttcccccgccattcttgccattaacggagggagggagaagtagactggattagatatattatcgagaggccaacaaggttggagacgaggtactctctctaatctctctttctccttcgctttaatcgtctggatcgatcgtgggttggtcatgccacgtcaaaatcgcaggagactctctgatgctgacaagtgacaaccatgagatggcagcgaaaatgcagttcatggccgccatcagagttgaccggccagccgcttgagatctcggctcgaattgaatagcacgttcttaatttgttggctgccccctgcagtgacccctaactgacgccactaacctgaatttcgtgatccgcgtgatgaattgcgggcgaaagattggttgacggtaaaagaaaacgaaagagatatgtagagaagagatttaattggtgcagggtgcagcaatctggccagctgcttccaagtaatcctcctgtcgtgcttgtgtgtatggtcggattcatggacggggcctgcagagccaactaactgaagatgatgatacagattcctgattccacttcactagaaaattcgcaatcctagcgtctccttttctgtccttaattcgtacgttacgtacgtctctagctggctccccagtgatctttattgttggtaatgcaacttcacatggatagccacttgaattgtttacaatatattgggaacaatggtttaggtttattagataacggatacaaaaactccttactaatagtagtgcatgtccgttactacttactaggccaggccggcctcagcatgaataatctcaactcaaacggacctaaacgacttttttcgatttcgtgtgaaagacgcacgtgcaccagggtttgcaatttcggttgccgccaaaatttctgaaatttcagtggttgctgaaaatttgaaaatttcctgatttctaggtttttctgactgaattgtttgaatttataacatattttgactaaatttgaacaagttttgaccaaatttacaaatatttgacaaacaaacgaaaatctcggggagatttgtgcttgccggtgagggccgaaattaccgaaaatttcaaaccatggcgtgcacacatcacactcacacacccatatgagtcccctaacacatacttaaggagataacccacgaagatattgcgacctatagtattgagtatatatagtaatttggaagtcatatatgctttactttgttcgaaattgcaacatgttctatatatttaagcactgttcacaagattttgtttaatttcctgctgattaattatttctttgactttccttctctgttttcctatttcatctgcaattctgcacttgacagttgtacacagcataaatactagtatactagagtagtgggatgtctgagactgtgagccatccttttggaccaaggctgagagcctcccgtactgcattgcatatgttcttttggctagttgtagtaataatgaagccccatattaaataagtcaaacgaaataagttgaaacctttttgcaaaaaagggaaatgaaattgaaaccattatacacacacaaggttcttgtaaaggaagaaacatgcattaattattgaattttctgatggcatgaaaaattaggatgatatttcctaaatgaatggatttaccttactgccgagggctgggttataccgcacccctgtggtaagcatggttaatacgcgctaacaactttttatattgataaacttttagaatagttcaaattattttaaaatttatttaaatttgatatggttattgcacggttaccattaccgtaccaagacggtaagcctggttaccacatattaatattatcaaccctgtttggtggtattttttttcctaaagatgaagatgaagattaagttttttacgcaaaacgaggtggtattaacgtatgatagattgagttttaattattacaaacttgaaaaatagattaatatgatattttagagcaaacttttatatagaaagttttcgcatgaaatgcaccgtttagcagtttgaaaagagttccacgaaaatcttaatcttcatccaactcttgttggagaaaagaatgggatcttaatttctagaagaatatataattttgagcaccacagaagaagaatttgccataagaaagtgcatttctcatttaattatgtaattacaaacacatctcttcacttggaaatacaccattctacctccttttggttaacattaacacggaccagaaacaatcaaaattagtagcatcggttggaattaatacaggcagtatacaagcaacaatagcataaacaacactctatgcaacctgtctcaaattcctcttttcactttttttttcaccacacgtgtgacaataataactaaatagtaattagttaattaattttggttgattaattgattaattaggatacaatcatctgtacttcatctcgaccacgcgtaataacgtacggtatgtgcatgcacgcgaggtgctcgatgaattagtaggtggtggcgaacggcttgtagaccttgaggtcggagaggattccggcgatggagccggcggcggaggcgacggtgatggcgaggcaggcgaggctgagcagctgcaggcacacccaccgcgtgctccacctcggtatcctcttctgcacgatgtacatctccaccgggaagtagacggtgagcggccagaaccccaccgcgccgaggaaccccaccacgtcgttgaagaacggcagcagcatcgacaccaccgtcgtcgccaccacgaacgccgacctccatgtcagcctgaacaggttcagcttgtagcaccttccgccgccgccgccgccgccggagagggagagcggcacgtcgatatccttggtgatgtaccatgatttcggccaccgctgctgcgcccacttctcgacgaaggcgaacagcggctggcagtagacctggtaggcgccgacgaggtggacgacgatggcggcgttggcaacgtcgaggagccagaagggctcgtagaagccgaacccggtgaggaggttgcccggcgcggcgtcgccgaacgccgcgtaccccgtgcagccgcagagcatgtagaagagcgtggtgacggcgacgctcaccacggtggcgcgccgcatcaccctcgactccgacggcggcggcgcccggatggtgtcctggatctcgatgaggatgagggagtaggagtaggcgaaggcgatgtcgccgaacgcctgcaggctccgccacaccttgtccatgggcgtcaccacgccgatgctgatcccggtgaggctccccttgacgccgccgttggccaccacctgcacgacgccgaggccgagcccgatggtggagtaggtgaacgacatgacggcggcgaggatggacagccacgagatctggtcgaagtccgggatctgcgagaagaagatctccgccacgccgaagatgatcatgtacggcgtgctcgagatgttgcacgggtcgccgtgcccctcgacgtggaagcagttcgcccgcttgatcgccctgttcatgccatgccaaccacacgcgacatgagctcaccacgaatcaccatcaatggagagttcgtgcggatcgatactcacagcatgctaatggaggcggcaatggtgtagccgatggcgacgccgacgatgttggcgtactgcaggaacccgcagacctggaccttgatgccacctgttcgaagaaatgccagcacagtgagcacgacgacatgggcgcgtacgaggccgtctctgacaatgatacgtactcaggttggcgttcacggcgtccatgtaggtgtagttgcgcttgccggtgctctcgtcgccggagcggtagcagtcggcgagcagcgcggaggtgtagtaggtgacgaacgagaagagcagcatgacggcggggccggccacccaacccagctgcgcgatcgcccaccccagcgacagcacgccggagccgatcaccgccgtgatgatgtgcgcgctcgccgtccacatcgtccctagacaacacatcaatgtcagcaacgacagccatggtccatggatgaagcttggctcgaggcgcgagctccgatccttaccggtgcgcttgaggcggccgtcgtcgtcgtacagcttggagccggccgtgtggccgagctcggcggcgaccacctccatggccgccgccgggtagcacagcttgctcgccaccacaccgttctcccccatctctgcactttccacaaacacctgatgagcagagagtgatcgatcgagtggcgccaagactttgcgttcaaagtcgtacgtgtttgttggtgggagagactgtgcgtgcgagtgagagatgcagagtggacgcggcaatttatagccgcgacgccgttgcgctcgctcacgcggccaagggttcgggtttgggggataattgtagaaggcaattcaaagggaatattaattatttgtgcagtggccctatggttttctagctagcatttgtcccttgctatctttaagaagaaatcgatgtaaagggttaataatgtgagggacttgaggggctgagtttgttgacgtatatgcctctggcatgtgtgcggaatatatgaccacttgtatgttcccgctttcgtataatatagacgtgtaagagcatgatagtacttgaatatggtggtagttctgacatgttttggcataaaacctagttgtgtgactagcacacacctctaacaaccttttttttttcttaaaataagttttaaattcaaagcacatccaagtatatctgaactaaatgtatttactcacaaaaggtaatgcaaccatgtgtatagttagtggttgtttgatgtcgtaatgactacaaacccttaggacggctcactagtagtggtagttagactcatctattgttgcaaggtcatatgtgaaaaaaatatataatttattataagctacttttatttattgaggggctagcatctatagcagttatccaaccataacctcttaaaacaaccactgtgtttttgacgtacatgttgcagttgtccataattaatgctataatatatgagatttttcgagtatagtcaatccaatataagtacctatatatggtccatgctgtacaaacatatttccaaaagcttttttaagactatttccgaaatcaagcaccaactaaggttttctcaagagagttgagtgtggaccacacacaaaacacaaacttcatggcgcaaaaacaaaacgtggtggaatataatagttgggcccaaagtaaatcgatcgcctccttccagggcccaaaggcacatgtctgcaacttattgctcctgacttagatctctattaagctagctagccggtacttgcatgcagtatacattggactcacggtggtcaatgactcaatgatgttatcagcgagcttacctacctatatttcacctgcatatgcccccacacatgatcatcaaatatcacggtgttacaatgcccactacatcaagacaggtaacttataggaatatatgcacttatcatagctagcaaagaaaagattgcagcagtacagtagtacacatatgttgctagcacactgtacagctagcttaattttgatcatgcatatatatgcatccatgcatatttacctttgcaaaagtctcctcttcttgatcccctaaccctcttccaattgaggaagagagaagtgaagatcaaagagagagaagaagcagggttacaaatagagatatagttggggttgaacttggtgtggtgtgtcatctatgtgcacaatggatgggtttttatagggagagggtggtgtactacatgcattataattagttgtacgacataatggtagtacttaattagtataccaattactgagagaactagctagggaggtccttgcatcctaaggtgtttttgtgccccatggttctcgaccaccctttagttttagagggaatatgttcggtgttccccatctctggcatgaaatttaataagttcagtgcccactagggatagagatcatatcaatgatcttgttctcttggctggatcattccccttgtatcaaaggaaaagggaagactttgtggagatggttttgcacattctggttatgtcaaaatggcccttaacggcaagtaaagaggttatttatgtgatagttttataagtgctgggagagacctaatataattgagcccaagtgtgtattatttaggccatccattttgcatcctagctgcatgttagtgaagggctcggttaattgagcccaatgcaaactcttcatgattgtgcatccccttccctttcatttttttctttagaaaaaaacatgactttgtaatataattttaatatcaaatagatagcttcaaaataatatatgatccgtatcatgcataagatcaacttactgtactgcaattgtttactcatgttcatagatacagaacatatatattgtcatgcatgactcgtgaatatgtagctttgcttcattcagatttttcttttgtcgtggagaaactgaaatgctactgatcccagaacaaatatataagttttccaaagccaaaatattcaagtattaatttggagtagtatatataatgcacgaattcattcaattctgaagttgattactagagagtaatgatcaatgcatctttgataactaattccggtggattatctatttcatgagatgaattaattagcctatgaaagcacagcaaaatagtaacttaacaacaattagtttgatactcacaaaaaaagcgatgacacaaaagcgttgccaaattaatgccttgcatggttcctcctttcgtaactagaatgccgacatcagcatagctaacgcacacctcaaatcataagctacttcactacactactactaaatatgttactaaaataacaaataatctagttcccctttatcgccttttgaaattcgaatatcaccctacttttgcttggctgagagattccactcgattcatatgatgaaaccctgttaatttgaccagcctaattaaacacattatgatcaggagagagaagaaaagcagtggcaagaacgcaacattccttctcgatatgagaatcttttgcagggattaagttgaacacaatattttttttttgtgtgtgtgtgcagctgcgggccgtgggatcacctagatacaattatcaaattaataacagccgagctagttgcacatatataagttacacacagtgatgatagatcactgagctagagctagtgtttagtatcactttatctcgagcacttaacggaaaggagaattaaatcaagagtaccctgcacacgtggatcaacgggtaacgctcgatgttgtcggcttaatttaattagatcctacgagccgccagctgctgctgtttaattcacttaattagaaatcaattaactagctggggtagtacaccgaagattctgaacttctgaccatttggaatatcaaagtcagctgtggtggctggctacgcatgcattcatagggcgacatgttatatgctacgagcagtaataaacttggaaagctgacgaggatatgtggatttttatttgtaaaaaggtcatcacaggggcccccatgcacgaggcacacaatgtacagccacctgggaaagctttggcaacagcaaccagagagagtatgatagctccggtagctgttcgtctgttcgatcccttacctaaattccccattacagcagacgagatgcactgatgcaggcccggttcagacaatcagaaattcagaatagtagctgttactatatgttataaaagtttgtgtgtgtgtagcggcacgacgactaaccttctcgatcgcttcagacatttatcatccaagacacgccagatgacgacacaggaatacacgatatttgttaacgagattcaatcaaaacctacatccccgaggctctgattataggcactcctccctaacaaatatagctcctagcagctacgagttcatggcctcgccgccatcatctccctatgtgtctacgctacattgtagtcgttatgcatggttatattatagttacagagcacctcctaccacctattataactctaagtctaactataattaaataggactagtatattcgacatgtattaatctaacactacgcatcagtagtggtaggagtacctttttgagagcgtgtggagggggaggagtcggccgcgcgcggggttccttatcaagcgtttgtggattctctgggatgagaatccgagaggattttgctgctatcagtgcgtgcgatcgatctgccactgcatgcagtgctgcactgcagcagctcatcttgccggcttttccagccacatcccccctgccgatcgatcagctccgctcctgctcagcctcgccgcgcacagtgtttctcgtacgtacgcgctcgctctcgccgtttgagagatcgcagaggccaaagcgtcggcatcatcgatcgcttccgctggccacgcgctcgctgcgcggctgcggcgggagtgcaccggacgatcgatcgtcgatcgatctgtgtacgtatatatcgggccctatttacgggatctgcactgtatcagcaaaattaggtatgtctggccggcctgatcacatcgtacggttcctttggtaggagaaaagggctgggctccatcatccgctagctggtggtctggtggatgtatggatcgatcaaccgtgcgtggtccacgacaccacgacgggaagtcaacaaaacgtaacgtagtcgagtggcgggcgctggcgcgcagtcaaagccgatgtccgatgaccgagcgcgacaaagcagcgggagcccggaggcgcttttctgtgtggaaaaagaacaccgaaggtccctcgacttacacaaaaccgttcacttaagtccttcagtggttttagccccggttttgtccgatgtggcggctgaatcagcgtaggatccacgtgggccccacatgtcagggtgtacagtcagcacctccctctttccccttctctccctgcctcctctctctctctctcacttttctctcgtagatcggtcgacaggtggggaggagaccgatgggggcatggggtgtggcgggagaggatttctggcgaccggcgacgccgcggcggcaggggtggtggtggcagcgaggcggagctgagcaggggagtagctctgctctcttctttcttttcttctctctgccatagtgaagtagcaacgggtagcagcgagcggggctgagcggcggccggcggaggcatcgtgcgagggcgcggcggctagcggagccgagcggcagagggcggaggcggcgtgcgagcgcgcggtggccgacagagcagagcggagaagaggagggaggcaccacgactgtacctccgggagccccgccatggcctcccgcagcgccacgctcctcctcttcttcctcgtgccctcatcttcttcctcgagccctcgtttccccttcaagggaatggcgtaggagtggacggcggcggcggggggggggggggggg

SEQ ID NO: 25423 - DNA, 41153 bp, Oryza sativa
  unsure (1)..(41153): unsure at all n locations
agccctcctcatcgcgccaccgtcgtcaggaaacgacggcctgcccctaatccactctgctcttctaatcggtcccaaacctgcgcccgcgacgcgtcgtacaccgccaccgccacccagagtcgtgtgccttggcgtccttgccgccgccgcccgggcctctccgacggcccgaccccgaggtcgcacgcgcggtgagccggtgacgctctcccttctcccgcatcgtcgccgccgccgctgtcgcatcgccggcccgccggatgtcctctcccacctcaccccgacgacctccccacccgcggggcatcctgcagaggggagaaaagtgagagagagagagagagagatgagaggaagggggagaagggtgaaagagagaggtgctgacggtacaccatgacatgtgggcccacgtgggttccacgctgactcagccaccacatcggacaaaatcggggtcaaaaccaccgaaggacctaaagtgaacgattttgtaagttgagggatgttctgtatctggttttgcggtttgaggttgattttgtaattcgatgacaagttgagggaccttcggtgtactttttcctttctgtgtagcactagcaccgcaaccacaacggcccaagacaaacctgtccgtgtaccacttctctgacggcccacgtacttactccaacctagatagaagtaaactacctaccggtggaagcaaaaggaaaaaaattcactttagatcacttttgtcgccgagtctcaaattcgtcactgaaccgaaataccagatatagcccatctcccaacttataataccatgttaactttagtctcttagcactataatgcccggttttagtttacgtggtgagtaggacccatgtgagccccacttgtcattggccgtgtgtgaattgagagatttgaatcagcaaaaatagcacatatgcctatctccacacgcacctaagtccttgcttcaccatgcctagcgtgccctagcatatcccctctgtcgtgcctccctcgacgagctctagatctgggttgccgccctcgagtactggccgccacccaacttgccagtgctagctccaaccggctatgccggccgctacccgtggtcgttgtgggtatccagatatacaccactctccttatctacatcgatgctccgcctgcctcatcgtcgaccaggggataggcccctcctcgtgccgcccatggtgcggccaccgccctcgctgactctgcccgttgaggcccctcctccaccctctgctctagacaaccgtcatcgaccgggccttgctcctactccctcctgtgcccgcaaccgccgcccttgggggccccagcgctgccaatgtgttgccacccttcgactgcttcccaggcgtcgtgctcctctgctggtagccttgtgttggtctttgctctctatgctccgtcctttctcttccctatgaacttgtgtatggttaccaagggtggaaggagagaaaataggtgccgatcagatttgagtaagttgttgtggggtgcagaggatgtgctatttttgctgctcggcctcgatgttcttcatcgtaaagaccccttggccgtcatgtgtggaccaactcgacgtgcgtgcgcacatcgacagctcgtccatcttcttactcttggcgtcgcggcgccacagacaacgacaattgctccaccatagcaaacgagaagcagcaggacgtgacggtactgcactccactgcctctctccggccacctccttgcagacatcactccagcacgtacatgggtcccactataattttattatttttaaccaatcactcactggtatataggtcccacagttttatctaactttgtcaatgcctcgtagctgccacattagctgaaactgttgttcaaaccatcttgggaccttatttgcactggttttgggagttgatgaacgcatcatatctggtattgcggttcagggacaaattttagaccccgacgacaaaccgagggacctcaagtgaacttactcggaagcaaaataggccactacgcgaccaatatgggccaaatcacagggaaatctgttgacgaaaaacacgaggcttgggagatctgcttaactccagtgcaggtccaaagctcgcctttgggtgtgttagcgtgccagttgatttgatcctgcaatcaacaagaaatagaaacaaagaaaccatggttaaatctataaatgatagccgatcggctaagtgccgatgacatatcatttatctttgagccgatgacatatcatttatctttgagccgatgtcatatgtgaatcgatcatcggttataaatagataataaggaactaaatctactcgatcggctgtagatattacgaatatatagttcttatatcgatatatacttaaatcaagtaattgggatagatcggtcgccatgacgagacagtataaatcacttagattgaaatatatattaataacggaactatatatgtttatatcatagccgatcaaatagatctagcgtgtatcggctaatactccgatactactctatatcaagatattaaaacaggtacaatgtattaaacaaaagtttaatatatttagattgcgacgatatcttgacacaaagggcagatttaacatgtcaatgaagtatatgaggcaaatatagttaaatcaaataagatcggctgaaactccgatgctaccctaatcggcaaccagaaggcaggctagagattgatattctaatcatgatttaatagatcaaactcaactgatgcagcattaagtatggaaagaagaacaatatctagacaatcaagccgctggaagtttcataaagtggtagatatcttacataatctaaatcaacgtcaaaatctaatctaatcggttgccctctactagcagatgttagccaattatagattagatagcgatattgccaaagattatgtgagatatatgataactcgacgaattacataaacaagattagagtatcataaatatggaagcactaatcccgagaacgcaagccgtcataacaagttttacctcttgttgaagatcgaaaccgatgcagctcagcccaaaagcaagaactcgtcaaaataaaactaaagcaaaagggtggcgatgcgccgaaattgtattgaacgtgtgtgtgtttaattacatagggctcggggtctatttatacccgagaattacaagatatgtccataccggacacgaccattatctctaagaaactctaagataccataagtctttgcggcagacttttgcccaaacatatctctaaggaaattatataaaatatcctaattaatagatacaattgtcttcttaggactctatccatgtgcggcaattatcttgaagcacctcaactcaacctgatgtcatacaccaagttgtactgtcggaatcggctccatcagcttacttagtccgactcagacctaaccgatcctaatcgtagccgatctggactccagccgattcttgctctgttatcggatcgatctccgcctccgactccacttcgatctaatctccttttccgatgccgatgttaccaaatttggttgttaacaaaattctagaggaaaaagtacaccgaaggtccctcaatttgtcatcgagttacaaaatcgtcccccaaccacaaaaccggatacaacgcatcccccaacttataaaaccagtgcaaactaagtcccttagtagttttgaccccgcggttttgactccggttttatcccacgtggcggctgagtccccacatgtcagggtgtccccgtcagcggctgctctctttcctctcttctctctctgttttctctcctcccttccttcctgtcgctctgtgctctccaacaagaggcggtgcgcgcgaccgcagggtggtgcagccggcgacgacggctcccgggtggcggcgcgcgggctcaaggcgacgcgagctcgccgccctccccgtccccctcgtgcgatcggcgatggcggcgcggctgcggccatcatcaccgggagtccgtcggagatggcgcgcggctgcggccggcgggggaggcgggagtccggcagcgaggcggcgacggcgacgacgcgacgacgaggaccctctcgcgccccctacccctccctccacctcctcctcccaaaaatccccatccggccatccccttcacaaccccaacccgacagcttcatatgctccatggtgcccggcaggccggcacccccacggactagacgcagtacagccgtggcggcctcctcttcaagctcagcgacagcaacatgcagtacgtcacctccagctccttcctgctgctcacctacgccaagtacctcgccttctccaagacgactgtctcctgcggcggcgccgcggtcacgcccacgcgcctccgcgccatcgcgcgtcggcaggtggactacctgctggggagcaacccgatgggatgttcgtcggcgctgccatcggagggcccaacatgcaggactagttccccgaccagtgcagtgaccacgagcactccgagccagccacctacatcaactcgccgctcgtcggagcgcttgcctacctcgcccactcctacggccagctcttctccggcctccccgccatcgcctacggcgtcctcaagcgcgccaacgacgttgtcgacgacctcctctcccagatcgacgccgccaaccgcgaccgcaacagggcgcaggagcagatggagcaccgcgccagcgccgtcggcggcgccgcgtcgttgcctcgtcgccgccggactcccacctcccccaccggcctcctccccacccgccggctgtgctgcctgtgagagaaaagaagaggagagaggaagagaggtggagcggggaggggaagaagagatggatatgtgggacccacgtgggtctcatgctgagtcagctgccacgtcggataaaactggagtgaaaatcgctgagggacttagtttgcactggttttgtaagttgagtgatgcgttatatccggttttatggttctgggatgattttgtaactcgatgacaagttcagggaccttgggtgtactttttccaatcctggaattggtagctcggcaaaccagcccaacgatgctgccgccgccgaagaatctgatgacttcgcctccggcccattttcggacacgtgtgctcccagattcgttcctccgtcgatgagtagaagtcgtccaagcgagcacgcgcgcgtgcggctctgtgctgcacctgcactgctgcttgctcaacgagtgaaaagaagcttcagagcgagttcgtccaaattaaagggcaagccgccgacaacgacgacgagagagagcaaacatttcttcacgaaaaaggattcacggcagcattcgtccttccgacttgtgctctggcggtttcactgattctctccgagattgatgcggcgaaactttcgtactacattacggatatgtcattgttatctggtagttactgatagttactacattacggccgtgtctagttcactctcaactatccaaaacttctaagtttctatcacatcacatctaaaatttttctacacacataaacttctaactttttttctaaactttcaactttcctccaacttcaactttttttcaggaactaaacacagtctacacgtaatagtagtaactaattagggccccctttgaatcaaaggatttatataggaatttcataggattcaaatcctataggaaattttcctatttgaccatttgattcaaaggattgaagcttttcaaatcctatgaaattcctatggaatggcacattgcatgtggattttagaggaaattcagcaagagctccaacctcttgaaaaatttcctttgagtctatctctctcatccgattcttgcgtttttcctgcgctccaatcaaacgaccattcctgtgtttttcctgtgttttgcaatcctttgttttacacttcaattcctgtcagaatcctgtgttttttctattcttctgttttttctaccctgcgattcaaagggacccttactagttcctgtgaactaattgtgtcaccttgagaacaagatgccaaatgaagtatcgtttctccgaatggatgcatagggtggtgaggcagagtttcttgaggtcgttgtgttgaacgtcgtgatcttcctttttggactttgcttggaccggaaccggaaggttgcctggctgcccatgtgggcttgttgagaactcgacgacttgtcaacttttgcattgctactgcatcctgcatgccgttgtattgtagcagtagcacagcagctgtctcatggcttcatcgtcgtctggattagcaactctctagctgatgtgttgtactaaggaaatgatgaggccagaagggtgcaagctggtgttcggtgctattgtgctaagctctttgtcctcttgatggcagatttgtctaaagggaataaagggaggatcaggatgccccgtttactgattgaatggacccaaagtagacagacacctcgctgttcagttcagaagcagattcgatttggacctgtttcttctcgcagtccagggacaatgcatgcgtcaatgctgatgataatgcatgtgcgccaacgagctcgtgagtaaaagtgcagtttctgagtaaactaattgccccttgccacattgcttgactaatatataaattctgtcgtgaactcgtgatatactatatatcaaccctgtccacacatgacatgggcgtgggcacatggcaaagaatgcttggctagtttacatatcacctattatctgttttcagtcctaaacattgcagggtgataaacctttttttctcctagaagacaaagctataaactaatccctgtctcgtggtttatgatacaccagtatcatctcttaaccacataacaattgactaaaaaaaagacggtctattacacatttgatagaaaatacctatcaaaatcttacaatcttggaaccatttgatcactttaagattcatgcaaacacacaaaccctaatcctttttccccttagtgctgcactctcgaaccccccgatgccctacatagagtctagactcctcgtcgccgccaccaccgtcccagcacgctgtcgcctgacctcgctggctagccgacgagatatccccgctctatcatctttatcatctccggcggatccccgccacaggatccatccccatcgggcagcaacttctaacccgttgctccgttttaccatcgccgctaataccaatccaccgccaactatcaccctcccgctacgctgcctcctacggtcatcactctaaacctggggatctcccccttcttcctcctccctccaaccccaaagcacgttcggtggcctaaaacctgcaagatttagggatgaatttttcatcaacagaaggttagcaatcgctaaaacatagtagtttgtgagtcgcagttggttgtaccatgcacgctttgtatcgggctctgctggcatgcaccatgggacggggatacgctattatgtctatacttctatagaacctcacacaaggtgaaaatggtaggaaatttcccgatcataccgcctacctttcagttgatttgtgccaaccatttaatttcgattgtatattgtccggaaatgttgaagttttattcgaaccgttttagtagtatacggtttactgactgcccatccgaataaaaagaaacataatatttatctgttatcgaaatattcaagagttttattctaatcgttttaatagtatacggtttaccgacagccgatccgaatataaagaagcataatctttatctgttatcgattattctattttaatgatgtattcaaaccagttatagctttgaatgttcactaatagtttcatgtgacgttaatttgtaatgtaaacatgactatgacttatttaccccttgatatatttttttggatgctctattttggtaattctattttagatattttttttcgatgtttcaatagtaccaatatcgttactattgaatctggatctaccgttcaatcacgtttccaaaaagaattagtttgagcttttatttgaaccgttttatccctataagtagcaatggtgctgtagattttccacaagagtgatggaagctagctgaaaaagaatactccgtatcgcttttatggcaaaagtcgtggagaggtaaggatgacgacgagaacgagctaggctgaaaagctacaagggccagaaataaataattaaataaaggcatacttgttgtagtgagatggggattataagattattcgggttatggtggatgagggagaagtatttgggaacatcccaacttgatgggcttgttcaatttgctatcatttttaactttatctttttttggtaaagtagaatggctatatttagtttgttgtcaaattttagtaaatacatatgaaatcttgccaaaatttagcaacattgacaaaattttgacaaccttagcttactaaaatttggcaatgtcaaaacttggtaaggttgaaaatggtagcaaagtaaacaagttcgatattacaaaagtcctaattgatttcttttacattgattattcaaacgaaatagcctcctagggcctcatcgtttggcatattcatatgcttatcagccaaatttgaattttcaacattaaatttggagctgaatttgaggttttttcatcgaagtttatttttcagcctttgcttttagatcgctaagagcacatatataaaagttttattcacaaattaatttttatttgtaaatatgccatattcagaaaatatgccaaacgatgaggctgctagtgatttaacgttacatatcaatctaagagtaggatggtacaaacagtaaacaaatggatagcttagagccaaaagacaggaacattagaatttagtactagaaatcaagcactaatccactctgacacgtcatcatgtatcttctaatctacgccacgtcattaaaaaaaaccttgacctcatatcagaaactttcttttcggccaccacgtgggcccacctctcgtcctcctcatttcgagcgaccttccggtggaccccgccggcggccatcggcgtcgcctacgtcgccgtcaagcctccccggcgaggtgggccccacctgtcatcctccccggagcgagacgaaaagctccgcgcaacgtataaattatttatcccgtacacgccaccttcatctatagccgccgcattttactactgcccaccaccaccacaccacccaccccctgcctagctattagctaagctgctctgctccaccactcgtcttccgcgcgcagcaactgttcgcggaaatgccgagcctggcgctgctcagggcggtcgccatggcgctgctgctgctgctcgcccgctcgatggagggggtggatggggcgggcgggggtgggaacgcgacgtgcccgctcgatctgagctacgtgacgacgttcccgtgggacgccgacctgtgcgccggcggggcggggaacatgacgaggtgctgcaatacgctgctgtccgtgctcgccatcggcctcgcggagcaggtccgcgccacgggccacttccgcatcccgtcggtgggggagtccgcggcctgcctcaaggactacggggcgaagctgtcggcggcgccgctctccctcccgggagcgtccctcgtgcagacctgcttcccttcgccggagcagttcgtctcctcgccgtccttctgcgccggcgtcaccaccgccgcggagtacagggcggtcgtcgggaacgactccgtggccgcgctggactccgcgtgcggcgacctctcctcgacgccgcactgcctccgctgcctcgacgcgggcatcgccgccacctcccgcctcaaagccgccgccaacatctccgccaacgccaccaccgacggcgccgcgacgacgcgcaactgcttctacctcaccgtcacgtacgccgccggcatctccaacgtcgccggccccaccaacccacctaccgccgcctgcaccctcggcctcgccctctccaaccctcccgccgcgccgcccaaatcccacgacacggtcatctacgccaccgccatccccgtcgcattcctcctgctcgcctcgctcctcgcgttcttggtctggaggaggcatgacaagaagaagaagaagaagaagatccacgagatctccaaggagggatcggcgaagcggcggtcgcatccgcggccgaacacgggctccatcctgtacgacattgccgagctctccaaggcgacggacgccttcgccgaccgcaacctcgtcggccgcggcgggttcggcgccgtctactgcggcgtgctcgcggacgggtccgtggtcgcggtgaagaagatgctcgacccggacgtggagggcggcgacgaggagttcaccaacgaggtggagatcatcagccacctccgccaccgcaacctggtgccgctccgcggctgctgcatcgtcgacgacgacgccgaggaagggaagcagaagttcctcgtctacgacttcatgcccaacggcgcgctcgaggacttcatcttccgggacggcaagcggccggcgctgacatgggcgcagcggcggagcataatcatggacgtggcgaaggggctggagtacctgcactacggcgtgaagccggcgatctaccacagggacatcaaggcgaccaacatcctgctcgacggcgacatgcgcgcgcgggtggcggacttcgggctggcgaggcggagccgggaggggcagtcccacctcacgacgcgcgtcgccggcacgcacggctacctggcgccggagtacgcgctgtacgggcagctgacggagaagagcgacgtgtacagcttcggcgtgctggtgctcgaggtgctgagcgcgcggcgcgtcctggacatgtcggcgccgtcgggccccgtgctgatcaccgactgggcgtgggcgcacgtcaaggccgggcaggcgagggaggtgctcgacggcgcgctgtcgactgcggacagcccccggggcggcgccatggagaggttcgtgctcgtcgggatcctgtgcgcgcacgtcatggtggcgctccggccgaccatcaccgaggcggtgaagatgctggagggggacatggacatcccggagctgccggaccggccgctgccgtacgggcacagcgccatgttcagcgaggccgggagcaacttcagcgcctcgccggcgttcagtggcccgttcattgacaatggcgacatgctcaggtgatgtaggaggaggtgatctttttcttggcgaattcaagaatcatacagcctactagataagaacaatagccgatatggatgtagtgctcttgcaaattctggtcaattgaactccagaatcatatgtttcgttatctcttgatttgcattgatttttttttcccatacaattcattccaagcgatgaaacagatggaattattatcagagttggctgctacttgtgaattttactgatccttgccaagataactagataatacaaactgactgttcaccatctggaaacaagaacagtggctaattaaacaagcagggagaagcacaaaagcaactgacattgagtcatttctgaattctgagtgctaatgctgggagaagcacaaaagcaactgacattgagtcatttctgaattctgagtgctaatgctgggaggagcacaaaacaactgacaccctctcatcagtgtgagttcattcagacaggcatgagagaaaccacagatacatctagcagcgcatgaggaaatgcaaagctagcaagcaggaggttcagccaaattggcagtgctcagcagcctacttctcctgctggaggttggggtggctgggctgcaccctgaaggtgaacggcatcgaggccgcgaagtccctgtcgtcgtggtggtagccgagctccagctcccttatgccgccgctcagctcgacctcctgctggtgctgaaaacacggggaggagctcagtgaactctcagctttcaggcttctttcagtaaagcttccctcactgaggtttgagctctgtgcagggaagtagtaatcagatctggcatttctgatcaattgctatatggatccagaatgcaggggtagtttgttcatagatgataacatctaatggagcagtcaattagatcactggtcaagattcaataggatgttttgtcatatatgaacaaactacacctgcattctgaatccatatagcaattgattagaaacaatagatctgactactactactaccgtgcacggagttcaattttcaatcgctatatgaattctgaatgcaggggtagttagtctagagatttgttgcgtagaatggttctgattgaatattgaccagtgatctaagtgaccgcattagaatgagcatggcactgaaaaatagctaaagtagtgataggcgcaactacgaagggtcacttattatcgaacctagttgaacagttagagcagttatatcagatggtatttgtcctcaatttcagatggtttttagaaatagaaatgagaacacaaggaatttttcaagtgaaagttcaatagaaaaacaagttactctgaaggaaattaccaccctaaaagccaacatcttgtgctcgtcctccagcatcttctcctgaagccgaacacagagacatgtgaggtgagtgatcagagcttgcaaaagatattgacttcatcatccacaaaagaagcacaagaatcatccagatatctagagctcatacattccttttatgcatcctccagtggtccatctgcaacatcatggaaacaaaggtgacatcagaaacaaaaactctctctgaaaaagaagagatgcggcacttgcaatctctgcatgccatgctgaagtaaacatcaagcttcaaagacagtaatcaccatcttgtcccgcagattggcctggccgttgttgagcgcctcctcgatcgcgatcagctccttgggctgcagggagttcagatcctcccctttcatatgcctgcaacatggaacaggcttgacaaatcaccaccatccctgatgtccccaacaagagcaaaatctaaagctgaaaacgctacaatgggtgatttatagttgtctctttaattaataggaagtgaaagaaataaagatgcatgatagtaataagttgggacactagcctgagctcgatctgcatgttgtcgttctccttcttgacacgatcgatctctgcgctgaggctctgaaacgttttccaagaatacatttttttaagcatttctattcgattttgtaggaataaaagtttggaaaaaaaataatccagaaaagcacgcaccttgtgcttctcatcccagagtatcttcccggagttggtctggtacttctccaagatccttgacagcctaaaacgccaaaaaaacaaatcaaattaaaggccaaacacaatgcaaagagaacatgcatatctcaggaaacactgaaattaagagcaagaaaagaagaaaagaaaaaaaaacaaggaagaggagagagagagacgggggaaacacggacgtggtcttgggcgtgcagtagtcggagagcttgccggcgctggagaagatgacgacgccgacctcggcgtcgcagagcacgccgatctcgcgggccttcttgagtatcccggcgcggcgcttcgagaacgtcacctgccggttcgtcgagttctcgatcctcttgatctcgatcttgccgcgccccatatccaactcctcctcctcctccactccaagaacacaaaccaagaaacaaatcttcacctcgctctcgaagaaacaagagggttggggagttgccgttcttccggtctttaaggtggggatggtggggggtgtggacgactggacgccatggttggagtggagtagtaaaggagggtgcagtggaggaggaggagggaggccgccatggaaggaatggaggtgaggggggctttcgcggtggggcagggctggagcgccggaaatggaaactgctctctctctctctctctctctctctctctcgcgtggtgcattgcgccattgcctggctacgtttcgaccgggtgcagtccgtgcagatcgatcgacgtaggggtagggctcggtgcttgagcttgagctgacctggtttgcgtgggactgagatggaaatgagaatgacacatggtgagcatccactagtggagaaattgtttttagtcccggttcgtaaccccttgtagtttcgggactacgaattcaggactaaagatccctatctttaggccctgtttgtttcagcttaagattattgtaatctagattattaaatcagattgctctaagctgaattataataagctaatataaaataagctacgagttgtttgtttctctggattattagaggcatctaaggatagtgggtctttagccactcaataatatggaaaaagcttccctagaggagattattggattatagtaatctgacttatatattataataatatagcataataatctacttgtttgtttcagcttactcctaataatccagattataataatcttaagctgaatcaaacagggccttagtcccgattcaaatactcgggactaaagatgggagaggcagtcctggttagtttttttattttcatttattgctacttactactcaatctctaatttattttctcccaaattatgtgggatgcatattcctaaatcaaaccccaaatcaaagtaacatcccaaatacacaaatcaatcatatacaccacagattatagatcccaaatcaaaccccaaatcaaataaacatcccaaatacacaaatcatatacatctcagattcatgcaatgaatcacagattctaaaaaagaaattatacatctcaattcatgcaatgaatcacaaattcttcatctcaacctatacatagatcacaaattcttaaaaaaaaagagaaaaaacgcaaagccgccagccggctcagccgctgccgcttccccggccgccacttcgccgtgccaccgctgaagcatctaggcccccggtgttaattttggtaattaatgacaagcattaattgtggactaaccgttgtctttgagctatatattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgccagtttaattttagtttcgccgtactattaagaggggtaatgacctagcaaagagatgattttaattgccacattaggtcattgcattttcatttgtgctctctttttcattacacacacattcacttgcaaattcactgggttcggcctgaccaggggcggtcagaccggccacatagtggcggtctgaccagcgtgccctggccggtcagaccggctacatagtgacggtctgaccggcggcactttcccggtcagaccggccccctggaggccgagatggtgctgctcgggatggccgatacagagccgacgaagccgtattcggtcagaccgaactgatggcggtctgaccgagccgaggccggtctgaccggccaccccatgccggtctgaccggccaggccgatggggccctctgacagggctacaacggctagttttctagccgttgcagagtagcacggtctgaccggccacatacctccggtcagaccgacagagcacagagttgggggatttcgcccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtccatttgcttccattgtagagctagtgtggcacttgatcatctccacaccgggtcattacttgttactcttggaggttgccgcctcctagacggcttgtggaggagttgctcggtgacctctccgagaagattgtggaggaggcccggcgccggtttgtgagtggtttggagttcaccaccttcagagtgaaggaagaactaccccgagtgatcgaggcttgggtagtcctctccgtgggccggctcccgccttgcccaccccttgatgaagggggcgtgcggtggcttcgtggttgagcggtggagttgggctcgcctcaacggggagtaggaaaccggcgagtttccgaacctcagtgaaaaatctcttgtctcattgtctcatttgattgtcgcctttacatttgtgcaatttacatttctagagacacacttgagatcatatcaccctaggattgcaaaacatcgacataggagcgtgatttactttcctagagatataattgagccactatcaccctaggtttgcaaaacataacttagttgcttagttagagttcaccctcaccaagcctagcaacttaggttagatttgattaggtgttatttagttttaaatcgcctattcaccccccctctagtcgacatctcgatcctacaaccgcgcggccctccgcgccgcagcgccggccgccaccgtccggcccaccctccccctcctgctgcgcacttcagccacacgcgaagggataaggaaagaaaagagataaggattagatatgaaaagagagagagaggagtttgtgtggatgggaaaagacgataagtaatagggattatatagtgcgttttgatctttagtcccggttagtaacaccaaccaggaccaaagatcatcgtgatctttagtcaggattaaagatccgaactttagttctccaaccgggactaaagatcctggagggccctgacaacacctcatagcatgtgaaccgggactaaagatcacgtagtcccgttctgtttataaaccgggactaaaaaccatctttagtcccgattttttattgcaaccgggactaatgtggtttttggtcgaccgggcaaagatggtttatccactagtgatcttttctcctctagtcgttctcttttgtgtggaaactattctgagctctcgagggaactgtttgagcaacatacaaacaacgagatgatgttccttcgagagtttaaaatccacactcctcttttgtgatcttcattcactcattcttgctcgagggaactgtttgagcaacatacaaacaacgagatgatgttccctcgagagtttaaaatccacactcctcttttgtgatcttcattcactccttctgcaaggagcaggaatgagcatgaggttgggcagattctgaaccattcaggatgcaaactatgagggcttcattgctcaaccatgtaaggcaccggtaaagccattcacaatgcaccgagatggcgagtggttccaactcgtcatgttggtgtggcaggctggtggctccagctagactaaacccgtgcctctgtgaggtttctagttccttgcagagggcgtgagtgtcccgatagggttgaggggtacttgtgttcaaggtacagctcgtgaggccgggcggtctcgttccccattctttctttcaaatggcggtgaccaaaataaagtggtgcgacaaatgtcattggggaagagaactagcacaacggagaaggagagaataggagtgtattgtctccagacatcacagagtctatcacacaatctacggccatatttgttgaggtcttcactcaatccgtcgttgtcggttacctaggaactagggttcccatagcagacaacgcgcacaaggcaaatgacatgtgtcagctcacccagctcgttacccgcgctggggaacagtttgggggcgacacgtggcccatctcagattgcaaaagacgttgccttcggggcaccccgagagaagatcccaaatcgtattcaggctgatcttgggtctcatactcttttccatttattcatgataggacgattatctaccccagggcaatgagtatggaagacaacgcctgtcactttagtcgtgttgaatctgacactagtgttggcaatggcatgcgggccctgtgtccaggttcaacacggctaaggagatgtggtcaggttctaccataccccatcgagacccatgccttttattgggcaatggcaggcggaccccatgtccagctaggcatggtgaatcctattcatcgtgtcgttgcgtggattaagtagggtgtgtggcaagttccgtgatgccccactcagagtagaccctactcaaagttgccttgaggcttcggtggattcgacacggtagcatgccgagctctcgcacatatatctcgcgaatagtaggccctgccaggtgtaccccccaggtcaacggagtaggtaagaagaggagttactgagaagacttatcatacttgatcttgatatgaaaaaagatatttcctcgaactttagtcatgtggtttcccccaaagaaggtataaggggaaaaccgagaccaaaggagagcggattggatggtggtgactaaggagagacttcaacacattatgtcaagctctcttaataaaccccaaaaagaaaggaagcagaactactccgagtagtcgataaacctgtaaaatccttcaagcgcaagaaatcaccaccataagagaagtagggtattacaccttcggatagcccaaatctgtatacttcgatcgtgttcgtttgtttgtttcttgcgctcttgaggggctcaagtcacctccttacacgtgactagctcctcaaccgaactcacagaagggggtcctaccagatccccattatcaaggttcacactccgacaaccgccccctccctcgtaatggatctaggcgtcaatgagctcatcggccctagccttgaggccgctgaacaaatccagcggtagagtgaatccgccttcgattttcgttggagatagagatgaggtcgcgagcgtcaggaagggatgcaagtgaggtgggcatgagcgctgggtttatcttatggaaatgtatctggaatctagaaagcagtcttaggaacatctttctttttattaacaaaaatatgtcaatcaacaggaaatcaatagatgcagtagcttagagcatctccaacagagtgaccatttttggctctccaaatgcctatttggccagcctaataaaagtttagagagtcaaatttgtcttctattccaacagactctcccgttccactctctattaaccaatggaccccacctgtcattctcctcctctttcttcttcctctctctccaatcctctgctcgtgccagcgggtcggctgcggcaacactgcggaggaggtggtgaaggcgtcgagccgccccgctgccgctccctccctccctccctcgccgcactaggagagcgatgacggcggcactgggcgggcagatcaggaagagagggagccgctgcggggaaaggtaggcgacgacgcggacggcggcggcggtcgcggctggcgacgacgcggatggcgacggaggtcgcggccgccgatggtgcgaacggcggcagaggtcgcggccgtcgactgcggtggaggtcgcggcgggcgacggcgcggacgacggcggcggtcacgtgtgaccacgtcggcgctgggggctatgcgagagagaacagccggcaaagagaagatgggaggagaatgtgtgtggggcccacaattgcccagcgatttttggctggctaaatttggctagtggagggagggttggagagactgttggagcgcgttttttttgttagagtggctaagattttgcttagagagtaatttggataggctgttggagatgctcttagtactgctactgtataatgcgcaacagttgtttgtgttggtgaactcagaccaaattccattgtaaaacatctgaaaaaacgtggctgttcggaggacatcacctgtgaaatccattatgactttacgaggtcttgctcttgcagtcatgtaactattcctccggtacaaaattatccgtaaaaggttgaaattcacagaaacttccttggcttggtaactaaaaaataaaaaagcgtacactaactacgttatcaaaataaatctaatttctgtagcatcaacgactccgtggcccaatggataaggcgctggtctacggaaccagagattctgggttcgatccccagcggagtcgaaatagcatattaattttgctatgtcttttgtttctgttttactacctggactcctggaggtttcacttccaacactgccacttgctcgaaatcaatcttttcccatttttttgtcactcacgttggtcacagttcaaaaggtattacctcttcatgcaaatgatgatgatttctcttttcccttgtctcttccaagcataggtcatcagaatcgctaattagcaatcagccacgtacatacaaagtttatacgtaacatataaagtttatgtatatggatataaattttatacatatactcaaaacgattatacgcgcatgtataaaaaaaatgatacatcaaaatatgtatgcgcataagatttatatacatatattttttatataaatatatatataaagtttgtacgtaattttgcccacgcaactccaccccactcccgcagcccatcccaacccaacaccagttcagagagtagcagtgcagcacagccaaaccaggccactcaagattgcaatctctgaaacccaaactggcatttcaggagggttttacaggtaaaagaaaaaattacaaccaggcaggtagtgcagtgaagtcgcagggctgagcagaaagcaaaggtgggttcgcacaacagagaccaactggaggaatggaagctcatgttccttcagctccaaactgggacctggcaatggagacaaatgccgactgactcagtctccgtcttggataatctcaatggccgtcgggtcatccgtttcgtagtcgtctgcgtcgatcggattgcaagctagtggcttgtcgatccatggcatgtaggccccctcgtggcacaggttctggaaacagttaaaacaatttaggctttaggaacaatttaataacttattattaatgccttcagcatagctatccttaattcccaaacgaagaacataataaggagtacatcaagaacatcattcttgttccctagagttatgttgtgagcattcattgattagtggccagatctttcaaagattagtaccctgtgaaatatctgaatcaaagaagtaacatgcacagaaggaagatcggacggactagttccctctatgtcaatgcggtgaaaaatgctagcgacaactgttccttgtttaatgtattttatagtgaaatcattttagtcattgcaccataaaaggaattactgtgatttatatcttcttcttttttcgaaacggaatcacagagacagacacctaatattttgacatagtttcagccattagtcaaatgaagaacattaaatctcaattccacttatagggtagtttagagatcacctccaaccagaagaagaattttcgcaggaggcaaagttttctctcatcagagtcagcagaatctatttgtatggctagatctgtatgagagaccaaacattagtgttgataaaagaaatcaagtactaagcagaatctgctaatctggcttatgtgaagcaccaagtaacttgcaaatatgcaattatacatcgtgccataaaaatcagacttcagcaattgttaccagggaaatgttattcacaaatgcatggatgccgtaaatttattttatattcaaaattgacatcatataatacaaccctcaatggtaagctactaataaaaaaaataagaattccttttccctgtgatatgtgcctatgtctcattttattgaggggttgcagtaatgaactagtcagaggtctagcctattgacttaacaaataaattccactgatcctttgcaactggcgaaagacaaaggccttgaaagttaatccgtaggatacaacaacaggctggagcacagatcaattatgtgatgctactagatcatataatgtacaacgagtgtcaaagcttgtcaacgccgctcaaatttaggacaaaatcaagcccttggactgttagacatgaggattacgaaattactgaccagaatttagtgattacctgggtagtgatcaagaaatgacaacccaactgcccttgtggcatagggcttggatgcatttcgcaagtgtctctgtctactcacaagcttccgatctgtagcttttctcaaaagctctttatattcatttaggtcatacggcttacttaaaacatcattaagtttttcatcaaatgtagagggaatgccacaactaagagcaagaggttctccttgttcatctccacatacctgggtccaaaaagcaaggtacataataaataaaacatcattaaagatattgccaagggaacttaagcagacaaatgactcacattcaaatcagaaagttcagtacaaggtggaagtccatgctcatctatgcagactagatcctgaccacccatgttctctaaagcaaggccatccatttcacgttcagatgcagaattattgatcttcccaagcccatctccatcagtattcatagcattctcttcacccatgttttcaaatgcagtcatcaaagaatctcttccatttgtggaagtggctattctcaattcatcatatccaaccggtgtctcctctgcttgcccatatacaatggtaacgcctggttctggctcaataaccatgagaccattcttgatcttcagaagtctcagaaatgtagcatatgactcatcgatttctgacgtctccatcgcaaatgatgtacctagtgaaaaacaatgccccgcatttgcactgccagccttgtctgatgttacacctggtccctcgctgttttgattacaatggcttctacgcaatgaactttttgtgatatttgtgccggatttggcattagcatatccattggatgcatgatcttgtgcatatcttagaaaaacaggcgagccatggtcccctctcggcgcatcaagtacatagccgttcccatcttccctcagatgttccaagaaaagcctgtaacttggatctatttctgggatactatcaacaggtagactaccaaacactttgttcttgctgcatgatgatctgctcaccatgtcctgggccttcatctggcaactcccctggaaatccaagaagtgtaaaaaaccacagctacatcaatccgaagagcaacaagcacggatacaacctactgagagctgcatcaagagtagtaccacggtgttgaaaaaagaaaagaagagaaaaaaatcgagaatttagagtatttaccatcaaattcgcgtgcctcaacttttttaccactcaattcgtatgccctctataatatgtcattaggagtgctaaactgctaatttgtctatttggtaccgttttctctgtttttcatgtatttctcatttcttaattttatttgtatatttttttactggtttgtggacatttctacccctgggcccacctgtcagatccaaaagagagaaatttctctctggatcgatcgatccctccaggcaagcgcccccgaccggcatcggcgccgtcgaccgcgaccaccccgctgcgcagcgtcactaccccaccaccaagcgccgccgcagatcgccaccgccgccagggtgagcaagctcgccgccccagcccccaggtcgacagcatatacatgtctattacgctcaggcgtaacaatttaccggtcaggcgtctacagtttacaataatttgctacaatatacatgtctgctacggaatcaggcgttgcaaatgagcaaaaatggctcaaccaattcctgctgcaaccatatgatcttcaaattgattttgggagcgattgaaaaactgaagaaaaagagaaacagcagctttgccaccatcttatctccttgtttctgctttgctactggggactgccctgctcatcgcctccatcttccagttcttgcctgtaaaaggaatcggaaagctacttactctttgcagaccatcggcagcgccccgcggtgtaggcggtggggccgtcgagctggggcggcgggggtggtggcgctcggcggtgggggcggtggggcgtcgagtcagccgcggcggcggcagctctcggcggttggggcggtgctcgggggcggcgagcttgcgcaccctggcggcggcggcgatctgcagcggcgcttggtggtgaggtaatggcgctcggcggcagggtggtcgcggtcgacggcgccgatgcctggagggatcgatcgatccagaggagtctctcactttggatctgacaggtgggcctaggggtagaaatgtccacaaaccagtaaaaaatatacaaatggaattaagaaacgagaaatacatgaaaaacagagaaagtggtatcaaatagataaattagcactcctaatgatatatattatagagggcatgcgaactgagtggtaaaaaagctgaggcacctgaatttgatagtaaatactctaaattctcgaaaaaatcggcacactgttgtagttaaccaattaaatgcacaataaaactagtccacaataagaactagtatcagcttgtaggcctcggccatgcacgcggcggaggttagccagatagatgatgatctcccgcattacctgaattgattaattgattacctccaccacatgacccctgcccctgttcttgatcccttttgctgcatgagcagcagcacagtcgaacaacctaatctctcgaagaggagagagagggggactggcaggaaatgggtgggggtttacagtgggagaggtttacagtgggagagagcggatgcggtggccgcaggcaaagaggaggaggaggagagacgatgtggcagcgaaggttggtgacccagcggacgacctgtttgaggagaggagaaagtagccaactcacgggtgtgcattaccaagtatccacctaggaaaatatatactgcaaaccacttatacagcaaaaacttaaaaactattgtttagatctaaaaacgagcctatgagattcgtccacatcaccatgagtaaaaattttactccttgttcacatcaccattactcataagtaataaatgtagtaaaatttttactcattgtaacgtggatgaatcttggctacaatattcttctccctcccctctctacagtagcttctctctctccctcgtctcccatcccctccttcccccagattccaacggttcaccgccggcgagggttggaggaggggtccggccacctccccctactagtgtagtgtggttaggtctgttattaggtcgttaggtgcttcctgtagttagggctagttggtgcttttgccggtgagtctccacggatgccagtgtggacggcggcggtgatggttggtggtggtggcggtgcgagatccgaagatcagtggacgaatcgacgggtggagatggctccttgtggtagtgttggttgcagcaccgtcttcgcccgggaggtcgccacccagctcctattggctgctgcggcggcttctcgaggccttcgttggctagcgctggcagcacatgtccatgtcgccctactatttcccggagcttgctactcgcggatgtcaagccgataggtcctagtgcgttcactggttgcagcgacgatttcttagacgtcgtggatttgttttcgcccggagctcgcagctcgtgatgcgcgatgacaacccgatgatggcttggtacatccaatggatgtggcggtggtttctctagtgcctgaacgggagcttccaatgccaaggttccattagtcaagattcacacgcttccccaaccacgtacgtcgatccaagaagacaacagttcgtttgccaccattcgagttcttcagtggttatgggaacctggatttgggctccatcttcccatgtgtttcctaacagcttgttccatgcagagtttgttgttcgggttgagcttactctccttagatttaacgacgaactccgtggacaactcttgctgagcatggggatgcttacaccaaaatttgtgactcagtagcatacctctattttgtgccgtcatcgtggaggcaaccgaaggggattgctggtttgtcaagcgttgtgcacgccaaaggaggcccaaggtcgcaatcgtcgcggcattgccgcacctccctgtcgatttgcaccttctccgttgtgtggtttcattaggaagtttgtggccttagtgcagtccccattctttagaaacggatggttttatgctttcagtttatctgtttggcaatgtagatttattcccgtgaactctatcgttttatattaatggttgtttaagtttaagaaaaatgtggacgaatcttaaatatctatttatcaattctcaatccaacgatagtttttagggtttcactagtttctaccatatatttttcctatctaccatccgtttcagttcagttgtctcaggtttatctttcttctcctctttaagaggccattttctattaacgaaattgctagaaaacacagcacagtttttctccccgaaaactattaaatttgtgagcattagataactttaagagtcgtgcaaatgaaaagaataaaataaaataacctatacacaatagaaaattgaaccaggacgtttctacctatgtcgctatgcccgtgctaacacaacggtgataatcgataatgcaaaaaccaaaaggtaatatttaagattcacgaataaaataacgatagagagatgtgtattgttctcatgaatattattatactgttaataaattcccaaagttggccatgaatagagttctacaatattttaacatttcaaaacacaaacaataactcatggtgtctaactttctataccacatatagatacaaatatcacctgcaagttctacaggtgttattttttcaatacatgtatcgcctagaaacattctgcaacttctgctcctcactggtcaccttcctccttatagagcacctcaagaagccatatgaacttctctatcgaacgcatattagtagaagcaccatattgaagacaatgtgttcgcctaccacgagacacacgctcataaagacatattcatcacttggcattagtaatttaactcccaaaatatttggcaaaatcccggtttctattaaggcaagaatatgtagcaaagcaaatatataggcttttacatggctccaattttgttcatgttaatgagttgaaaaaggtaaaatgaacatgaatactttgttaaatctgcagataaacttttcggatcatggaaatgcatttgtcaaatttcatatgttcagatcaaatttcattataccctacgaatacacaggacgcgtaaatcatcaatattgcacgctaccaacagctaggcaccacagaaagcagtccgaaaaaaccatagaatgcatgcgacatttcaggaaaattaagaacgatacgatgtggttcaggagaagggggatcggcgacaaggcagcggcttggacaggggaccagcggtgtggaaagatgtgttccaaacctgctgatgttcaaaattaagcacatactccctccgtcccaaaaaaagacaaaccctgggtttgtctgggtttgtctttttttgagacggagggagtaagtcagttcaccgaatccaacatgaaactggtcaatgactgatatagatttgttttttgaattaaaccagattgccactatggtgctttatctcaagtattcagctttttacaagcttaaatgccgaccctaaaatatagagatcattaataaaaaatgtggccccttcctaccctatgctcaggctatcagttaggtccatctcacagaacctcaatccctattgaccccatattagaaaaccctgaatctcaagtacaaccgttacatatatgacacattaagatgtagaagacactaatttttatatcagtttttaataaactgatttgacaaagctagccgggtccatttaccattttatcataccagataaactaacacacacacacacacacacgcatattctcttccatgaagttccaatatgcatgtttgttttgttccatttttctaccaaaattcattttgtagtgcattccctaagacccaacgatccccagtcatgcatgatacaaggttgcattaaaaaccctaaactcaatattttttttccaaaaccacaatatgaaaccatacatacatccaccatgcatgaccctgttgaataaaaacgaacactgcaaatatataattgcactaatggaaatgttcattggactttttgacgtcgaaggaacggtttgagtgtgacatacaggggcagcggtggatcttgaggcaatgggggcagtagcacattgatggaggacacagctacgtgtcggtgccaccgatcgaggcagggcgacggtggtccagcggcagagaatggtgtctccatggggcggcgatggagcttgtctccataaaattagatgttgccccgtcccataaaaatttcagcctgccatataaaagagagtcaagtataaactccatgtcatgtggcttgccatctaaaagggatttcagaaatcaaggatttggattgatggcataatcctatgcacaaagttagaaagatcactcttgaaaatttaaccacctttcttgaaacaaagattacacaggattggttcatatttcaaccattttaaaaagcgggattgaattagtacaccaatttcattaccccttctgacaacatatgagtgtaacaggggccatatatattgagataagttaagaaaatggatctaaaaaattttgcatgacaaaaaaaaatctaaaggcattttaaacaaactgagagatcagctcagagtcatctttgttcagatgcaaggaaggaataaaaagaaaattaaacaaaccaagagatcaagggccaaatagagccagcaccatctcttagtacaggaaatatatgatcaaaccccaaagtaaaaatgcaccatttaatttctaatttggatgaatggcaatcgagcccattgcattaagagaataggcaagcatgcataggtggtacggtggcaaacagcaaaaacggatcaataataatataattctcactcatattcttgtaaactatttaattctgatatataagataaaatgctgaaggaacataaagagaataaaatccagtatcaatagaaacttatgaaagtgcagtgtgacagtagaattcttctgtttgacctttttcaatgatgaatagtttcagcaaatttggttctattttaaatgaacaacaatagttaggaaacctattcatctagatcatagcattttataaacctatgcatctgaagatcaatttgtacaaagcatcttactctcttccatttaaaataaactactatcttccatgaaggcaaggtataagttacaacgctatgatggcaatacattttaacacaagcaaatttatctatggtgccatcatttttttagggtggcaacaaggtaccaagtacccagctggttagggcattctcaacccaatgactaggatggtgtccatagcattaaataagttgccacctaggacaaaaaatgatgtggcaagtgaataaatgaggaaagagaaggaaaccatgtcttgtatgagacatggtttctacacaacattcaagacatcatgtgagataagtagcattaaattgaagtatggaatagtggtatttgcattggaagagtagtgtctagtactagtttctgcatgatgtggagtttatggaaacaatgtctagtgttatgggttgggactgctcttatataattgtgctactccatgcaagaagacagagagattaatcaaagccactaaatattcagcataatactactaactaccaagatattccatcttataatattcagcatggtccaaatttagtagttagctacattgtcatcatatgctcttagggtatataattttacgtctatctgctcatgttcaaaattatttcctgaaaagtatataactaactgttgttacctttggttcatgtacgaaaacctaaaattgatgtatacatccaccatgatctgaatccatacttgcatccaccatacatgaccctacaaatgaacacaaattgaccatgcatgaccttgtgggatgaaaatataccctgcaaatttcccagtgaaagaaatgcgtctgtctaggaaaggttcacgaaaaaaacataataaatattgctactggcatttgaattttaaatccatgaacacaataaaggaaatttttttgacccaatgaggcattcaacaggcacccaaatgaaccggtacgtcctatcgctaaacataaaccaaatgaaccttatcctgtcctatccaacagccacccaaagttctgtataatcccaacagcattcacatagtctcctctatcatcaatataagtttgaagaaaacaggaaacatgtgtagactaatggcattttcatttggctgggcaatgaaaatcctaaatgatagagcagaactggacagtgaagcacgacttggtcatcaaacatcagtttcttatggtcgcaaggtctcaactaaactgcaagctcaacaaacataagaatcaatatcctctcagtttattttttgacatgtacaaacatatgaagataatcactttctttgccacacattcgcataataatttattttctcacaggtttatgcacgtacacacataatagccatgacactgtaataacgaaggaacaggatcgagcgatgattaccttgttcgcatcgcggtggagagggctaaggtggaggcgcaaaggagagcagatggcacgagggagtcggcggcggcgtcgcggtatagaagggggcgcgtgggcgagcagtcccggtggcggcgcgaggggccggggatcaacagcgcgtgacaacgatctgcattgtgtgggggctttggcggtgtcaatctggaggcgggaatcgacgacgatcgtcgtgaggggcgctggtggtgtcatctggaggcgggaatcgacgtgctggttggggcgtcggcgacatcgatatggaggcgggattcggtgacgattggcgtgagggtcaaggtggagagacgggaatcgccggtggcgtcgatgtgaaggcgtgatggggcatcaatggcatcgatctgaaggcgggagtcgacggcggctcgatggcgggacgtgggcggcgtcggcgcgattgcggcgcgtcggaatcgacggcggcatcggcggcggcgctgcggttggcgtggggagagagagagagagaggaggttgtgcgagagtggagggggagagggaaatgcgtgcgggagattagtgtgaggttgcggggagatacgtgggaggagctgagccattggattcgatgattctcggtcgttggatttgatgaatgagtacgtaggtgtaagagtgagttggtgaattatagggtagactagtaattggcccgtgctaacgctacggtagcatttagaaatgcaaaataaataattaaaagaatatatattttttgccaatcaagcattaaatgagacaagttaaaatttaaaaactgaatgacaaagcaagttattatattgttaatctttagccatgtgagtaaaatatcatgacctctatctttcgtaaaaatctaattggtaatgtacaacttcacaattaacacatagacataaaaaaagtccaaaccggatataatcatctaatgtttgatctatatatcgtttataatagtatgcattatctaatgtcggagtatttgatgtggtaaggtagtttatctcgtttacatgtccaaaccatccatcaccatctgctaaattcaagtttataatctatatctcatatgacttctttgatctggcatgaaaagaaaatgagaaaatgtttggaaatctaaattttactgagaaatagaactgaatttggcaattgggagaacacatagtaattcatgatgagtctgcttcatgaaatcaagctgaatactaaaagcactttattcaatcacccagatccaatcatttacttttcaatcaaccgccaaaaaggtcacatacaagtatacaattgcttcatatggcatgactacattattcatgaacgtcacgatacaaggaaaacgtctatcaccttgcggagcggatggccggtggggacaagggaggaagctgtcgatggtcttgacagcccacaccaaaaaggcaccgatggtgctgcataaatcaaaacattacatgttatctccacaatttacaataagtaataacatagctttcttagatacatatgctaaacttggaaacaacatagctgcataacatttttaaacttgtttgtacatgaaaaatgtcaatgcttgttctgtgcaattttcatattataccagtgcattttgaaatgcaagccatcacccaaaagactccatttcagtggcaaactgtcaatgactatacctcaatctatcacgtattaatctggtacttacatgacacacctaagaagacaaaattgaaggtgcgaagagatcagatcgtatacctcaaaatcaaaattttagtcctcaatttgccacgagcaggttatttactgaatttgcccacagccccacatagttcacactggatgcctgtttgaattagcatgctcagtcctagtccacttgtgctccttcatattcagttttatgtaaatttgtacacaccagtcagactcactttgaagcagccaaataaattaacatttcagctaatactgagaagtaaaatgaaaataaaaataacttcctatatgtggaatatggacaaaccctctattatctataactatacagattaaccatagagatgataagaatatgttctcctgatctataaaaaagatatcgtgattaactcataatcatataagatgactctggtgagtgatgtcatacatagaaaaacaaactcactctagggtgtcattcccctactttagaaaaaaatcattgtctccaaaaaaattgtgttagttaaatttatggtttttaacaaatcagcattgaacagtacaattaacagcaattggcatcggttgggcaaatagcaaaacggaaaaaacagcactgacaagttcaaattttatctccagctcttactcacaaaacatcaacggcctgcaacaagcagtcacataagctgaattagttcttgtttccctttctattttaaagttctttgttcaagggatttagtcacaacctcgaaaaatgctattttcatgctccatttgtttttattatatgatatgttggttggttcaaattgaactaacaataattccattactgttaattacaaagaagggagtatataagatataacagaaatgtcataacaaataattaattatcacagactcaatagtgaatctgcatatgtgataacactttgaggccaccaatagtgaatctgcatatgtgataacaatttgaggccaccaaagaatgtagaaccagatgcagactacaaactcgatttcaagtatcattgactgttagaaaccaccaatagtgaaatagaaccggatgcagactttattaattgaaattcagatgatatgaaacaaaaatattccagatgatgatatgagccatgcagacttatttatcctaagcagcaactaaggatacacaggcacagccaccagaaacaatttctattttgaaagctagatccacatatcttccttgaaatacccaatagaagagttggcttcattaggtgctaaaaattataaggtggcttgaaaagaaacacaatcaacagagatagattgaatttgttctctttgaagcaactgcaggcataaacaataatactctacaaagtttcattgggtctaaactactctttgcacgtcatatatatgcccaaaattttttagcaccatacaaggagttcataactcatgcctaaatctgacaaatttgtcaaacaacacaaagtcaaattataatgcagttgtctagaataatgggattaggtgatagcaagttgtctggaagcatatgggcccctatgctgcgtgcagaaagcatccgacccaacggtgcgatgcagaatgcggctgctcccatagtcattagtgtaacataatgatcaaaattagaattaatagcacaagcagcaactgtgaacattctgcccttacctaactgctcgcaaaaaggccatcttgcataaatgcagggagcttcctcagttgatccgacatcaaggcaagcaatggactcagcaccagcatatgtctagataaaatcattgcaggcacctgaaacagaacattaacttttcagcactaaattatataacctcaacatctcgatttttgcagcacatctgatagcagaaatttttgttgatgtcaatataatgaacatgctttgttgttcaaagggcataaaaaattttcagcgccaaatcctataagtgtttctgttgtcagcacgccgcttgacaggacaggacgccgccgccacgggagacgaccgccaggacaccgccgacgtgggggcatcagcacacaccgtcgcctgccgcctggggagggatgccgccggagatggggtccggctgatatgggcagcagcagcaagccgtgggagaaggggagagagacgaagaagacgaagaaaatcgtgggcgaaggagaatatcgctgcctccgcgtgcgacgggaagacgacggaggacgggctcgcccttaacgggcagtctcccgtcgatgtgggcggcacgacgagcggagggtggcgtagtggatggcagtgtggtggagagccgtagggtggcggcgaggacgacggcgcggtggagaggcagggagcgacggcgctcgcagaggagaccggtgcggtggagaggcgaggggcggcggcgcggtgtggggagattagggttgcgatttcgtgacgacgacaatttgtgagcgccggcagcaaatcgtgggcggcggcgcagaggagatcggcgaggcggcgctgatctggatgctggtgcaagcgcggcggtccgcggttctttcccgtcgatccgacggcggcgcaggtggagctgctgcggggtttgggattggggggcggcgcgacgcggggagagcgagggtgcggcgatgatggtgcgcggtgggagctgagggaggtatggttcgtcggatctgaagcggtggatgatttttgtccgttggatttgatgaatgaagcacgaaggatgtaaacatcagttggtgaattatagggtagatagattgtggtcttgtggagttgcactgtgaaacttgtgggtggctaatagtgttcttagtctaggtggcatggaaggaacactaaaggaaaaagtacaccgaaggtccctcaacttatcatcgagatacaaaatcgtccttgaaccacaaaaccggatacaatgtattcccaacttacaaaaccagtgcaaactagatcccttggcggttttgacccgattttgatcgacttagcagctgactcagcgtgggacccacgtagaccccacatgtcagtatgtccacgtcatcacccatctcttttccttcttctcttcgttccttctctctcttctctccctgcgacaatgacgggcgcagccttgcggcggcggcatgaccctgtggtgggccggcgagggataggcggcggcggcggtgctgctctgcgatggccggcgggcttgcacgccatcgacgctgtctctccctggtccccttttttttcttttattctttgctcggtttctctcccccgatgccgccgctttccatggcagcttgcgtggaggttcgtgcaggcgcggcctggcttatggcgcggcggctggatgtggccggatgcgaccggaggccaggacgacaccgcccgcagccatcaagcccctacccgccgcacatctctcccaccggtcgagctcgccgccgccgtctgcgccctgcatgtcgagctgctcatcgtcactgtctcaatgccgcgcgaacgacgactaccaggggctccgcggccgcgcgcacgatgatgatgtgggtctcctgctctaggaccgccgcggccgtgtggcgggtggtcctgacgagtaagaacatccgcgccggcgagcggccgctgttcccattccagtcgcccaagtacctgaccagcctgaccaggcggtggtggcacggcgcagcggtcggcgttccacactatctgccgcgtgcttcactacttgaagcgcttcctggtaatgaacccggagcagccggactcggctagaccggcggtggactacctcgacatggatgcgcagctgctggggaggttcccagagtgggaggggaacggtgtcgccgacgtgccattcgagatgtacgcgtacagggtgatggagagggacaagagcaacgcgtgtagggacaggagctctgactccggcagcgacgacaactcattgtgtggagatgacagcgtcagcggcgggtccagcacgacgacgacggtgacgaacgcgtcggcgtcggcgtcgagccggccaatacttgaccggagaggtagcacgaggtcgtcagcgccgcggcgcaaggtggccatcgccgccaccaaggcaggcaagtgtcgcagcggtattgttactcgtctaaagccttccaagattacagctagcgctccatgtccatgacgtgtgcatggccaccgcagaagtcgagatcgataggcactgtgaggccgccgtcgccacgcactcgaccgcctttgctccgcttcgccggccgccccgcactcgacgtcttgctccgttccgctggccgcagccgccgccttgcttccctgcccagagagccctagagagaagagtaagagagagatgaggaagggagagagaggaggatgacgtggatacgctgacatgtggggtccacgtgggtcccatgctgactcagtcgccatgtaggctaaaaccggggtcaaaaccgccgagggatattttatgaccggttttgattagttaagggatgcgggatatatggttttacggtttgaggacgattctgtatctcgatgacaagttgagagaccttgggtgtactttttccaacactaaattatggtgtcacactgggctgtcgtgtgggctagatttgggaaagcatatcgtatccaccaagaagaggaaacaaacggcggcgacggcgagatccgagctggagtaacagaaaggaaaaagaaaaaaaaatccacggccgtcacggcgcgtatcccgaagcggcgtatcccctcacctcacccgtcgcctcgtcgtcctcctcctacctcacctgccttccttgccactacccactactatccccacccgtgtcccgcgcgccacgccacgccacgcgcccacgcctcgcctcgcctcctccccccaccccccgaccaaccaccaccgcctgagccgccgccgccgccgcccgaggcgcgacggaattcccccccgttcaattggacgcgtcgcggtcgcgatccgccgatcgatcccgcagccactgctgccatgggcgagcccgtggtccccccgcgcgcccccgcggcccacgccgcggtcgcggcgccgaagccgccgggagatcggtgccggcggagggcgaggctagggcgccgccgcggccgccgcctgcagtgncggcgggtgcgggggcgggggcgagcgggggagggaggcgggtgttctccgtggagctacggcccggggagaccaccattgtgtcgtggaggaagatgctcaaggaggctgacctcggagctgccttgccgcccccgccgccggcggcggcggcacagccggcggtcgcccccctccctggaccatctggtgcggtagggtttcgtgctctcgttacatgtttttttgccgatttctgtcttccgtgcctattctgcgtgcaatttttcacctgatcaagcctgaaaaccgcgggggattttgtgtgggagttgggaggtctgattatgattcttcaattagctaaatacgattttcaattatctatcatggtgaggccaaatgcagagccgagcataagttcgcaacagagaaaccgagaagtgacagcaaaagttattgagatttaacttaaaggaaagcatccattagctgttgccgccgcgagcacctttgcaaattggagggtgaaaagaatatgctcctctgcttcttttctatagcatcaaaatatatcatttctcaatgccagattgcccctcaccatgtctgcggtcaccagctttaccttgatgttgggatttcccactaggtaactaggctgccccgatttagcatctgcgtgtcttctaacatctgcatttggtagtgtggtacatggatcagtttaatagtggaaattgcaacgtcaatcgctcattttttcagccttgatggataacagttactgtattatttattgatcaatggtgattatcatgtcattggggaagaaggtcaagttatgaagacttgtttctcaaaaacgataagatctcaagacttgctacttatgtgaccatatgtaagaactacaaatgccatgcaaactttgttaagcttttattctgttggtagaatcaatatagcaggtccgttttgatgacaaaccagaattatggaaggggtttacgcatacactagaagtatgtgcattgtcttgcaatgatgcaacaatgatatattaattcctcgaaattgtctggtaagatgattaatgtaaactggaatactatacaagcaagatgtgtcatttgtaggcaataattcctatattttgttggaacttgtatcagacattctgataggtggtggttgtgcttactcatttgcaggtggtcattacccttacccatttgttgaattaaatcagcctaacttgtggttgtcttcacatatgattgcacagatcaactagttttttttattgaaattgaaataatgtactgtatttgaaataatggccattccatcttttgaatcagacacatcctacagaaaatgactgcgcacaatcaaatcggttcaattcagttattgagaaaattgagcgcctttacatggtaagaaacatatggtgttactatcagagaggaaattcatttttactttccattatgcacacgaaaagtgcttacctctgtctacatccttttactatgccagggcaaaaatagtagtgatgaggaagacttggatgatgcgcctgatgatgatcagtatgacacagaagattcgtttattgatgatgatgaattggttagcttttcaatttaattgatataataatgctctaatgtattgttaataaaatgttctttttcattggctcatctgacctaaacagtgttaatactgacattgtagtgctttgagttaagcttgttactatttgttttgccatgcattctgcatatgtgctactatcctgttatatgtatcataaataacagccttgacttcttggctaccattccatatgccaaatttgaagaacagctgagaatggcatgctcttataatctttcttttttcattgagctatttttctagtgttaggaagaatgagggtttattatcttgaattcaatatggtacttcactcaagttgcaacaagaaaaactgctactttgtgcaaaaccagaatgatctatatggctggaagaacttaactaccgacactaatttatatgcaaaccaaatgtgagcttacatgcttcttgctgcatatatctagccttgtttagaacatctcaatgattctttttctgtatcattaccatttgacatgctgagaatgatagccagtgttctgatcactctgttgttttttatccacaggatgaatattttgaagttgacaattttgcaaccaagcacaatggttattttgtgaacaaaggaaaattggaacaaatgtaattttcctaaaaactctttaatttgcagctatggtgttgggcaagttatgcataaaataatcccaccaaatgattctagaaggcattgtgcggtgtcatgactagctattcagaatgatatcatgtgggatgttataacataataacagtaatctttgcatcagtgccaacatgcattacatatctgctgttataggatgacataaatcttgacatgcttccacccacttttgcagtgactttgattcagtacagactgttgaaccaaagaaacgaagacgaaaagactcatcaagttcttatattgagaataacaaggaattttctccaggctcttcctcatacatgggcacgcctttaagagactctaaaagaagcactctccaaacggggaagagtactagtaatggtcacaaatctggagctaatggaacatttgagtacccttattcagcataccgagacaaggatgctccaggacatcttggcctccaacagaaaataacttctaatggggcgaaccaagatttgtcaaagaacatgcaccacaaagagaaatataatgctggtcaattttctggtttgcatgcttccagtaacatctattcaacagaaacaatggtaagaatcaaggaaactggtattgtgacttgtgagcatggtgcaaaccatagttatcttttcatccccaaagtacatagcactaatttattcagcacaaaagcattacaacataagacatggaagtaaacagag

SEQ ID NO: 25424 - DNA, 9160 bp, Oryza sativa
  unsure (1)..(9160): unsure at all n locations
acttccatgcatttcattttttttaaaaggatagtatcttttgttgcttttccaattctgggtcgtctattatctctgtctggaaatgatctttatttcttgaacattgaaaaaaaaatcataggatgttgtgatctaatcatccattgataaaggtagcctgtagattcattgagatatttaaacgagtgctagttaggtaacaagagatagacactctttttgtccagttctttatgcatcgttttcgtaggccttgggcaccagtacaaatattccactctttttatgtggtttcttgaactattcttatattctacaactaagtggattctagattcctgttggcatgctgaaatcttttttttttttttttttggaggggggggggtgttgcatctaaggatttgttcttgcctttgtttgtgttgacaggcatgggctttgttactctttagtaagcgtggtagaataaatatatgttgcatagtgatcctgtcaaatgaacatatattcaaaagacataccaagaggcaccggcaaaaagaatctccttgtgttgtatggtgacttggtgagttttaaagattttacttaccaaatgttttttggcacagagaaacatgaaagaaatggtgcaatcaggtttatgtgctaaacaagagaaggctgggaaattgcaacaagtgaaaatggaaatctatgaaatggtcaaagcacgtctagccaccaaacctaaggtgaaataattaccttgtcagtaaagtggtgtaatctgctttattttcagacacattgcgttttgttccagtcttcattcttatgaaaagctttggtagtaggaactcttatatctgtatgctttcagggtgctgaacataaggttgaatctatagatggctttcaggatcctgttactcatgatgacagaatggccttgagaggaaaatctgtcatggatgctgtattggaggacaggatctgcgacctgtatgatctgtatgttgaggtatagtcgtattatcatgtttacttcaatgataattgcaatgcatagccaattgcccaattgctgtgctgaaagaacgacatcagcaatagagacattttctctattttattttaccttttgtctatttttaagtgtatgttggtgaaaggatatttttttatttcccccttcaataaggaggccgctagagttggtttagaacaggagtgtcttggataaagtcttatcgttttgcttttttacttattttatatgtagtatcgcttggaagttcaaaaccatgtatttttacaaattgtgattatgcttactagcatgagtaatgcatgcttttcagggtatggatgaagataagggccctcagagtcgtaagttgtatctagaggtaccatcctgcctcttttaccacacctttttatttctgtgattgctaaaaaactcctctacatttatatgtgcctttagtctgattgagtgtttcaacttgaatcaatggattagaaaattccagccttccctttctgattcactacgcagtcacactccttagacagactgttgatcatgaactttattttccttaactcacttttatatttgtaaatttgtaatgccgacttgcttatgtatgttgggataaggggctaatttttgaccagcaaacgaattgcactggtatattgtgtcaaggatagcactttgttacttagtttaaagtgcctgtaagcaaagcaacataatttgagtttgtatgatcccttagcttgtttatatatccaactatccaagtttgctaaacagccttaagttccttaaatatttatttagctattcataattatcaaagtaaatgtataccctgttaatttctataatggatttgttttctttcagaaactttaaattttatcacccgagcatatgaatttggtattttggttgtgatcgttctctttgtgtaccgtactgtgctttcagtaaaagctgggtgaaagcctttcctctaaaattttttttgggtattttggtgatgttctgtttcaaagtgcattttttgtacaacttctccagttttcctagcgaatgtgattatacttgtccataacgctcatacaaattacaatatctttgtttctgcaccagcttgctaacttatggccacatggcgacatggataaagttggaattcgagatgccatttctagatctaaggagcgaaggaatttattatataggcagaggaaggtgaaagatcttctcttaaggcgtgaatgccattttagcttaaccatgtctttatttttaaccgtcataatcatatggagtgaaggaaaacaagtgtacaattcagtaatgtaaatttccaaattatcctattttatagtacctcattcaaaccaatcatgccattcaggtccgcaatgaccagaggatgaagaggagaaggctggctgctgctgccaagttgcgtgacagcgaccctgccgccccacaatctgcacagtccctgcaaaatatgacaagcacccataccatgtatcctgtggttaacaatggaaatagtcagagtagcagaagtgtcgacaaagttaatgaaatgagcgtcggtgcaggatcggatggcaacaggagttctaccagcatgaagaaacgaaaaatagactctgaagataggcaagttaacccaccgaaggctactgctgaacttcatcatcatggtattgaaatacagaagccggcaaagcgtgcagatgaggcaacaaaggtcagtaaccttccccagacgctgcttgccattccaagcagcgacagtcgccccagcagcagctaacgtcctgatcgtgctggcatagctttggagaacaaaataaatcatcggcaaaggtcgttgataaccaatatagtagaacacactagctaggtgattgctactgggatgctctcggagcctatttgttggcttctgagcaaccactaattcttgaagatcttgtttgatactaaaaataaggtgtatttataagaaccctctgtaacacaatgtctagccggtttcgtttttactgttgctgttatattctgcacttcactctgatagcctgcaacgtagataatttcatctttagattgccatttttcttcccctcttagactataaattgagaaaaacctagctctgtacaatctagatcgtcaatatatctcggaagcactttttaggtatggatatattcacagaataaagtgttgtgtgaatcattctgctgtcaaatctggtctcttgatttttctagaggcaagttatgcaatttatgtactacttccgttttttaatagacaccgttgactttttatcacatatttagacaatttatgtaattatattttctttttttagttgttttaaataagacgaatgatcaaacatgtgtttagaaaatcaacggcgtcgtctattaaaaaacgaagcgagtagtaacttttttgttagtgatatagcaatttttttccgttttataccccgtcctttctataaaaaacaactaagtacgaagtaccaattcgtagttggaatgtcctccatccgtctcatttttttatccaattttggtcgtttgtgttatttgaaattcttttatgattaatatttttattgttattagatgataaaacataaataatactttatgcgtggcttatgtttttattttttaaaaaaaaattaaataaaacggacgattaaagttggaaacagaaactcatggctgcgcttaaaatgagatagattgagtacgtaattcgcacggggcctttttcttggaataagttcatctgcggtcccttaactttacgtcgagttttgttgacgtcccttatctccaatattagaaatctccaccctaaactatacaaaaccgtacaatttcgatcccatggcagtatggatccttgatttcgctgatgtggcatcatagtcagaaaaaaagaaagtgcgtggggcccacatgtcgaagccctctcctcttttcttcccaagccggcgttggcacagcctctggcgctccctcggtgtagagcgccgcggccactggcgacttgcaatggagcatcagctttcggggaaattggggaggaggacagccatcgccgaagcgttcgtggccatacttcttctggggccattcccaacccaaccacaacgcggcaaagaggcagcctgtgggggaggcgaaggcatgagagggagggagaggaggccagcaagttcgggagggagggggaggcaattgttgagcccgtccgagctcacccagcctgcgtgcgccggaggtagacggcgaccaagaaaccatctcctcctttgccaattccccttctctcgctggtgatgccattcctagcatcgtcgaccacctgcggggcacagcggtggtggcggccgagaacgggggagctccctgtccatccactgtcttccactttgcctagctcgcgtcccgcctcgagccttcatagaggctgagacggacctcgacttcaggaggctcgttgatgaaggggaggaccacgatgaggacgtgctccagaagctcgtcccggacatccgctgtgatagctccccacgcccgtcatggcggtgcaagtgacagagttcttcggtcatcggtggaagctccggtggtggggacgttgcggttggggtggccgtgcaccacgccgcacctacagcagacagccgcggcttgtggcgattcttggagatgtggtctgccgccatgctcgcccccgctactaggcccgccgctgcgctcgcttgccgctgctccaccagctgttcgctctgcccgcagcccaccgccgctccgcccgccacccactgaccgctggcgtgctcgcctgccactggcctcccagtcccgccgactgcccgccggcttccctctttgaactctgaagaagagaagagatgaaagagaagaaaagagaagaaaaagagatgcgtggatcccactcttttcttatcacttatatgggtctcatatatattttttattttttattttgctgacttggatgccacgtcagcgaaaccagagatctatactgctatggacctaaattacacgattttgtataatttaggggtgaagatttatggacctagttagagattagggacctcaaagagactcgacgtagagtcgagggacagcttgtgaacttatttttttttttgctgcgcttggtgttctctcctctcgctaccatgttggcccacacatcacaagtcaacctcccttcctcggcccacttggcgagttgctccttcccgtgctccgccggccgtatagtcaaaaccaacgagtccccgacgccggcgagctccccggccgagcataagaggcggccatggcggcgggcaccgcatcgccaccgccggacgcggagcctcccgagtgcccggtgtgcctctcccccttcgacgccgcctccgccgcgccgcgggtcctcccgtgcggccactccctctgcggcccctgcatcgcctccctcccgccggcctccgcctccgcctccgcctccgccgcctcgctccgctgccctctctgctcccagtgcgtccctttctcccgcgctctcgggccctcctccctccccaaaaacctcgccctcatctccctcctcccctcgcccccaaacccctctcgttctcgcaccgccgccgcggcgccgccgcctcctcatgtcccgctccacgcggaccactcgcgtctcctctcccgcttccgccacgccgtcctcccggagtccgcttcgccgctccactcgcccgctcccgccgcgggcctcgccatcgggtccttcgcttccgacctcggcgccccgtggttctgcccgcgtggccaccccgtaagcctcctcccgatcgaaacccccgccgccgccgccaagcaggagtccccgttgtactaccggcccagccacgcggcgcgggtggccgccgcgatcgatgcgctgagcgccgcggcgagggatgaagtgatcgatttggtggccgtctcgtcgcggttggcgcggcgggtttgcagggtttacggcttctggatgggccccgaggcggctccgctgtggctgctctccgagcggcattcccgcggagtctcctgcttgttggaggagaggagccgacgagaggagacggtggctctgatcagaaatgtcggaatggaggtctgtgaagcgttcatgggattgcacggagaggggctggtactggggtgcatagggctaggatgcttctgcctcgatcgctttggacactgcctgctcgacctgaatcaggttttggccttgtgccacggggttcgggtaggggtttgctcatccaagtctaaggccttcatggctcctgaggtggcagaggtggtgcatgacaagttgcagataaaggatcatgatttcagtggcttgttagggcctagttcagatgcttggttgcttggttgtttattggtggcacttgtaactggggatgagcagcttgcagcaggatggagtactgaggggtcatacgatgattggaagaatgaagtgcttacgaaggttgatgcttcattggttggcacacatatggaaccatggtctgcaaccatagtgtcatgtttgaactatgatccagaaggccgtccagaaattgctgatgtctggaaatgtattaacggctcattgatgaattccgacattgaagctttgattcctaatgttgatcttgcagctcgaaagagttttatgtgtttgctccttggggagttgtcctcaatgtgctctaaccttggtgctgttgagtcagatgatacaatgcatctttctcaggatttggatgacaaacattcaactccagatgatgcaagcagtggtggtattataaacaacgaagaagttggtgcagctggaatggatgggccaaaatgtggactgtacaattcttcaactctgcttgctcaccgtgactgtattacgggattagccattggaggtataacatattggagtatttacaactttaattatttaaggcatatatagtgcaaaccagcaactaagttctacattgaaactattgatttggacaccattgctatctggatagttttaaaacgaaatattaatgtcatctacctagtgtttagatcctttgacaatttcatgttcaacattaatgtgtgttatgagatacatatgaacatgcaaaaaggagaagattttgaataactctgttttcgttttgtttcatttcattctagtttatcatttatcataggtttctcatgtcaaacttgtcaatgaaggtaacataaattataacttggaggtttttatgttaatttgatgttaagtaaatgttttgaaatcttgcaggtaaccgttagtttgcactagatttttgatttcattgttggcgtccttgctagagtatccgattctttcatctgtggtgttattctatggtcatgacacatcttattatgctagtggatatttttaatgttatgcacttaacaagaactgccactcaaggacttcccaataatagatcttcattgactgcaggaggctttttgtttagctcttcttacgacaagacaatcaatgtatggtcactgcaggtatcttctctcctcttctctttcttgtcagttctgttagtatcatttctatctcctctttagttttccgtggctcatttttctgacttctattggtccttgggttctttctacaggacttctctcataaacaaagtttgaagggccatgaacacaaaatcacagcaattgttgttgttgacaatgataatcagtcactttgtataagtggagacagtggtagtggaatatttgtctggtgtgttgatccttcactcagtaatgaaccattgaataagtggtatgaaagtaatgattggatttatcgaggtgttcactgtttggctgtttctggaactggttatctttacactggtagtagagacaaatctattaaggcttggtctctagaggtaaagatgctaatccaatttgctttattaattagcatacagggattataataatgttggtgtttggactaaaatttaacattagagtacagtttgccctggaagttgattccagaatgtttccctcctattatcttgataacaagtctgatttggtcattcatatggttaaggggttcatatccatttatcttaattttagcatgttatgtgaagttaattctctatccccctttttcaggattattcactacgctgcacaatgacaggtcacaaatcaactgtttcttgccttgcggttgcctgtggtattctttacagtggaagttgggatggttctattagatcatggtggctcactgatcacagcccgctgtctgtactggaagatggtacaccaggaagcattactcctgtgctgtcaatttcaacagaactcgattttgttgttgcatcatatgaaaatggctgtttgaaggtttccctatacctcaatcatgacttataatgtgaaatgtgtatattctggtcacgttgtgttataattttaattgcagtcaatgtggtttgtgcgtaagctaaatcatggcatttttatttttgtcaatcagatctggaaggatgatgtcctagtaaagtcagagaaacttcaaaacggtgctatatatgctgctaaattgaatgacaagtggctctatgctggtggatgggataaagttgtaaatattcaggtctgtttagttgctttgttcatatgaactataaaacataagcatgcattttctaaaacataagtgctctatatctaacatgtattgattaccttgcatttttcttgggttaattatgttaggagttattggaagatgattcagaggtggaaatcagagatgttgctacctttacttgtgattcaattataacttcaatactgtactgggatggaaggctgatagttggactttctaacagggagattaaggtatgtatacctctttttgtttgttgtctactttattagtnnnnnnnnnnnnnnnnnnnnnnnnnnnnnnnnnnnnnnnnnnnnnnnnnnnnnnnnnnnnnnnnnn

SEQ ID NO: 25425 - DNA, 424 bp, Oryza sativa
cgaaacttcagcaggctttcctcggattagggtttcagggttgaagatggtgactataaagtagtgaaagattagcggtatgagtttagaggtatgactataaagtgatgaaaaattaacggtaggtggtggacacaggtgaatggcgaggtgtcgaagccgcgggatggatgctggtggtgggagggggttgacgtggggtggctcgtagaagataggaatgaatttgacggtgcgagtcatcagacacgagaagactaaaaagaagtgtaaaaagaagactaaaaatttataggtatttttagacgactgaatacttaaaaaaaaagtaaattttagaaatctgcaactttagtgataaaactatcagtttcctgcaacattagcgacatgtttcaatttgctgcaacaatagcgtgggaaa

SEQ ID NO: 25426 - DNA, 26805 bp, Oryza sativa
atctagggagttaactttagtctctatatttaaataataattgagagtattaaatatagactacttacaaaactaattacataaatgaaagctaatttgcgagacaaaatttttaagcctaattaattcataattagagaatgtttactttagcatcacatacgctaatcatggattaattatgctcaatagatttgtcttgcgaattagtccaagattatagatgggttttattaatagtctacgtttaatatttataattagtgtccaaatatccaatgtgatagtgacttaaaagaagttttagtcccatctaaatagggtcttaagtaatacatatacacacgtaaaaccggcctgttcatcggagggcaatgccaaaacatagctgaaatgctgatcatagctcgctaacatgggacaagacaaacgggaaaaagaagaagccaaaaaggtcgcctctgctgctagttctactcatgttacttctaattgtgtgtactctatgtgtgctagggcccttgatttgaaataatcttaaaccatggccagagaatgtgcgcacgatcgatcacatgctaaagcagaaagcactgccttatctcaagattaaagctgcccaaataaacaacaaattaatcaaataaatgaaattcctagtagtactacaaaggtcaaaaaagggcacgatcgattagactgaattattgtggccgtgaaagcgaccaggggatcggagccaatgcatgcatccatccatgcacgcgtaggtaggtagcgatcggcgaaacgacgggaataatccggatcagagtgggattttcagcaattacctacttgttcctcaattcccttatctcatcggtacaggatgccatgatggccggactactgcttattgatttgcctctctgattaattgcttgtgtttactggaacagtgagtgcttttccactgtgggatgcgatgagattaggaggcatcactcgctgtctctgcagactgcagtggaacaattttgacagtagaaaaggtagtacagaacattgcaaccgtgcaagtcctggcagttaatttgcttaatctcgctactgttgctgcgcagtttggctgacgctgatcggtagatgctgcactgctgaaatggagagcgactccaattcatgaggaatttttgacgggtcaaagcactcaggctcttttgttcagaaagagtagtttttttcccagtcgatgcttatgctctctgcttcgcagcttcggtttctcatttggtacttgtttcgtagggttgatatcccagcccagcccatatccagagatgtcctggaaatttctaatcaattcccagcccatcctaggtctagacgcctagttaggaatgggctaattacggggctgtttagattgatgttattttaaaccataccattttttggtaaaattgatgaaaaaatgtctatgcttagtttgttaccaaatttagtaaatacataagaaatcatgctaaaattttgacaatattgtcatcttgcaataccaaaatttcaaaatttggtaagatttattttggctacaatctgtacgtgccctacagttccaatcacaattattatggcctaggatttggcccataaaaatatttttacatgcatgctcttaattttggaaaattctattttgcattccacgactctagtccaaggttaagacggcttattaagaaataaaattaatttattggtaaaatttttatatatgtacttttagtgacttaaaagccattgttgaaaatgaaactattgaaaatatctaaaaacattttaaaattaaatttgaaaattctaattttagctttggcttcggcttatttgaccaacggatgggcccctaatgatcttccctcaactataaaacatgatgtggaactccctcatctaccaatacggttcaatttacctctttcgcactggattcgtcctatgtggtgtgttgactgggtcaatccgagttaatttgatatttatgtctctcacgtggcattacgagcaaaaattaaaaacaaaatattcactgagtcatgtacacctacctctcaattcctctctccctactttccctctgacatcagctcttgggacgaagtggcgtcacgttgccaggtgaaggaacgaagaaagtcgggcttgagcccacggtgctttgggagatagatcgatgaggaatttttttcatttatatatttttttattaaaatatttacaaaaataattttttgttttgaaaatttacaaatctaatcccctgccgtcctttgggatcgcccttccaaagggcgacaagggacctaaatgcaaattttccagcacaacttttagctctatgattttacaatttaaaattatattatataaagtcagatgaaataaaactttatatcaaaattgtagagctcaaggagatctacaactttgtagttaacaactttttcatttaagatgttttagatatccaaatattcgttacaaaatataaaacatatttcaaaaaatctcagatctacatttcaaacgatattggatggagataaactttatataaaagttgtagatcttaatgagatttataactttgtagtttatcacttttccatttaaaatcatagagtatcgaataagcattattagtttttaagcaattaaaaccagtgaaaagggtttgaacacaaataaaaattttgcatttaggtcccttgccgctctttggaagggcgatttttaaaaatcgcccacccaaagagcggcaggcaattagatttgtaaatttttgaaacaaaaaattatttttgtaaatattttaataaaaattgtataaataaaaaaaaattcgatcgatgaggcgcctgaggacggcctactagaggtccccatgagcagtgctgaccttgccctcaatcttgcaatcgatggcctcgagctgcacctgcaacatgcggaaggtgtgggcaagagagatttcaatgtcggtgaacaaagggttgtagcctgcatgcgggcatggtcgactggcaccggtagggcagggtgcatccaatgccaagcaaggttggtcctcctatcgatgggaagagatgaaagagggttgacgacaaagagatcatttacatatgggtctcactataatttttattttcattcttgactgtaatggcacgtaagtgccacatccgattttttttaaagaaaaaatttcccgctgatggaaattgtcgtgtgagcatcatgtaggatgaaaccacagtcaaaattactcatgatggcaaactgcaccaacattgattattgagggaagcgttgtattgaggaaggaaattagactcgggctatagtagagggacacagtataaactttatatgtttattatcccctgaatttaacagaaccacattttggcccattatttgtttattcccagattgaataagtttgaaattcgtccctaaaccgaaataccatatatataacaggttgaatccaacacgaacagcgggccgtgcatgatgtcagagtagctggagaaggagagggagatgtttcggctagcggtgggcggtggagagaacggtgctgacatgatagagtaagaagggttggttgctgacatgtgggtcccactcactacatcacccaaaactagccactatatcatcaagggaccaaagttgacatggtgttatgagttgagaggtaggttatacccggtatttcggtttaggtttcagacacagcaataaattgagggacctaaactgaacttattccttcccagattaatacaacccatcaacgcatattacgatccttttctggctatgcacgcagaatgcatacatgagttattatatttgggcgtccatttatttggtacggaggaagactgataaattagcacagcccatttcagagatgaccaggaaacaggaataagttcgtccgaggttcctttaacttgtcaactgatccgattttcatctcaaccggaaaaccacatacaacaggtctctcaactgtcaaccagttcaatataggtcccaaggcagtttgaacggtggtttcagctgacataacgcctacgtggctaaggctgtgtttagttcccttcaaacttccaaaaattccgtcacatgaagtgtttgaacatatgcattgagcattaaatgtagataaaaaaaataattgtaaaatttgcatgtaaattgcgagacaaatcttttgagcctaattacaccatgatttgacaatgtaatgctacagtaaatatttactaatgacagattaattaggcttaataaatttgtctcgcagtttacaggcggaatctgtaatttgttttgttattagtttgtgtttaatactttaaatgtgtgtccgtataataaaaaaatttggcgcacgaacaaaacacggcctaattttactcggtgctcattatatgaacttattcggttattccccaggaatatcaactaaatttccagcccatttcgggtctcgttactcgttaggcatgggctaaatccaggtttatttccattggtaggccgtgatttggctcatgccaattaggaataagttcatctgagatcccttaacttgtcaacgaatccgattttcgttcctcaaccgaaaaaccagacacaacgggtcttattaaaaccggtgcagattaggtcacttggcggttttgagggcggttttcgttgatgtggcgcctacgtggctaatttgactcggtcttcatctgacgtggtattgacgtggcacttacgtggcaattcgatctaagaaaaacaatataccccgtgggacccacgtgtcagtttaacacgcattaataaaaaatgtgggggccgtgtgggccccacgtgtcactctatcactcttcttctcctctctgggactccgagcaagccggccgacgggtcacgccacgcacgacggcgtcgagcccgggggcggaccagggcgaggggacaagctcaacctcggcgacggccacgcggtcgaccctggccgggaaggaccccgtcacggcatcaccgagtgccgcggcgtcgagctccatcccgcgtgccgacgaacggcggcgcgaaggcgtccctaacgcggtcagtgtcactgaggcccaggttggtgctgatgcagccggcccgcaactcggcgagggagaccgcctgcgcgatgtacgtgtccagggactccctcgccgccggcgggatgtccgggaagtcggcggcgttgttcttggggcggtgctggacgaagtaggtggcctcccagtcctgatgagaccatcaaagttccatctatctctatcgatgcttctacatgtttgcataatagctcatctaggagtattgttcaggttggatctttcttttgtaccgtgcaacaacaaaagaaaggagaaggcctagctgcgagcagtacttttataggttaattaaggtaagtgttattagcggcatcgttaccattaatcacataattagattactttttatttgtttgtttgggcctgctcgagtaggactttggtcctgtattgcctgcgtgcaacataaaagcccaatgtggcctgtaatgagagttagtttttgcttttggtgaagtcgtctagggtttattcctgtggaactggaggatggcgatcccatcctgttgatttgccgctgccgccgtgaggtgtggagggagcacacgtccaggatacttctccagggagtgttgcttggagtcaggattggttccatcttctctgatcgtgtgtgttgccacacgggtggagttgcagatcgttgatccgtatcagtgctttaaaactactatctggtattgctgtttgttttgagagacaaaatcaattcactgcgacgctcatatacatactgccggttaatatcgttcttactgctttggtctgctcatttgtttaagttggaaaaataatctggttgggttattcagttgttggtaccgtgaaagagagggaaaatcagggcattcaccgccgggtgctcatcaagtcccagtcgacctgatcggcgagggcgtcgtagtcgtcgtccttgttcagctggaggttcttggcgaggtcggaggcgtagaacttgttctcgagatgctcgtcgtagtggcgagccccttgagatcaatcaccggaatctccatctctcccaaggctagctagctacttctacttgtacgtgtacaactgcctagtagtactgtactactgctgatgatgagccaacttatatgcaacaagaagatgatttgcttccgatgagcgagtggcatgcagctgggcagcgagaggcgaggaggccggcagcgagcgcacgcgaagagggaggaggtggggaggccgacgcgagcacacggggagagggaggcggcggcgcgggagcaggccggggcaccgagtccaccgagtccaccgccgctatgtagccccttctcccatgtcgcccgcgctgccgcgtcgccccttctcccgcatcgccgcgtcacctgtcgatggccgccggccaccggactgcattctctcccctctcctctctctcagacgcgacggagagggagcggcgcatggcggcactggcgggagaggataccgtcgaggtcgaagggccgcccggaggacggtggaaacgggggcaggggccacgatggtgagggcacgccggcctcgggccaccacgcctctgccggcgctgtgccgccgacgtcgccgtcgcaccccggcacggcgggagatgaagcgagggaagatggggagaggagagggggagagagatgaagagagggagatgggtgagaatgacatgtggggtctacgtgggcccctactattttttttattaatgcgtgcgaaactgacatgtgggtcctacggggtttattcttttagatcgaattgtcacgtaagcgccacgtcaatgccacgttaaaatgaagaccgagtcaaattagccacgtaggcgccacgtcagctaaaatcgccctcaaaaccgctgagggacctaatctgcaccagttttaatagttgagggactcgttgcgtctggatttttggttgagggacgaaaatcggattcgttgaaaagttaaagggaactctgatgaacttattcctgccaaaattactgcacacacatgaacttgcaaactagaaccaagatgggctggacaaaaagctcccagcgattaacacgcgcgattcggcccattatttatttattcctaaattaacacagtccacgcggtctcccgtctcccagacaaaaaaaaaaaaaacacacagatcacactattcggctacttgtcgtcttctgacccgaccggcttggcgacgagccggagagggatccgccgccgcacggtgaatcccgggtcgtcggacatgtcgagctccccgggcggcgggatctcccagtcgaagaggcggaccaggctggccagcgcgagctcgacggtggcgagcgcgaactgcatcccggggcacacgcgccgcccggcgccgaacgggacgagctggaagtggccgcccctcaggtccatcgcctccgcctcgccgccccccggcaagaacctctccgggcggaactcctccggcgagctccaggcgcccgcgtcgcggtggatggcccacgcgttgacgaacacgcgggtgcccccggcgacgtggtaccccagcacggtggcgtcgtcgtcggtgtcccgcgcgcactcgcgcgggacgagcagtggcaccggcgggtggagccggagcgtctccttcaccacggccttgaggtagggcgtggcggcggtggtcgcgccgccgccgcggcgcacctcgtcctgcagcttccgcatcgccgccgggttcttgacgagctccgacatggcccactccagcgtgatgaacgacgtgtccgtccccgccgcgaacatgtcctgcaagagcgacttgatgatgtccctcgtgagcttgaagctcccatcatggcgttggctctcctcctgcagcgcgagcagcacgtcgacgaagtcctcctccctgtgctcttcgccgccgccatcgtctccgccgcgtagcctcgcctcgtgctccgcgatcacctcctcgagcagctcgtcccaccgccggaggttcctgcacgccctcgcggcgaacccggagaggaacgcgtcggcccacgccagcgccgggaagtagtcgccgacgcagaacccgccgagcagcgtcgcgttctcctcgatgagctcccggaacagctcgctcctcccttcgtcctcccgggagagcctcccggacaccgcccggcagatcacggcgttggtgaacgcgtacagcgccttgctcacgtccaccgccgccgcggccgcctcggtcctgatggcgttgacgaggagcgcgacctcctgctccctcatggggccgtagcggtgggagcgggcggcgctgaggacgtgctcggagcagaggcggcgggcgtggcgccagtgctcgccgtagggcgcgaagacgaggtccttgaacccgtaggtgaggatctccgccgtgcggaagtagggccgcgtcgcgaacacgtggtcgtgctcgcgcatgaccgcggcggcggcggccggcgacgaggccacgagcgcggtgacatggccgaggcggaggcgcagcaggtgaggcgcgccggtggccgcggcgagcgcgcgcagggcgcggtgaggcagcgcgcccacctggtgcaggttgccgatgacgggcagtccccgaggagccggagcgagacgccgccgcgcgttcccgccggagcggagcacgccgccggtgaggtagaggaagccgaggaggaggaaggggaggaggaggagcacgggtgagagctcgatctccatggctgtcgctgcagatcttgcagagcgcgcactcgtttctttgattttttccgaacttaaactcaacatcgacgtgatgacagtagggccctgtttatttcacaaatataactttttcactatgtcatattaaatgtttgtacatatgtacagtgttaaatatagaaaaaaaattaattacacagattgcgtgtaattgcaagacgaatcttttaatcctaattgcgttatgatttgataatatggtgacatagtaaacatttgctaacgatggattaaataggattaataaattcgtcacgtagttttctggcggaatctgtttgttttgttattagtttatgtttaacactttaaatgtgtgtccgtatatctgatgtgacacgtcaaaaattttcgtttgcgaactaaacatggctctaagtgcccactcctcgtgcccaaaatatataaaggatttttacgagatgtgatacattttaaaactacgaacctgaatatatcacattattagtattaggatgtcacctccaactaaaatccaaaagttttgtcattgccgtcattttcttagtactagtagtaggtgtttgccttatcttatggagtactcctccgtatttatttggcttttggagattttgcgcagaggatttgacatgtactccgtatgtagtcgactccgtatgtagtcgtcattaggtcactgactcactggagatcgaccagttggctctccatctgttctgtaggcggctatgcgcctatgcctcataatttttgtggtcgtataatatgcagttgtatttgagttattcataagattttgtaaataaaatgttgtgtatctttacgcatccgtaagaccgcgtctcatttgatttagatattaagtatattattgctactccttctattttatattataagttatttttcttttttcctagtcaatctgtttttaagtttgatcaagcttacataatattccctccttccaaaagtttatgtcctattccattgtttggtcttttcaaaagtctaagttctatttgtagtcactatgtgccatattaatttttttatcagaacctaagaaatcattttagcacttattggttgcatgttcactagttttatcacatgaatgaattaactacaccttagttttggtaaaaagaaatataacttagacttttggaaggagtgagtaatatagtactagtattttactatttttaacataaaacaaacatattatcaaaatatactcaacattaaatttaatgaaaataatttaatattttagatattgctaaatttttctataaattagatcaaacttaactagaaaaaaagtcaagccacttataatataaaatagagggagtacttaaaaaaattatctacttgattatagagtaaattaaatatttttaaaaaataaatattacaaatagtttaaaataaatagtctaatgaatgcaatggaagaaaatattcaaaatattcatggaacgaacaatctatttcaataatgagaagagttggagttaagtgttcaattggtctcgtataattatgtgtataaatattagatttgaggataattaactaccgttttaattttatattaacaaattttattgcctttcgacagaatccaccacttgagttgcaaggaacacgtatgatggaaatgaattctaatatcacgaggagatgtcttcttattcttgtatgtcttccaaacagttataattgctttaaaaaattaacaatataaattaatgtgtgatatattattttaacatgcaagtttaaatttgatcttcacaagttctaaaaaaaacatattaaactcacaattatttttttaacttgtaaagttaaacttaaacttgtatatttacgtagtaatgtaccacatattaatttagattttttatgtttttataattatgtagatgatacgaaagaaacgtctcctcgaacgattaaaaggtttcatggttctgaaagagaaaacaaaagaagcagccagtaaagcgtagctgacttaagaaataaagtatacttctgctatattatcgtgttaagcaagacctgtaaacaaatttagtgtcagcatcaccttttaaggtctgtgacctgagtttttttcattttagcttcagaaggattaaagaatgatttggggcagactttatagggattgtttaaatcccaccccaaaactttacaccctatcacatcgaatatttagacatatgcatggtgtattaaaagacaaaccctgatttccgtatccaacgtttgaccgtccgtcttatttgataaaattatgaaaaaaattaaaaagataagtcatgtataaagtattaatcatgttttatcatctaacaacaatgaaaatactaattataaaaaaatttcatataagacagacagtcaaacgttggcacgggaacacacggtttgccttttttgggatggagggagtatagtctaaaagaataactaattatttagattgcgactactctgcgagacgaatcttttaaatctaatttgacaacgtggtgctaaagtaaaacatttgctaataatgaattaattaggcttaataaattcatctcgtgatttactgatggatattataattagtttttttagtacataaatacctctatatgacaccctcgtataataattaaggtgacacgctcaaattttacacccaatcaacaaacccataccggagggctggagccatggctgtcgactgtcgtcactcatgacgctgagtgcaggttcgtttcttcgatttttctggagctcagaggtgatggcagcaggtggcaagccattgccgtcgagtacatatattttccttagcttatctctttgtcctttggagtttttgcacagaggattgacaagtagatagtcgtccatgtcacttgagatcgggttgttgacttccaatagttttgtcggggcagtaccggctacaatcagtggtacacagagaacaaaatgcgcaggagtcgtgtcacatgttacagctgatcaggagtatgttgtttgcgcaggaataattattttccgttgctttcaaaaaaaaattcatggcttatgagctgtagagccatgctgatggcgtcattacgcagaagacaagcatcgctttattttatcgacaaatatactctattttttattctagagagattttagctttaagtgatgaatactagtagttacttcatccgtcccagaatataaagagttttagacttaaacacggttattaagaaaacagctagaagtgaataatggatggttgtgattggatgggtagtggaagtaggtgagaaaagtaaatggtggagggttgtgattagttgggaagagaatattggtggagaaattgttatatttcgagacaaatccttatagttaaaagttgttatattttgggacggatagactaataatagtaactctatcttaatatatagcaatatagtatcaaatgggatatatttttgtaatagaaacctgaaccgaacttatctatcaatattagtagtaacgagatatacctcatttgatattaggttgtttcatttttggtccatgagatggatgtttgatgggaaaagttttttatctactggggtagacagctgcacaccacacgataagtgattcgtgcgtacacccgaccacttcccggtatttcccaacttgcccgtattttgcccatttgttagcggaccatggaaatactttcatgcttgaggtcacgactatagtatttacatggcatgaagatcattgataccagggtatatgcgagattgagataaaaaagatagagacaatgatttttatacaggtttgggccccttcacaggaaggtaacgaccctactcctattggccgtagtctgtgtttttctttattcatctgaatcacactaagtacaatatttgagataacctatctagatgtcgttgacttggcggcatggatcaccaacacatagtcaacgacagggtagttttactcctcgagtacgaactcgtcgagattagagatggcgctagatctctcttgttggcctccgcaggcaccagattgagtctgtttaggcttatcactgatatcaatgtctggtggcgtgtgttggtgtctattctgacttgtgtgtgtgttccctctctccccctatgggtcttgtatttatacctatagatgttcccttgtacaagtagtattaagaagaccaatatagatacaatccgagtagtccttgtcgttttcatatagaactctactcgtacttccttatccggaactccttctatatatgaggtacgattccgtataagatttggtatatggtgggccccgctgagcttagccgattactattgggtacgtggtatccataaccatgacaaatacgactttatacgcggatcctacctcgtacaatcgcactggcgttcacgggggcatacttctccctcctcttctcctcactgacgcctctttccctatcacatcgccctccgtagtgcatcttcccatcctagactatgcatatcccttctttctataaagttaaggccaaaagctcaaacctcgtgcttccacgtcatcatcaaatagtgaaccgttggatgaatatattagattgcttctcagacgttggatggaatgcagcatagagcccaacccattagtcaccgggtgagtctcttcgcctcctcagtgccaaatatagcccacatgaacacattggcctatgtccacacacatatacatgtatccagcccgtcactccgtataaaagagctttatgctgaacgctctttcagttgacatgtgttacctaaattatctacaaatttttgatagggctgctaaaaagaatttctccaagaaagctatttgtttcttcttgatattatacttcttatctaacaaattgatgttaaccaagtcccacagcaacacgtggggcatcctctcgttgtatatactcttcccatccgttaggaatgctggcgttatagttggccaaatgggccgcccggcacagcacggcccaggccccgccgtgcctgggccgaggctagtcgggctagcacagcccgaccgacacgctgggccgtgccgtgccagcccatgtgctgcacacatggcccaggcacgacccaatacgactcgggccgtgccgggctggcccgaaggtacaacagtccattgtgcttgtccatagaataagtatatttttcatccctcaactctgtgggctgagttcatatggctagaaataagtctattttgtatttctcttctcattgggccttatcttatatggttatttaagtctatttttcatccctgtactttgtgtttgtccacagaataagtatatttttcatccctcaactctgtgggctgtgttcatatggctggaaataagtctattttgtatttctcttctctttgggccttaccttatatggttatttaagtctatttttcatccctatactttttttcttcaatcgtgccgtgccgggccagcccaccgtgccgaaggtgcagcccaggcatggcccgactgtcgggccaggccggcacgggcacgaccccagtcgggccgtgcttgggcctggccaaaacggcgtgtcttggcctggtccacgggcctcgggccatatggccatctatagctggcgtgctcttcgccaaccaggaacgaaggaaccacaacagcgcacaaacagtccaacgattggttagtgacgatttacccatttcaacattttgctcctctctttcaatatttttctcctttctagaagggttttttgttttaaagtggcatagtccagacaaatccgtttacctgaaatccatgtgtaacctcatctctcccactttttatctgtagccaattgagttagggaagaggagggtttcgtgggacgaacgttcacggcctagaactaccaggagcaagacgtgggtgccccccttgaagctgacgaagaggattgcgattcggtggttgatatcgcgctcgacaggggcgccttggaggccctagtgagagaagtaaaccatggtgttgatgaagatgaagatggagccaccagggttgctacaatgacaagctcagttaggcatgcagtcaagataatcacgaagtttgacgactacaaaagagacggcggctcgacgacgccgtgtgcgtattttgcgcttaggtccttgccgtcccccgcaatgcaatttgcgcccgacgaaaaaagcatttggctgggttttttttgcatctgggtctagatgcaaaaaaacaagccaaatgctttttttttcagctctattgataacagttaaagaattatttattggtaaaacttgttaataatgttttaaaaaatgtattgaggtcggttgttttgcaatttcatattttaagtaagagtttatggtgtaacttattcgacgtattagtgtatgaaattgatataggcctatcatagtttcggtcgtagaaacattatatacaattaaacaaggagaattatgtcatgtatagaaatagtagtagaatttgaacatgatacatctggttccattgcagttacatatataagattagattcaaactaggagggaggtagtgcaagagttgaacacaacgatgatgtagtaataggacaaggaagcatgacattacaaatttcaataaggtaagttgtccgataatagctaacccctacatgaggatccctctcctctctcaaactgcgctttagtaaccctgtattcctctgatagttcaagctgcaccacacggctaggtggagttagaacccttctggtgtctatccattctctgtattgacatctccttggtggttcctgtgaaaaacgaatagatgtgaagcgaacaaagttagtaaatgttgggagaaaataaggattcatgataatcaaaatattcttactatgaaatcgtcgtctagaatatttggacaaacaaaaaaaccttcgacccaaagtcgtaggcttcatggaacgaagaacctgacaatgatcatcgcatctacatcttggacgggcttcccatggagggagtgccgtagttagcacccgccagtcgcactgttgttcacgacgttgtcgttcgtaagccgcttttctctccaagtattgctcagtactttcggatgcgaaataccaacgtccttattgtaaacaagtggttaggtcgagaacgggattttctgtatcgacccactcgatgtatccgtaagccgtagcgtgggtctgacgaatagagtagtatgataaagaataaaacaattgcccatataaaatgaataagcatatgcagataataaaataccttacggtcatagttagggcacctaaaaaagtgtcttcctcgaatgtcaggattcatcgaagccattagttgccatcggtcaccgcaaaggcaaagaggccgttggcaccaaggtggtagcaggtatgcacaaggatcgctatgccaattcggatcctcaacgccccagcatctagccattgccaaaagctggtgggttttgtaatgaaaccagtgagaaagagagtattgaatctgaccgagttatgaaagattgtgaggcatcgctcgttatggcaacttataaaatcacagtgataaccttgacatgtctacatcgcaggccatggtgggtcagcctgattggcgccgaaagtaagattggacgtatgcgggccatggtgggtcagccattccgcagtcgtatcgcacgcgaataaaggaggctgcatcggtgtggcagaaagtactcatgcatgcaccgaaaggtatcatgctttcgtaaaaagtaacagcgaagtttagggatgcaaaacccgaatagcaacaacgtattcattctacaagcatacagtactagcatgtaaagtaaataaacaaagagaagtctgctctactggccctgccccgcgccgcgaccacgcttggtcctccgggcctgtgctcacacgtggtcctgggagtacgtgaagcgatccagtggcacaacacgggtagcacgagtatttggcggcggagtggagggcaactggtcctgcgtctacaccgactggtccgatgacgtcctctatcgagtgctggaagtcgaagtcgctgatgtcgaagtgcaaggtggaagcccacccgtactccgacgatgtcccggcatggtccagtggtggaccctgactcgacgtgccggctgcctgtgatgaagtcccggcatcctactagaattgcgcagagtgcgaggccgacacagttgcctgagacgctgaccttgcagcctgggagaagtgggcggcctgtgtcgtaccgaactgggcgaaacctatacatcgacaacaagacccttgtaagctaacacataaattgcatgtaaattgattgtcgatatagtgttgtttttttagtacctgtgggggcacaataggaggcatactcgtggaaggcggggtggtgaacggtgcacgaaaccctgaagcaatcggattaatcggttcacatatatgtgtggggcatgtaaaaataaaccttaaatatacttacctccgtggggagggggagttagcctaggaacgtgtgcagctggacgaggaccagtcggtcggggtggccgctgtggtgctgcgtctgcctgagcaacgtcgacaggacgacaggtggacgctcggagaaccgagcacaccgagtccagtattcgcgtgcacgtcgtcaggtgctcgtctacaagtactgcaatctccttggtgttacaataaattctaacagatctatcctaatcggcccgtaacggacgtttcctgggccatggtatagttgaaatatatgtttgttggacatttctgtcaacgaaataactagatcattctttcatgtaataaatgcccaaaatgtaatatcttgttatgtatgctaatgtaatggtactcaacaacatttaaaactacaaagactacagatctacgtagttacgtatatctaacaatacgcagttctacagtagtacaactaaaaccctagataatataatacatttattcaaacaaagttttaaaaaatacacactagttaattaaataatcacatatatgatctatgaatattacctgaaatcagagtctcaaatcggcagggcttcgccttttcttctcttctcctccccctctctttttttttctcagagtagaggtgaggagaactgaggagggtgtgcagggcggcaagccttttataggctaggaggcctgccaccctagcagagggcggcaaggggccgcctgcaaaatggcaggccccgggctggcttttttgcatggaggcccctagccgcccaggcagtgggcggcaagggtgttaggtgcaaaaaaaaaactcatctttttgtatagggcggccaagtcagcttgccgcggcggcagggtctatttttgtaattttttccgacgatagattatttctgtaaatattttaaaaaaataaaaatgaaaaaaattctctggacataatccgtggttatcaggctgtgggccatcgggccggtgctcttgagggccgaaacctcgccggcccagcgcgcggcaccaatcgcccgatgcgcagccgcacctgcccgcgtcgtacggtgtactgcccatctccgccatagcgtcgtacgtactacacgcgacggtcgcgtatatacatgtacgtcgtactcccccgaacgccaagagctaacccatagagagcaacatcgacataaactatcatcagctagctgcgacagcgagctagtagaagccatggacatgggcggcaatggcatggcgatgccgccgccgccggcgccggtgaagaaggcgcggtacatgcacatgaccttcttctggggcaagaacacggaggtgctcttcaccctgtggccgggcgccaggggcggcatgtacgcgctcgcgatcctcttcatgttcgcgctggccgtgctcctcgagttccgcggctaccgcgtgctggaggcgcgcctcgcccggcggcgcgcgccgcgggcggccgcggcgctgcgcacggccgtccacgccgtgcgcgtcggcgtcgcatacctcatcatgctcgcgctcatgtcgttcaacggcggggtgttcctcgcgatcgtggcggggcacgccgccggcttcctggcgttccgcgccggcctgtgcggcggcgggccggcgccgccgctggaggaggaccgcaagaacgaccccgtgtgctgctagtatggcttaagctgtctcgctcgtcatggtgttcacgtggccttttcgcttaatttgttgatgttttgtgtgtgtgcatataggtttcaggtgattgaaatctttgaaatttgggtcggatgatcgagtttgtttggttgttttgtttttctctcgtaaggtctacagatgtgacatgaaagttaatttcttgatgtcatcttggcttggaatctattactagtggtgtctgtcaaactgtaattgtatagcatatgtcactcatttgattgatgctgcctcccggctttagtttcaattgtctcagattggttattatagtgtacctgcaaaactgttcttcaatccaaactcgacttgtttgcatctggattcaagcattcctatgatacatgttcaatatagagtgctttctaggtagtgctactatttccttttctcgtttggaagattttcacatttatatggctgctctgaaattcacaactgttctatacaaagagttgagctggtcaaaattaaaatcttaaaacaaaacacacgagattgaaccgattagcatactccagaatttcaaaactgtttgatcaccgaataccctcttccgagtttcgtcgataatagcgactgcggtttgctattaatgtgagtatttctatttaaagagtaggatccacactcggttaccaacgaaaccgggcggaattcttgaaatttgttaaaacttgaattatagttttcattttaaaaatttgaccatttaccgagcggtttcttgattcgtactggtcgaataagactgataaccatgataatgaatagttaccgtcccacttgttaacccagccccgttgaaggtggtcctttattaacctttgtcggagctcactgtcaagtgtcaactttctgatgttttcttacattatccacggctgtattctacgataatgcactactaaacaacccaaataatgattttaccgtgcccactgaaagcagaattaatctatttcatggtgagtgcgtctctgaactcctggctatggattgtaaccctaattctgtgagttaataaagcttcctggttttcccaaaaaaaaaagaattaatctatttcatcatataattgtactactcaattgggctaaacacctcggtcacacgtcatgcgtgacaattttaaatcacccccatccattttgcagattggcaactaattggtaagttgtgcttcattgcttcagacttaaaatctgcccacttgtaaattcttaaatactgtgttgataatggaagcctccatagggaaagtttattttttctttcccatggtacaaaggattttcccccattgacatgctgcatccgacacgttgaatccacttctatcttctgcttctcgctctcttgcaattaggggtgaaaatggtacggaaatttccgagatttctaatttttgagatttccatatgttgtttctagtttgcactgatcgtttcagtcggtgtcggtaaccgtcggtcggaaatcgaaatggtaataacttttagaaatggtagcgaaaatgggatggatacaaccgttttgccggtaaccgtatttgtacgataacctccatcaaaattatgaaaaaattccgaaaattccctagcgggtcagccagcccaacccatcggaagcccatgagaggaggaaaccaggtaggtttgcagcccattataaaggggaagtgattagggaaaagcgttgttaaccctaagacgtgccatatggactttgttgaactttggtctcctcaacttattgatattgaaatattattgaactttgtttgtattattcgtcaaatttattatcatatcattaataatcatataacggtgttatgtggagtgtaatgatggaagactgaagttataaagtcctcttcatgcatagttaaatatgtgctatgccacactccgctcattctgacatgaacttttgacttctgaccaatatcggtggattccgttccgactacccgtttccgatattaccgatatcattactgtttcggatcccattttcgagaaaaaaactgaaaatgaaaatggcatacgtttttccgaccgttttcatcccttctcgcgaataccttccatagcttgtctaggtgggcgtgccttttcatgggcttcacgctctcaacgtggcttagctatatccagctggaaaatgtcaaagatttccttagttctaggcaaaccaaaaattcccggcttcaccgctgcgtcacgcggtcacggtatggcctgtttttacccatgcaatgcaatgttcaaacaaagaaaattactaattggcttcaagataaggccaacgaagcgtgcttttatttgtgatctcttatcagatgaacctctgatgtatacgggggttgagtgacttgtcttgtgaacgggatgttcttccaatttgagccatctcaaaaagaggcaaggtcagagagctgatcggctccacgcctcgacccgacgaccaatatctcaaaacatcgaggattgcaaggggcaacaatgactacagacagcatgcgctctttcaacctcttcttgtattatgagtgagctatttgcctattgtatttgaaagaatacaacagttccagaccaatgacctctatggctcacagcgatttacagttcagaacttgggattcttggccatcctggttatctcacccgaagatatgtataataactgatgtaatgacccccaaaattttgtacggatgtctgaaaaaattacagggggggccgagccgttacctttggatcctacagtcaacctatggagtgtgtatccaatgaaagaatggagattcttcccttcccacattgaggagctagcgttgctgctggagtataaaccttgaagcacggttgcaagcattagcaggttataatgtcgcacgaaacgattccgtggccctcggtgacctgagtggaatgccatcagcagcagatctgagaggaattccttcagcagcataaccatcctcctcggcgtgtttaggtagtcggataggtaaatttggtgggagacctgcgatggcaatgaataagaatttaccaatgggtgctatttcaagtcaacacaagatgggacgaaaggcagtcataccatccaccatatcctttgtcttgtgaagaagaaatgtcccagaaaggattgtaacaaaaccgcacatctccgtgacaatttgtgttggatcttgacgatcccagtcctgcatgcaatcagggttgcatcaacagatagttcagaagcattgtcaatggaacacaataaggggttgactgaaccatgatgcgccattctgatgatacagtttgccgatagaatttatagcattatcatgattcagaaattcattgtagtatgaaaggcctttcaatgttaatgttatgtttacatgtatactgacaggcctacatgtcctattcagattagagaacatttttagatatatgggccccatataagaggagtttgaacatcaatcaggatatttaagtgtaattgaatatcaaacagctacagtatcacattaaggcggcagttgatgcagcaaggaaacatgatgggtagtcatctaggaagatggaacaaaaagttcaatggccatggtcaaaaactgaatgccaaaggtcccaacatgtttttgaaaatagtccagaaggataagtcaagagttaatttgatatgccaaactgcgctatcgatacacaatgtataaaagattgatttccattcaagcagcaaattcattaaaaagaattaagtatacttctggtatattgacatattgccatattaaacaaaatcagtacaatagtttatagtgtcgccatcaccttttaagaaggcagctacatggtgtttgtattaaaattatgtcaacaaataaattaagcccaaaacctgttaccttgaacattatcacactggccaaaatggtcaaggatgtaaacatcgtataatatatgggcgaaaccactgcagtgttgaaagtgtcaagggcctgcaaaagtaaacagtcaaattcaaagtcgtatagagtagaagacaaatgtacaagacttccatatagaaaaacaaaatcagtctattcatcgtttatttttttctcttggcatgcccaaaattatcctacaacatagatattgatcataccttgttcagatagttcatctgtgttactatgcatgcaactacaaaaagtaagaacacccacatctgtggataaacaagctggttcatccctgaaaatgtcagcttcaatgctatcccaagagctttgacactcatgacctgccagagaaagaagtttacagaatgaattcatttacaccgtaaaccgactaagaaggatattgtgaaaacgtatcaagaattattaatgacatgcataccgataaggatcccacgagagaacagacaccaatatacaccatgatatgggtctgaccatattgtgggacaaaatggaatatgagcacaaaagctgctgcaagcacaatggctgcatatagtagaaatgctggaacataaaggtttaaatattagtacttgaaaaaccaatgtctaaatgagtcactattttctaatatttgttatattattatcttgtgtacatggtaggattatacctggttcagtagctagatcccatacttctgccacagactcaatttgacgctctggaggggcatgaagcacaatacttgtcgaacccacaacacaaagaatacacccgagtataccaaatatgtgtagcttctctctcagaataatgtgtgcaagaacagcactgtaagaagggatgccgatattatcagatttacaggaatatacacagaagaagatttacaggaatatgcacagaagaagattttaccataccacttcagtcatacaattctagtcttacctgataattatgctaagtgcaccaagtggagtgaccaagatagcaggagcaaaagcataagctgcgaagttggcgatttctccaacaatcactgacaaaaagcatagtacatcaattagcactatcaccacagatggaagaactttgtcaaccagtatattcatgcatgaagaaaccacttacttgctgtcattcctgcccaccacaatggttcaagcaagtaagagtagccaccaacacctgtagcaagtcaacaacataagcataattactgaaaaagctgaaacccatttggccagagggtagcaaaattccctatatggtacttccgtgactaaccaacatatcatgggagaccaattacacaacgcggattgatcatccatggaagtttaaagcacaaaaaggcaacaaatagagcaacagcaatcacatagtagttttttttttctgcttgcaaccatttctgcaatcataggctcctcctaccgtcaaagattttcatattctacagccttccatgtttgtgtaagcttgttcaaactgctaattttgacgcagaaaccatagataacgaatcgcaatgcagtcacattataaacaagaggggatattgcacatcgtgatatcaccactgcgccatgaactataacaattgctactattgtactattactctattaatcatcttgctggaacatcatcatcaactgagctagtcctacaagaacaactatttcttagtacccaaacaactacaggcttaaccgacagcccgatctccaatgcgcgtgcagcaccaaactccctaacaccacttggccaccgacaacacgatcaagatccaaatctcgcggggctcagatctacgctacagagctagcaccgcggcagcagcagcagcagcagcagaggagagcgtgggcatccctgcgattcgcttgggttgcgagctgagaaggggttaagcggaaggcggaggtggaggtgggtgagagtcacgtcacgcacctgcgcggacgccggaggcgccggccttcttgaggcccttcttcttgacgatgaagctggcgccgatgaagaggctggaggagagcgccagcaggaggcccttgacgttgtccgccgacatcccctccacccatctccccagcctcgccccgcccatgccgccgccgccgccgcccgtacgcctcccctactgcgccctcctcctccgccgcctcctccgccgccgtccactccggccgcgcatgcgagatctgcaaggcggagaggccgccccgtctcctccctcagcttgctctctgctggtggcctcgcctttctcgacccgtagcctgtagcactagcactagcacgcagtccactcctttgagagagagagaggcgcgcgcgcgccgacgacgacgacggcgacgtcgtcgggaaggtggcaagtactagtagtagtaaaccggaggaggacgaccgaatcgccgtgcgcgcgcgcgctctctcgcgtgtgcgggtccgcgtgcgcggtgcgccgctagaacgtgagagatcagatcagtcagtcagatcacggtggcgcgcggtgttttcgcggtgattttggaggtttttctgggtgtcgccatgccggtcggtggggggaggggagccgcgcggggccgcggctgcaacgtgagagatcagtcacacagatcacggtggcgcgcgcggggttctcacggtgattttggaggtttttcgcgtacgcggtaggtggggtgccggtcggtggagccgcgcggccgcgcgagcgggcgggcacggtaggcaggaggatcgtccccttcttttttacaggtggggtgtgcgtgtagcgtgcgagcgtgacgcgacgcgcgagcttgcttttggtaagaccaatgtgtgggttagaggataaccgcgcaccacagggataggtagttttggtgtgactactatactttctttagtggaatctttggtgtatcggatgttttgctgtgtggggttctgtttgatccgagtgtttctagtagcgttatggttttgctttctattagtgggacgctgatgatcctttgttatgtgtgactggacgaggattcaggccatatttgtttaggcttataagccaacttataaattaaaaaatctaaatctaaacaaacaagcagctttttcgtttggtttttttaagccataagccactctaacactattaagccaaaagctaggttagagaagcttttttggcttatgtgagacagatgcataactccaccattaaacttagaacattaaatccaccggcttataaatcatataagccaataagctgacttaaaagtctaagccaataagtctaagcccaaacaaagagggcctcagtttggttgtagcagtggcttgtggagatagaaatttgcttttgttccagcacttcaataccatatcggcatatcatatacttcctccgttttttaatagatgacaccgttgactttttctcacgtgtttgaccattcgtcttatt

SEQ ID NO: 25427 - DNA, 8041 bp, Oryza sativa
aagacgaatggtcaaacatgtgagaaaaagtcaacatcgtcatctattaaaaaacggaggtagtactcgcctacagtggttagctttcagttctttccaccatgagatccactatagagaacatgaaaatgacacttctttcccgttgcattcttagagcaggtacaatagcaggctataagccagctataaccacatatcgagaagaaaagagaagagagagaagaaagcgggctacagatttgtagccggctgcaacacggacttcaatacgttataagtgtatgagaggtaggaccgggtattaatgatatagtatatttttatagataactattgtatgaatgggatattagattggctatagatgatttggagccaacagttggctatactattgaacttgctccccattactagctctaatttacctatagccaatctaatagccaattcatacaataattgcttactatactattaatatatggtctcacatatcatacacacattgcgtcttggagttcgtgctgcacctggccataaatctgtagccgctgctcttttatctcatcttttatctcgttaaaatatgtttatagctggctaatagcccgctattgtatctgctattaggggtcatttagattgcttcctcactttttgtgagaatgcggtgctaaagttgtgacgtgccatggttttttctggcactaaaacaggtggaaattaaataagaacaggtgatgtggtatggagttatgatgcatgactttacctactaaggtttaaatgatttccctattcactttcaaatcaagcgacatcaacaatttgccacttatgtcgagtatgtttagggcagggtgtgcacttatatgttttttaataaaaaaaattacttggaaacattgcgacaaacttttaaagcttgacgagttagaactgtggcttataaataaactatgaaggtatccacgcttatacgcgggcactttattaatgttgtttaaaatttgtattacgaatggttatatgtggttgacttttttttaaaagtatccgttaacactattatatctatcttcatcaataatttgtttaggatcttaatccgtggattgggggcgtgtgcagcagcattaccgggcatcatgggagggagcgacactactccgcccgttaagggaagtggaggcaaaggcagcggtggcggggaaggccggcggccacgctgctgccttgtcgcctgggcgccatcgtcgtcttcttcgcactaggaggagctgaggacgcgggcgtggttgtcgaggctagaactgagctgacgagacaagaagagtgttggtcggttttttccgagctcttcgtcaggggatcctatcgtgggcattaccagggagccgtcaccgtccagatttgcatcactccttgtttagcttctcaacctccaccacaccgcccgagggaaccacctagtcgccgcatgccatcccatgggcttcctctctgtgctcacgcgacaagctttttcgatgagaaaaaattcctctctaattaatttattatcatagtatgagcctctcctaccatttctcgtcaaaaaattaaaaagctttggtgatgaggttagcatggatccacaagctccgtgtggcgcagatctagcagcggcttgacatggatcaagccataacgctaagctcctttgtggctataggggaaatatgtaattgatgggggcggcgggcgtggagtgtgaacaacctcgacaatggtggcctctcctcaatccggtgttttcgggcgttgatctaatggggtggcgactcaagtaggagatcggggtgatatggtccccaacaacgagctcaatggagcactatttttttctccatgggtaccgacgggtgggcccactgtttttctcatgatgcatgccactgccatgttagccaatcttgtccaaaaccacccaaagagtgttgattgggggggggggggggtaattcgtccggtttgaaaagttagagatattaaatgtctggttttgtagtttaagcggggtaaattgtattatcgtaatagttcaagtgtaattccgacattttccgctatagaatgcacactaaggttgtgttttttcccctttttcccaactcacttccctcgttttccgcgtgcacgcttttcaaactgctaaacgacacattttttgtaaaaaaaaatttatatggaagttgctttaaaaaatcatattaatcctttttcaagttttttaggctaatacttaattaatctcactaaattgcgtgcttcgttttccgtgtcacaagcaaccttgcctcccgaatacagcctaatcattctcctgatacatcttaaggcccgtttagttccccaaaattttttcccaaaaatatcacatcgaatctttggacacatgcatgaagcattaaatatagataaaaagaaaaactaattacacagttatgggggaaatcgcaagatgaatcttttaagcctaattagtccgtgattagccataagtgctacagtatccccacatgtgctaatgacggcttaattagtctcaaaagattcgtctcgcggtttccaggcgagttctgaaattagttttttcattcgtgtccgaaaacctcttccgacatccggtcaaacgttcgatgtggcacccaaaaatttccttttccccaactaaacacacccttattaccaatgtatcccaaaagaaagtttaattgcatagttagttaaggttacaaagtcatgcagtatggtaggggcaatattttagaagcaccatacgtcatgctaatgtgagattattcttgaccgcttcaacttgattaaactgtttttgcatgaatatctctacataataaccatatgaaattcatgactttacctcgattttgtcaggagcacgtcaacggtggactggtgaccaactggacacacttatatatgaatctatacaaatgatagtactccctccgtctaaaaaaaaagacaaaccctggtttccgtgcccaatgtttgaccgtccgtcttatttaaaaaaattatgaaaaaaattaaaaagacaagtcacgcataaaatattaatcatgttttatcatctaacaacaatgaaaatacgaattataaaaaaattttatataagacggacagtcaaagtttgacatgaaaacccagaatttatcttctttttttggacggagggagtatgtgttattggaagcacgtgaggtatgaaaaaaacagcttgcgtttgttcgagattggcgtcactccttggagcctgatgcagcttctgacgatccactggaatccagattctgatttgtggtttttctattagcgatgaacttcacgtgctatttggaaactttactttggatgccatttggacattggcatcctcttctgagaccacagaaagtactgtacatggtttctcacttcagatctgatctagtgtcagcttacatataactcatcacctgaggagccgacagagctgaaagctgagtctgtgttttagttcagcgcaaagtttgaattttaaattggagatgatatgacagaaaaattgtgtgagtatgatagattgatgcgatgaaaaattactgaagtttagatccaaactttagatctaaacacagcctgaattgtgttccatctaagaaatcgagttgtgttgattgttttagtagagatttgcacgtttgattgcattgcagcttaagtgtgttcaggtgtgctaggatctaaaattctaaggaggctgtgattttgtcgttgttgatgatggacaaatttgaaactgtgggcgacaagttgaatgatgaactacagaacataggagctatgtattttttaagactaaatttcataaaaacactagatattaagttagactaaatttcataaaaccactagatattatgacttaagttatgcaaaatcacatgggttttgaaacctgacgcatacccaattatgatcctatagttttataaaaccacgccattaatcaacttggctttctttactagcaaaataaaaaaaatgtggttaacttgttatagaatagatcgatgaatccatatatttgagatatgattttagaacatatcatataattgcttaacagtatggttttgtgaaattctagagcgcaataatccaagagttatatatcacatgtcaaaacccgtgtggtgttgtgcaagttggattatgataccttgttacatgaaatttactctaaaaaataaagggaaaaagattgcctattgtattcccccaagtaacttatgtgcttcttggaaaaaacgatttgtatgttcagacaaaatcacagaagttctgagcatatacacccaagctacattttttaactgatagtgataacagggcataaatacaccttttacaatgtacagattacatggtacataaataatatgctactctgcaaaattactaacttaactaatatgtacacgatctgaaaatggctacaaaattccctgctgtcctccctgataacagggctcccagcagatcatttggcataatcaattgtagctggtcaggaaatattacctgagcgttatctcggaatcacctcaaagcattgataaataatccttcatgccacaaccacgcaaaacctttcgttcttgcatattaagcgaacattactcagaaatacaatggtattgactggtataatgatgcggtattgctgattcttaccattgattcccgagatcatttgttccgcccaaagtacaagctatcagaagcaaaaggggaagacctatttaactatcaagctccacaaccattgattggaattcttacattttcataacctttcagcgtatcttgggtaaaagattccaatgcttcaaatattggacctagacctgctttcagatctgttgcacttgactcttggatttgattcacggcttcctcatgcctagatctttgttcatccaatctcttatgcaatgcgtccaaagctacaatgcggctatcaactgctctgttattttcggcaacaggcaacaccgtcttatcagcttcatgatgtccagccaagccatgttccttttgaaaagatttgagcctctttgcataatctctagataaatagtcagctttcagcttctgttgctgctcttcgtcctgccgctcccgtaacatgtgcacattaacagcgaaagcctccattgcacctatgacagtaccttctggtatccttttcatgctttgacaccaatcattagctgtgatgaacacagctggagctccaagcctaccaggagaaaacggtgcgatcccatcaggtgtttcctccttttcctcaggaagccatttgactaaccagccattgagagtttcaatataagccttttgtgacaggatccaattgctgaaacaggaacaccagttcaaaagttccatttctagttcgagtgtaatcttggagttcctttctggcccattcttagggataagaacatgagatttagtttcgagtatggcatgaaattgcttccgatggcattcaagaatgaatttccacattctcacaagcctacatcagaacgacaacagtttacagtctgttcacagataaatcagctttgtgacaagtattggaagccgtgcagaggaaataaattgttatgaaggcaatatctatctcccaagaatataagctcagacacaaacagcaacaaagaaagacacatgagaggctacatttgctagcaagacaaatgtgctttccaaaagacaactggacttcctaaactaaagatatcctagcattaactaattttattagtgtgatagctattttgcttaaaaaaagtttaatgatatgatatacattatattgactagctaatttcaggacatgtttcaatggatcaaatgactatgaaaccattgcagcatgcagtagtgatattgcaacataaagaatgcaagataaactaaagaaaaaaaataagtacttaaaaaaaattctctgcaagaaaacaagggtaggcgggtgtaatgacacagtgactatttgatggttgatccctttgaagaatcacttgagtagaaaagtgtagaaatatacttttcatacccttgaataagtttaacaagatgtggatgtagctcatcgtctcgtagtatgtgaatcctcctagaaataactttggctgatctaattgtaatgttgattctggtgagcagtgtactaattgaggcccgtgtagaatcaattttatatggttctgcaccattgtcgtccaactctttcaggcgcttccattgtttgtcatatgtgatcctcaatttttcttcctcctgacaattaatttaaacaaactgtcaatgcgatgctcatgaaaaatgcaagtcacgagcaagtgtcactctatcattcagcagcaatttcttttttaatgagtaattcagcagcaaaataaattcaacaccacaataggacccttttaattatatcaagataagcagtgcattttgagaaaacaattttgacagatgaagaatattacataaaagtataggagaccattatcagccttgtgatttgtatgttttgagagtaacaagaatttatcaagacatttcttataactaaagtaccataccataatttccttatgaagcctcttctcccacacgtacaacctatccattactgaagaaagagtattaaactcaatatcactggcactaccaattctttgactcgaattatgatttcttccagatgcacttaatgctgtctgctccaaattctccacagggggctcagatacagaagaaaacaacaaggcaaaggcccccatcaaccgcgaaaataccactgcatcaagtataagtgacaaagtgtttaactgagtaagaactgtctctggagaaaatgtgaaaggaaggtgggcaagaaatcgtgtcaacagatcaatacaatcagaagaaagcacatacgctacacaagatctctttaatgtagtactatttgtcagtgctaacttattagttataagtggacttgatcttgcattggagtctgatgctgctagtattcagaattttcttgcagtgcaatatgtgcatagcaatcaaatgaaatgaaaagaaaagcatatactcacatctcacaattcttctccgaggccggtaccgcatacttccgacctcaaggatcctagcaacatcgtctccacaggcgaccacagagttgaactgctcctttatctcattcacaacatctgcaacatcccttgtgccgaagttcttcggcagcacatcttcagccactaccatggacgagtgctcctctgaggccaccttcttcaccatccttggatcatctccagccggcgccgcagttgctgctcctgctccggcattgccatcggcatgatcacattcacagctgcacacactctcctctccagaatcaagaaccgaagcactccccacactctcgatctcgcactccttgtgctccatcgacgccgtcttcgccttggcattcactgcatcggcattgtcaatccgggtggacgcggtgctctccaccgccttcctcgccttgatcgactccctcatcgactcctgctcggtctcctcctccagctccggtatcccctccctttccctcacctcgctcgagttggggctactcgtgaacgatccattggcatccttgtactgcggaagctgctggttgtagtcgtaggagtcaaacgggttgaagaagtcccagggcgagacctccggcattggcatcggcggcggcggcgccggtgccgccgccgccgccgcctcccgggcacgatcctcggccagccgttccccatccgggggcaccggaatgccgtacattgggttgctgtacccgtagtcgtacccgttgtaggagacattggcggcgaagttgccgtagccgtacggttcttggtacaccgtg

SEQ ID NO: 25428 - DNA, 11845 bp, Oryza sativa
gtggtgctgctccgcgaaccgcgcgagcgcgtccgccacgcgcgggagcgcgcggaagtaggcggcgtgcgcagccgccagcgccgcgcgccgctccgccgccgcgcgcagcaggtcccgccgctccgggcagagcgcggccaccggcgacgcgtccgccgcgtccagccgcgagctcctgcaccccatccccggacaccaccctacgccctcgccgtcgacggcattgtcactcactccccgactggacgagagaaaaaaaaaatgggcgggagcgcggagcacgcaacgggacgaacaccaaagggtggcgacttggcgtggcaaaaacggcgcgcggcgcgcgacgccgaggcgaggcgagaggagcgtggcggggcgcggcgcgagcgtgacacgggcacgtggaggcgctgcgagagcgtaccactccacggtttagtactactactattattgaagcgaagcagcaaaccacactacacaaacccacactggcgctggatgcagtggcagtgggcattgcattgcacatcacgagcaatcaccggcacgatgtctcggggacagcagaggatgggccattgaatttgcacgtactgtacttcatgctcggtaatttttgggtgctgtaactggatcgtttgcgtttttaccagcttatggcgtattggtatgtgctggctagattcaccaaatcattttggttgaggttgctgtcactccactgtttgacgtatcgtaaaaaccgtatagttaccgtgagacatatgatggttttaaaaactgtgaagattattgttcgtgataaccacacggtttctgtaaatcctggcgctggcaggatgtcacttgcatcgcagcatcatgtacagtaggcgtaaaatatggggactgtagcaaatctggggcagtaatcagtaaatcacacctctgaatgctcataaattcattcgcttatcaagtctttgagtgccttttctgggactcctgccgcggcgatatttgagcagcagtagctgctgtaaaattctgggtgctctggttgaagttgaacacggcgctctgctcactgttccagatagtactagcgctccgtcaccactgatactactacactgaatgcaattatcggaatcatgatgcagtagtactgatgagccacagatcaaagataaccctgcaccggatgtgatccatatcgtctaattaatcttcagatttcgcatttaaaaccctcctcatcctgtagaagttcgtaacagcaagttttagagtggaggcacctctaatttaaatgataacatctaatttttaataattaaaaggtaacaagtactcctcccattgtcccgatttgttgtcttatatatagagttatagggccggttcactttgatgccaaaaaaaacttaccaaattggcattgccaaaattttggcatagttaccaaaattttggtaacttgccaaaattttagcaggatttcttatatagttatcaaaatttgacagcaaactaaatgtagccactttttgtaactttaccaaaatttggtaaggttggaaattgcatcaaagtgaacaggcccatagtccgtcatagtcccatctactctcttcatcctaaaaaaaccagtttgaatctggacatacactgtgtccatattatagatcaggattagattttttttggacggagcaggtatgttggttttattttttgaacggagggagtataacatattaaatctaatacacaaacttttatattagttcactcttacacatcttttattttgtagagactgccccttatataaggacagactcattttttttccttaacttccctcctctattatcatctaattttatgtgataaatttagagacaacatatagaggtttataggtttatagtacttgctctaataaccccctggtgatcgtcagagattgtctctcctcactctacacactcacgcgcacggagattgcaacagcacatcgaatcgcccattagattaatcgaatggatcacatggctgcagcctaattaaagaggatcggagcgcatcgaggactgaatgctcccatccacggtgcactactgtttctagattctgacggcaccggattactgtagctttgctcgtagtatactagtactagcaagaaacggcagaaatgcttccgatgcctcacagactttttcctcttcttcttcctgctgctaatcccaaaggagacgcacatgccagccacgccgatcactcatggctctcctacccctcggccccctgctctgctactccgaaaaagggcagagaaaaacaacacatggcacaccagaggggagggatcgggataacgtttccaaatcgataattcgatgcgagcttgcgatctgtagggggaaaaaagaaaagaaaagaaaaacctcccagctgatgcgtgtgggattcagatctgaagaatggcgacagcaagaagaaacctggccctgacagtctgactgcagatgagtgagagcagtataatagcagtctataagcccgctataaatatattttaataagataatagagaagagagaagagtagcgggctacagatatgtagtcagctgcagcacggactccaaaacatgatgtgcgtatgacaggtgggaccagatattaatagtatagcaagcaactattgtatgaattggctattagattggttatagatgaattagagttagtagtaggctgtactgttagaacttgctctgatgaccatcagctaaaagctcggtttggaaacgtgtgttttggtttaccactgttgctagtaggcctcttacataattaataactgtgctgtttagagcacaaagttacgggggttagggataagattaaggagcccgagacatacagaacggagagtagtagtggcagcagtgcagcactctcctacccgtagctatactatagaaaaatggcttggaaaacaacggaggcatgtgacctgagacgaaagcgaggactttttgtcttcaccaccgtgatgtgcagcccatctctctcgtctcctcggagcacgtttgtttatgagtcgttctcgcaaagacgagagagctccgtacgtaccagtggcttgccatgctgctgctgcagctgcatgccacagtgaccaactcgccatgggcgacgacgacaagggcgcaccaatttccgaggcttggggggtgggggcgagtggcaaaaggctgtggcgcgacgatgagatcccaaggacagggacaggtcaaagctggctttgacggatcgggccggtacgtggtgacactgacagtgtgagggggtggggggccccacgtcaagtgccattatttgtggtttttttgtactcgtacgatacgatcgcgctcggtccttcgctgtcgcgtcacgttcgtactgtaggagtacgtactacgccgtgtgcctgggcgacgtttgctgccgatccatgtaccggccggagtactgcgggcaacaggcgctgtttgcgtcgtgcgtttcgggtactactagtagtagtagtacgttaaaattggtaggagtacacgtacgaacagtgcaggcacggggctggacactgtctgtcacgtagtactacgtgcgcagacgcagaaagaaacggagagtgcgggtgcacggaacgcgtaggtaggcgcggggaatcgataacggtggccatggccggccatggcaacgggggtggatgctttcgcagcagcggaggctgatgcgacgacgtacgcgcgccgtatgtgcagcctcgggccacaggttgcctgcgcgttgtgcgactgtgcgccccgtggtttttcccgtcgccgctgtgcagcagcccgtgcatacccaagttcctgaactctcggaaacaaaaaattttcaaatactaaaactttcaaattacaaatcataaaaatctcaatcctaaaatcaaaaattttcatctaaatattcaaatgctcttctcctttagcctcaatcgttgttgcttcatctctcgagacaccaccgcatggccgcatatcccgcatagctagggttgaggagctatggctaggagagagaagaggcatcgcacggctagagaggaagatggggagggaaggagaccaaccggaacagagatggtgatgaggatgatgacaaggacaacaacggtgacacggtgatgtagtgggtcgatggataatgatggagacgttctcgctctaccaacgccaagaaagagggagcgaatagagaactaaaagaagaggaatcagtcaacttattcttttcattgggctaggcgtgggcccaatgcaatgcaatggtattaagatgaatacccaaaaatatttgataaaataaaatatgtttatatagtatgtgatgtatatgtgtatgaaaaaacaaaaggataccatatatattcaacaaagagagaccatatatctattatctatttctattatacctactgtttaaaaaataagaggtgtatccatcgtacgtaaaaaaaacgggcgaaaaaaccaaaagaaaaagaaaaaaaaggcgaaaataagatgtttcctttgtccgttaaaataaaaaaagtagcgaaaaaaacccaaaataaaaaaagttcgatccccctgtaattttcgttcgtttttttccctttttcccgttttattttcttttcgcgtttcttatttttttcagcgtttttccctttttttttcttttccttttttcgttttattttctttttgccgttttttcccttactttttttctttgactgtttttccggttcctttcttttatcgcttttttttgcggtttttccatcgggccaaactctaccgccgccgccacgttgatttgcctccctatatatttcatcctccaattcattgcaaaaaaaaaaccaattccccgctactctcacatcattttccccttgaattcctctttcaattcggctttaattcaccggattgaatctccatttaatcctcgtcattttttatcccgagttttacagattgcttcgattttgattaaaaaaacagaaaaaggaggttgagtggatcaaaatccctcaacaatttttggagatggagaaacattcgaccaaatttgatggagaggatcggctccgttattgtacgggcactagactatgcaagaacaattttggagatggagtaagattcgaccggatttgatggagaggatcggctccgtcatcgtacggacacgggactatgcgagctcgagcggattaccggatatgggaggagctcgagcggattaccggatttgatggcaggatcggcttcgtaatggtacaggcatgagactgtttgagctaggcctacagctccactcgtgggctgagccgaagagaggtagatcgagcagagagaggtagcggactgtgctaggactggagctgaaaaggaaggaaggaataagcatctggtctaaaaccaagaaagtatcgggtccaaaactaagggagaataatgtataggataaaaaacgtttttacctgttgcaacgcacgggtattttttctagttcaaaatataatacataagtagcttttaactgtatttttttactccatcacactttaaatacacaacctgctttgtgcagatcgttcagaaaaaagaaaaacacgacctaacgatcctagggctgccccttgccccctgctcccagcaatatgggtcttatgggccgaaccgtgcgtcggcaacgaagctagcgcgtctgtgtgaaataggaataagttcatccgaggtcccttaacttgtcaacgaatccgattttcgtccttcaaccggaaaaccagatacaacgggtccctcaactatcaaaaccagtgcagatgagatccctcggtggttttgagggtggttttggctgacgtggcgcctacgtggcaaatttgacttggtcttcatctgatatggcattgacgtggcgcatacgtgtcaatttgatccggaaaaaataataaacttcgtgggacccacatgtcagtctcatacataaatcaataaaagaatggtggggcccacgtgggccccacaagtccctctcggctcttgtttctcttcctcttcgctctccctcgtcctcgcggggagcggcggcaggagcatgccggcggatggagcggaggggcattggggagccggcaccaggccgcggaccggtggaggttgccggaggaggaagagggcatatgaggaggtccgccggcgagcgcaacagctacactccgtcagccgttccgcccgcgatgccaaaccggacggtgccgcccctcctcgctcggtacccacacacactgcctccctcctcgcccggccgcctccgccgacgtcctcgatggtcacatccgggtcgaagccgcgcgtcgcctctcttcgctgggccgtcgagcaccgcttccctcctcgctgggcccccgagcaccgcctccctcctcgccgggccaccgcgcgtcgcctccctcgccaggccgccgcgcgtcgcctctcctcgcccggcccccgcgcgccgcctccctccttgtcgggccgccgcgcgccgcctccctcctcgcccggccgccgagtgccgcctccctcctcgtcaggctgccgcgtgtcgcctccctcgcccggccgccgcgcaccgcctctcctcgccgggccgccgagcgccgcctccctcctcgccgggacgccgagcgccgcctccttcctcacccggccgccgcgcgcggcctctcctcgccgggccaccgagcgccgcctccctcctcgccgagccgccgcgcgccgcctccctcctcgtgagccgccgcgcgtcgcctccctcgcccggccgccgcgcgccgccatccctcacccggacactgcccggccgccgcgagctgccatccctcacccagacactgcccgccgcctcggggatgggagaagggggagagaggaggaagaagaggggctctagttgaagagagggagatggctgagaactgacatgtggggcccaggtgggccccaccattttttattaatttatgtgtgactgacatgtgggtcccacgaagtttattatttttccggatcaaattgccacgtattcgccacatcagatgaagaccaagttaaatttgccacgtaggcgccacgtcagccaaaaccaccctcaaaaccaccgagggatctcatctgcactggttttgatagtttaggaccccgttgcatctggttttttggttgaaggatgaaaatcggatttgttgacaagttaagggacctcagatgaaattattcctgtgaaatatgattcccgcatacgagtacgagatacgatctcatcctttggtaaatgatcttcttgtgagatgtttaagatcatcagatttttttttgtttccttagatcaaagagaagatcacgatcacggcgggcagtgacaacaaacgactaggcccacgttagcccatctggcacagcacagcccatacgacgaccacacatcaaaaggaaaaagtacaccgaaggtccctcaatttgtcatcgagttacaaaatcgtcctccaaccgcaaaaccagatatccgacgtcccttaactaatcaaaaccggttacaataggtcttccagtgattttgacccggttttatcctacatggcggctgaatcagcatgagacccacgtgggacccatatatcagcctgccacgtcatctctctctcccatcttcctcctcctctcactctcttactcttctcttctcttctcatgttctctgggcaagccggggaggaggccgccagggtgaggccgctggggaggagcacgtggggagagcgaaggaggagcttggagagggctggctgtctcctcgtccgacgcgaggcgccgcggtggcggcaagcgatggagggcggtgggcggcaggagtggagctgggcggcggcggcggctggcgggagagggcggccgccatggcctgccgcagaggtggcccgccacccacggatgaagccgagtcgtggctcctcagggtggcgacgtctcgcgctgtcgcgcaaggtcggcggtaaaatagctatattcagtaatgcttgctcatcatacgattctactgaatatggtttcaaattgaacagcatgaaggcagcaaatctcctatgcttcaaccccttgtcgttgctgaatcttgttatttcaccatgctactcattagctaaatagctagttcctgtgagctgttgtttgtcaaggttggcatggtgcacagtagctactagctagttctagacgattttaatttcttgacggggaatattacaggtggtgtttgaatttcatgaagataaagataaagtgtttcacgtaaaacgaggtggtaataacgtgtgattaattgagttttaattgttacaaacttaaaaaatatattaatataatattttagagcaactttcatatagaaagttttcgcgcgaaacataccgtttagcagtttaaaaagcgtgccacgagtattcaaaatttcatccaactattatggttgtgtttagttcagcgcaatggattttggttgaaattggagatgatgtgactgaaaagttatgtgtgtatgacaggttgatgtgatggaaaatgactgaagtttggatccaaactttagatctaaacacagcctatatgatgaagaagccgagaacagatcagattatagtagcagtatggaacagtagttgtgagatatccaccttcccttcctccttttgactgaagtagcaagggactatcagattatgttaaaaagtgtgtcacgagtatctaaaatttcatccaattattattggagaaacgaacacagcctatgatgaagaagccgataacagatcgaattatagtagcagtatggaacagtagttatgagatatccaccttcccttcctccttttgactgaagttcaagggactatcagattatgttaagatgaaactacttactccctccgtaaaaaaaaagagacaaaccctggtttccgtgtccaacgtttgacagtctgtcttatttgaaaaaattatgaaaaaaataaaaagacaagtcacgcataaaatattaatcatgttttatcatctaacaacaataaaaatatgaattataaaaaaatttcatataagacggacagtcaaagttgggcatggaaacccagagtttgcctttttttgggacggagggagtacatatatgtttttttttttgaaaatgtagttaaaactacctgcttcctcttttttagttgacactgttgatttttgacttgcgtttaacaatttgtcttatccttttctttaaatgcataagatataaatcataattaaaatatttttagtaataaaataacttacatcaaaatatgataattatgcaaaaatattaataagataaatagtcaaatgtgtatccaacatcaatattatcgtggtatatgtatatcataagtacgttgtctgttcacgtgatactctaccagactatcacagagacgtataacagataacatgcaaggaaaattaataatcgtgctacaggctacagtatatactgagcactgaacagtgagcatgccttcatatattatcaggacgatatacatcgttatcagaaaagatggccatgccaactgtttctgaataaatctccgttatccattcaaaaggggcaactgaaaactccagcgagttgatattaatattgcgaatatacagtgaatcgcgcacgtgcagttagctagaagatggagcaatgagtcgatgtccacttgccataaattaaaacatctctcttcgtcacatatatgaaccataaaccaaccggcgaacaattcaaaccatcaagttctgctttgtacttctgttagtttttgttgggtcaaaaggctttcttctgcaaaaaggaaaaacgaaagaaacgtatatactacaaattcctgatcttgttgtcatggtgatgtggactagaaaaaaaaataataacaggataggctcgaatgatcgaggagtgaaatgaagatgtcaaactcaaacgatgagatcgatcgcttcatcatcaggccgtataaaaattggacactcggcctggcgttacgttgaatttatgccagcattggcagcttcaagttgaagcgatatacagtgcttaatttcacaagcaaatgatggccaatgaatgtcgctgtgacgagttaattccggcaaataattatagagatttcgttaggtacttctacagcgagtactaatttgagttcgatcgccacagcattgggaagaagagaaagcaactgcagctgcaaagagagaaataattaatagccgtacttcttaagcttcattcagctggcattcaagcatgacacgtgaagtacttgttcatccacggaaaattttgttcatgtgaggagagaatttcgggagaaggcgtttggaaaatgttgcttgcataatttgacaaagactttcttccggagaccctttttttttattacgacatgtttgcttccttgtatcatgcctccattctcttcagaccgtgtggtctcttgagatggtttcctctcctactgccaatttcgcacgcgaaagaacaaagtacaatctccgtttgaaaaggtaaaaagcaattacaaagaacaaatggaaattcccatttgaaaaggtaaaaggaaaaaggaacaaatcaaagtctctatatgaaaggtaattaggtaaaccatgtttctgttggaacttgaaaacggaattcgcaatttcgatctaattaggcatgttcactgtaagataggaatactagtaaccacaactcactttatcctaaaataaaatataagacataactaccactaacataaaaccaaaaaatgattgctatcactttatcatttagataatcttaataaataatatgtatttaccttattttttcacgaaagagatattgagggtggaggattttttttaaaaaaaaatgttatggaaggaggaattgttacttaattgcatgtatatgtgcgtgacttacattataaaacattgaaaaagatagttgcattgtatagtttgaaatggaagggtacttattaaattttattatccttaaaggaatattccctcattggattcttcttccttcgtcatctttcgtcctaattaggttgttatattttgataggaatgaagtaccttctattttattaatttcaaattttaggcaacgaaatctgaacgaagttgtgtgacccaaactgtcgacgtttgatgtcgcgattccggtatttgcatagtatggggatcgttggtactaggatatatgcgagattgtagtaaaaaagatggggacgaggatttttatacaggttcgggcctctgaattgtcaggtaataaccatacttctattggctgaagccagtcgttgctcttattcaccatgatcacaccagtataatatttggggtagcctatctaactgttgtcgacttggcggtctgaagtgctgactcgcagtcgacaacagggtagcattcctcctcgaatccgcatccggcgaaattaaagacagcgctatgtctctcctgacagtatccgtagacatcttaggggactagccatgcttatctctgaagtcgatatccggcgtcttgtcttggcgcatgttagcttgtatgttgatcttgtgttttgatctattgttgcgtcccccctctcctcctagggggcattgtatttatacccatagatgt

SEQ ID NO: 25429 - DNA, 6342 bp, Oryza sativa
cgggcgactgtttaagcgccggctctacttgcactctaaggtaagtttgagcaattccagtaattcattgccatgcactgccacttatgttaggagagagagtgcatggcactaggaggaaaatgattgtttaaagaataatgcttttattactatggtatgactgcagattggagtaagcaccgagctgtactactagacttgctctaagagcaggtacaatagcaggctataagccagctataaatatattttaaagagataaaggaagagagagaagagtagcggactataaatctgtagtcagttgtagcacggactccaaaacgtaatgtgtgtatgacagatgggattagatattaatattatagtaagcaactattgtatgaattagctattacatcgggtataaataatttggagctagtagtgggctgtactattaacttgctgccatcagacaatctgggaggatatctgcaagcagcgatttggtgatctctgcaaggcaccggagaccgcgtaccattggccatcagacaatcaggcgagtacttgttcatgtggagcatggagatccacaggattatatatttcaacatgtttgtttttgccgttttgcgtccatttcatcatggtcataagctcatggacggccatggctgctatttagttacccgatattgcttgtggccaacgaggaatgcatatttgaaaaggccacaatttctaacgcgataaaaaaaaaacctcctcaattacttacttactctactgatgctatgtaaggctttgttcagactaactgtatgactatatttttgataaattcagacctcatttgtgttagtgtgtataaatacttccatgcagtcttcatcttgaaaggtactacccgatcgagctgtgtctagcctgtgggcacaccccccaaggcaatctttttttaaggcccactgcaagttgtgaagcgatagatagcaacaccaaatataaacacgagcaattttcagatatttatgagcagtttttgggatcgattcaattgcatgccggaaacgtgtgctttgagaagagcttcccgcggaaaggcgccaaaatcgcccattcctcctgtgcggataagggcgttggccgttagtgcaggacactcatatatatgaggatcctccttacgagctaccactagaacggatacccttatcttaattaggcagtaagccccatctcaatcgggcacagcgtccgtcacagactagaagtcactgatgtgaagaattatctcaatcgggcaaacggccgtcgcgaatgaatatatctcaatcgggacctaagtaaaacccgtcacagatagctttgacccagacgaccagtcaaactatagcccgtcacagatgacctatctctatcgggtcacaactagcgcccgtcacagatgactactaacctttatcgggcctaaactagagcccgtcacagatgatactcatctcaatcgggcctaaactatagcccgtcacagatgactgatgacctcaatcgggcctaaaatagagcccgtcatagatgactactgacctcaatcgggcctaaactagagcccatcacagatgactgatgacctcaatcgggcctaaaatagagcccgtcacagatgactactgacctcaatcgggcctaaactagagcccgtcacagatgactactgatctcaatcgggcctaaactagagcccgtcacagatgacctcatttcaatcgggcatttagttatggcccatcacagatgactataatacacaaaaaaaaataaattttgttttttggctagcctcagacctttgctagccatgcccgctgcaaaaatgacagaaacaaacacagatatccaatatccctagctccccagcatcacccattcatatacatatgcattcacatacagagacatcaacatatttcacacaaccacacattcacagccatctcatatttcacatccattcacatatttcacatccattcaaatatttatcatgtttcacctgcaaaaccgagttaattggatcaaatatttatttagcaagtcttaacataaacatatgaaatatatacataaataaaaacatcacagttacatcatcacagttgcataataagtgttcatcattgcctaaacataaaagttcaacattgttcatcattttagtttaagcctaaacattcctttggggttaattatttcgcggaggatgaagctggctatctcctcgcgaacctcctcaaagctggtaggcagagacttggttattgtgccctacattgtcataattccagattagttgatcgatcatatataagtactaaaatgtagttagtctatcacaattgagaccaccgacctcaaactcaaccaaagtcttcaccttttctctatacagaaggcgcatgttgtggcacacatggaatccacactggtcacctatttgttgcttcactgggaagtcttttttgtggatgagggtgtcatgtcctgtcttcctgaggcctcctctttacacgtattgggcccacgcttcatctattgctagttgaattggggtccaatcatatgcgttcttatcaattctggagttcaggtagtgacatgtactccacttaggtgttatgaccagaaggatccaatgggcactgcggcattaatatagtgaaagttaattaagtactcaagaaatgtgtcatgctgttgtgtatatttagttaacacacttactattgattataggcgcacataatgtactccttgtctcggcgggaccacaaggtgtcgtagatgtagttgaccattccttgacggtcattctggagatttgtgacagtgaccacttgtggatcaaggaaggcaaattccggtgcatgcttctgacaccattgccaacttaacctacacacatgataaacgatcttgtaagcaagttaaaccgattgttattaccagattgagttgggcgacaatacatacaaggagtagcacttaaggaggcttgtgtccaccgctcggagcctgtagaggtcgaaaagatccttgaagtcgaccacgatataatttgttggaccgaggaatggcttttcatcgtgctctccaaggatatcggtagctttacttagcttcctggcgttagatttctccatgtagtataagtgaaggtccttgcaagcggtgcccattgcggcaagcacgtcatctccaaccaatggcatgcctagttggaactcctgtggagcgacatatttcttcttgacctctttgcccttagtctcttcctggcccttgcccagatctagcttccttggagctagaagcgaggcctgcacctctcctccccttcctctcccctttgcttcgggtttaacgagagtaattctctgaggggaagagtgtgccttcctgctcttcttcatcggtggggttcatgaatcgccttgctgtcggcctccgttcggtcctccccaaaatccgtgtcgtactgcaactacacatcgtaagattgtgcatgacgatcttgagcaggaggggctgaaggagcagaggcgggtctctttggtggacaaccgcctggtgcagtggttggcctcgctgtaaccctaatctcaatgagatccttgggccattggatgaaggtaccacgggcatttcctagtgagaggacctcgtcgttcggtggatacttcagagggaacagcttgtattcgggcttcaccgagtcgacttgaacttttgcacagtcggccctgagttgcgctccatgcactcttgtctctggggtcggcttgtacgcaagtccctcggttgctggaaccgtgaaggtcggcatcaccctaactgtgagggtgcagctcgttggttcctgcgatagattaatcaatttttttagaatattatatatcatatggattcgttaagtctttcatgtattgagtaagttcacggttaccgttatgtggtcgacggcgctgtcgaccgatgttggattttccgccaactcagttgatgcgcaactgctgcgtttttgggtgggacttcctaactcttcgtgcgcagcagcagcggcggcctgggggttctgttgctcttctcggatctcttgcctaatcttggccctcatcgactcgagcttttcgtcgaattcagatgtcagctcagctcttatcgacgcccggatcttggcttcaaggtgtgcatctttctccgccttgttggaagtctgcttcttgtactgccacgcgtagtctggaaatccatacttccagggaacagaagacccaacgccccgtgtccgtccacggtgttccttgttgcccaacgctttcatgaggaggtcgtcctcgcgtctttgagagcaggcctcttgcgaggtttgttgctcggcaaccaactccttctacattacaatttagtggggttaaataaacagcacgatgggaaacaatgcgaacatgtagtttgactagacacttactatagcttcgtatactcgttgatattctgcatttggcatgaagattgtgccatcatcattcttctggtacctggccctggcccagttcctagcccgagggtgtgggatatcaccaaagacgagcggtgtgcacgattcctccgcttcttcatcctcacgctgccattcctcttccttaccggcatatccgaaggtgccaagccggtgcggatgctggttcctggtctggagcaagcgatatgcctcgcttctagctctggactcggaggtcgacttcttcgcatggaattcctcccagacctgttccgtgatcgaaggaaatttctctcttggatctggattcgccgggttgtagacaaactcgccgactagcttagtcttgaagttcttccaagcattgcccataaccttgaaagcagcccgcctgagacggtcctcatgctccgcaggataatcaaagctctccttgaacgttagccaagcaatgtccttctctgcggccggcacgagcttgatgtcatcttgcagaatactgaatttctgcctccctatgaccccgcagatagacctaaatcggctcaatattttccttggagatgtcaacaaccctacggcatccaccgctgttatgcggaaccgttccttagggattttgttccctgtcctaggagtacgtgcccttgaggacccactagttgtcgttgacattggttcgccttgctgagacaccatctacttttttttctaaataacaaaaatgcacaattgaatgctacaatctattacaatgaatttaatgtcacttagaaaaataactgaaacatataaataaactgaattgcgcatctcacagtaataaaacgaaccacatttcatctatttactaaattcattaatgcaccatgtataaataaatgaaattgcacatctcacagtaataaaattaaccacatttcacaatagtttcattgatgcaccacatttcatctcaacataaataaaccacatttcatcccaacataaaaaaaccacatttcatcccaacataattcataaatgcaccacatttcatctatcactacaatcatctatcacaaaattcataaatgcaccacatttcatcccaacatcgacatgtctcactcatagttcaatcacatatcatccacatccacatttcaatgacatgtcattcacagttagcagagggcggcgcgatggaggactcacctgaggatggccggtggggctcggtggcggcggcggcgtcgggctgggtggagggtgtcgccggtcggtggaggcggcgttgggctcggtggaggcagcggtctcggtggcagcggcggctggctcggcaaaggaggagtttgcggcggcggcgccgggctcggtggagggcggcgccggtcggtggatatgccagtcgggtaggtcggcgccgggcgggcggcgtcgggctcggtgggggtcggcgacgtgcgtcggtgaggacgcgggcggcgacgacgagaaaggccgacaccggtccggtcggtgtagaggctcgagggaggacgacggcggtggcggcgggctcggtggcggcggcgccgggctcggtggagggcgtcgccggtcggtggaggcggcgggctcggtggcggcggcagcgggctcggtggcggcggtggaggtctcggtggcggtggcggcgaagtaggagttggcggcggcgctagggttctatggaggcgggaaactgtagtgggacttagaaaaattttcgatccgatctgagaaacccaagatatagtagagtgatgagtcatctcaatcgggct

SEQ ID NO: 25430 - DNA, 2858 bp, Oryza sativa
  unsure (1)..(2858): unsure at all n locations
agcccgattgagatagattaatctatatcgaccgtaaacgttggcccgtcaccgatgactcattttccatctttcatttgttgtgagtgcaaaatatatagctgctgtataataattcattttattagtcataatacattttcggatagtaaatgatttcaaatggaaatatggtcaacaacaaagttgtagagcctttcaagatctactggttttattttggtcatttttctatataatttttttcccaatagtttgaaattgattttgacaatatgataaatctaattaacagcatttgtaaatactaaatgatttcaaattgaaatatggtcaacaacagagttgatcctctcatcatgatctacaacttttattttggtcatttgcaataaaacaaaattaaccaaattaatgactacacatatcaagtctttgcaataaaacaaaatactttattcattacaatagataagtacaaatgcatcagtcacaaggttatgccttccgtatgatctgaacgagcatatgccacaggctcttggggatcatcgtcaaggtcaatgtgaggtcttacatgaagattatggttgtattcttcttcatcgacgatgttgtcaactcctacaattcggcgctttccatccctcacgatgtgcatcttcttgtttgaagggtcttttatgtagaatatctgctcgacctgtttcgcaagtacaaatggttcatcggcgtatcccaccttagatagatctactaaagtgaaaccttccttgtcggctttgacaccagtgcgtagattcacccaacggcagcgaaacaaaggaaccttgaacttgacgtagtttagctcccagatctcctcaatgcggccgtagtatgtgtttgacccaacttgatcctggaatgcatctatacggacgccgttgttttgcactgtgcttttgtcatcctgtttgacggtgtaaaatgtgtatccatttatatcgtatccatgccatgtgtctacgatccaagacggtcccatccccaacaactgtactatctcatttgggacatccgtggacattgtcacacgattcttgaaccattcgttgaaccgagaattatgttctctgttaatccatgcatcagatcgccccaaattctcatctcggattttcgctaagtactcctcaaagtatgggccaacttctgccatatgttggagcacagcgtaatgagcctgcgtgtacgacgcttgatcaggcctaattcttttccttccgattgtgccaacacctgacaaccttccctcgtgacgagatgtgggaacaccgataggattggcatcggacatgtaattgacacagaactcaatagcctcctcggtcgtgtaaccttcaatgatgctcccctcgggtttagctctgttacgaacgtacgacttcagaactcccatgtacctttcaaacggccacatttcccttagaaaagccgggccacatagttttgtttgcttcaccagatgaatagggagatgaaccattatatcaaagaaagacagtgggaaaaacatctccaggtgacagagggtattcacaatatcggtctgcagcccatctagatcttctggatctataaccttctgtccaattgcattgaagaaggcgcacagacgttggatcgtgtgacgcactttcggttatagaatgcctttgatagcaattggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatggactgaagttcactatgaatattcatgtcctgtagatcaaggcgtgcgttcaacccgtcctttgtcttcccggaaatattcaacatcaggccaaccaaattctcacacacattcttttctacatgcatgagatcaatgcaataacggacatcaagatctttccagtaaggtagtcgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaattttcttctttcttctaaatgcgtgacgtagcgggagccacctccggtgacccatgtataccatctttcgtgattttttcagccaccggcttcgtgtatgttccttgcaatcggagcatgccttctttccttttatagtttgtctggaaagattaccgagtgcagtagtcattaatggtgcagaacaatagaactcttagcttgaagttctcctgaccatatgcatcctaagtttccacaccttctttccaaagaatctccagatcatcgataacaggctccaggaatacatcgatatcattgccgggttgccttggaccttggattaacaagcacaacataatatatttttgtttaaagcataaccatggtgggaggttatagttcgcaataagaactggccaagtgctgtgagtactactcatgtcaccgaaaggattcatgccatccgtgcatagacatatcctcatgtttcttaaggagtccgggcccnnnccaaagtctttggttttcgattgatattccttcattcaatcgaatccgctgggtgtctaagcataccgtctttccttctctcgcgggcgtgccaacgtactaacttc

SEQ ID NO: 25431 - DNA, 425 bp, Oryza sativa
aaatggtcaaggatgtaaacatcgtataatatatgggcgaaaccactgcagtgttgaaagtgtcaagggcctgcaaaagtaaacagtcaaattcaaagtcgtatagagtagaagacaaatgtacaagacttccatatagaaaaacaaaatcagtctattcatcgtttatttttttctcttggcatgcccaaaattatcctacaacatagatattgatcataccttgttcagatagttcatctgtgttactatgcatgcaactacaaaaagtaagaacacccacatctgtggataaacaagctggttcatccctgaaaatgtcagcttcaatgctatcccaagagctttgacactcatgacctgccagagaaagaagtttacagaatgaattcatttacaccgtaaaccgactaagaaggatattg

SEQ ID NO: 25432 - DNA, 4380 bp, Oryza sativa
  unsure (1)..(4380): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattgttcacctatgtctccagttccaggacccaatagcaggaatcgaggcctcgagaggataatccgcgaaaagccatggggaaaaggctccaaaatcgcggagcaatcgaaatgaaagccgaaaatctagggaataatcggagaccaagaggctccctcggaaaaacagcccaagaaagaaaccgagttccagacttgcataggtaaatcaaagcttagccagctcctccaattcatcccccacacaaggaatgaatccatcctcgcggaaaaatattcagcaaaacaaaaaggggaaaatcccctccaaaaaaaaaaaagaccagaacaatcaactcacccagtccaaagcacgcggcgcgaggagccgaggacccttctccctatctctccttcccggaccctgcggggcggagacgccggcccagcttcgggcctcccgaccccctcctaaacgcgcgcggaggcgggaggcggagggggagggcggctcgatcgggggggggtggacgcggcgagggccgagaggaggaaggcgagcgaagctgtttgggtgggcgtggcgtggcgtggcgcccgcgcggaggtggacgcggctcgcgaggcgcgagtgcccggcggatgggggcgaaatctttttttccgctcgtcctggggcgtggcgcgggatgtggatagagacgacgacgacgcggcctcgcgggcagctttgggctggggcggcacgggacggcagaggcggaggtgttttttttttttcttttcttttaactcgtgtgtagtgaatgtgatcgtatcgtatcacgccaacgcgacctcgtctcgtgctatcgagagggcagcgcacgtgacatcgggagtgtagcgcgccctcgtggcggagcaaacaacgacggaaacgttctagagtactccttcgtcttatattattattagtcattttgattttttttcttaattgaatttgtttatattttatcaagtttatgataaattgtagtactttctcagtcatataaagatggttgttttgcaatttataagatgtcccaaaaagtttgtcatgttagtttttcaaggtcattagtacttctaaagaattattctggtccacccatttgaattgagtgcaagtaaacaattcattgtttttctcaagcattcagaggacaacgataaatcaagggcaatttggtaatttatgattgtgggctaatttgtatcaaaatctttaagcaaaatttgctacaggacaccgaaagattgcgacctttattgtgggacactcgaagatcgtgtatttgctcgtggacactaaaaaaagtggtaattagctactagacactcctcccattattttattatttacggtcaaaatgaagagagaaactttggttaaagataagtttgcccatggtcccacttgtcaatctctctttctctattcttcttcttcctctttctcggttcatctttttctcgttgcgccaccgccgagctgccgagctccgccacggctgagccgtcgtgtgtcgtcgccgttccgtgagcactccctctccagcctcctcgctgccctcccctccagcaccgcgcacgtcggctgcctcagcctcacccaccggcacactcctccgcgtcgtcaggaaacaccggcaggtccaccactggcgccgtggggtgcaccgcgcggggcgcggtgggcacgtacgcggcgtatagccaagcgggagcgtgggggtagacacgccgccgtcgtggagtgcgtcgcgccgggcacgccgcctcctactgccgccagcagcgcggtgggcgtgtatgtagcatatagccaggcgcgagggcggggcaggatcgcagccacggcgggagcacgacacctccggctgcgccccaacggcccgcgccggccgttgcaggaagcgaggacggcggggaggagaggcggggacggggtgagctggcagacggaggtggccgtcggtggtgaaccccggcgatgcgccgctgccgccgccccaccgtggtcgagccatcccggcttaggccagccgcggtcgcgaggaagaatggggaaaagaaaaggagagagaggaagaacagtacgtgtctaggggcattttggtacttacacagctctttatctctccattttgaccggaaataataaaataatgggaggagtgtccagcaactaattaccacttttttacactgtccacgagcaaatacacgatcttcgggtgtctcacagcaaaggccgcaatctttcggtgtcctatagaaaattttgccaaatctttacaacgtcaatctttgtgggatagaggaagtgatatttgtaacacaatacaaacatatattatcaaaaaatatatccaataccaaacttagtgaaactaatttagtggtttagacattactaatttttttattaaatttgattaaacttttttaaaaaaccatatcgtaccatcgaaggtggcctcgtgcgaagcaaaggacggaaatgatatagagtaacataaatagtggtaccgttagaccattcacactatagcggtatggcatttggacttaaccatctatgcgggagactctcctccacgtacgcaattttccttccccaatgaagacgctcggatccctgtgaagaaagggtggctttgtcttaacgcatggtaaaagcgagaggagacagaaaggcgtacgatgggaaagaatgtcgaggggaaaaggtgatgactagcgagggggataggcgatggccagagtgaggagaggcaaatctacaacaaacttaccaggaggatccacgccatcgctaccatcatcggcctcgaagctcactggcaggagctgcctccgatccatctcgtcacgatacttgttgggatgatctactcgctactgggcccccctatctgatcgtcgtcggaccacactgccttcctagccgttctcccgtcggatcaacgtccagcactaccagatcgaggagaaatgaggttgcatagcttccgtcgatggcgaccttggtgaggaagacgaggtcacacagctcctatcgacaaggcggaggaggtggattggcggtgaaggcacatggttgacgctcatcaccacctcgccggcgcttgagtcattcgatggtggtgagcgagaagaggaggcggctgtgcacaagaagagagaggaggggaacagacggcaaaacaaaggagggggtggcaacggcgacctgatctgttcggcgaccttggcaacgatgatgtgaggtggccagaaaagggacatgagcaagattcagccagaaaagtgaccggaggaagaaggggatcatgatggaagagagagagggggggggaaatagaggagagggtggcacgtggccacgtgggttcaccagtaggttgagggcacatatatagacttttttttttgttgatatagggtttagattgtaaagttttaattaatttgctaacaaaaataatataaggactaacacgataaaagttaggtgctgaatctaaaaaatattatagagtagcctacattatggagatagtatttatatttatatatcatatatagttggaaccaaaagtttgacatgcatataaccccttttttttagagtaaagggcagaagctctgctaatttcatttcaaaagaaaagagatagtgtttttacaagcatgtaggttacaaaggatcccagaatcccccaaatagcctttggatctttcgcatgctttgatatcaaccattcatgtgtcatgtgcatttaaatcccacttagtgtagatgtagttattactataaatctaaatatctattaaaaccatacatatcgcctagataaattataagcattagatttctctcatgttagatacaagtatttctaaatttttctactgcaacgtgcgggataaccacttgtttttaagatggttttatccatgtactacctccgtttcacaatgta

SEQ ID NO: 25433 - DNA, 1190 bp, Oryza sativa
cttacattgtgaaacggaggaagtacactagtacagatccttccatctgtgacggcccataacaagactggaatttgcgggccgtcacaaggaagtaatctcaatcggaccgaagtttcgcccgattgagatatggtcgcacagccatagtatatcggcataaaactaaagcccgtcacggatgacactaatctgtgacggctatagtttaggcccgattgacatgagggttccatatctcaatcgggccctaaaagaagcccgtcacagatgagggtcatctgtgacgggctccaactagaggcccgattgagataagtttagtgcccgtcacagatgacactcttttatgacggccttttattaaggctcgatagagattacttgtatgcccgtcacggttgattgttttagggtcgttacagatatttgttgcacagtataaataccccccaccacctagtgtaactgtatcccactgttcactattttggtgggaggctgtagggggcgattttttgtcctttttccaaggaaaacagaaattaaattcctgtaggtgatcaaaatggatcaatcaagtgagtaatattaatcattaattgagcaatttcatcacgtcttacttttgcaatactgatattataatatgtgcctctaatttgttttttttattttgtagcaattgatcaaagttggatgtatgccaaaaatttgaaacgtcattatatggagtacagaaagggcgtaataaattttatgaacgccgcggaggaggatcggataagaagaaacagtgattacatgtgttgtccatgtgcagattgcaagaatgagaatatgtttgatagaggagaggacgtacacggtcatctgatacaacgaggattcatggagggctatacatgttgggtgaagcatggagagcaagaatcaggaagtggagcagcagcagacagaagtggtgcgcataatcaggaagatgaagatgagcatgacatgtttataccttctccattggacggtgaaatggttgatgtggatcacgatctgctgcaagacatgttacgtgacgttgaggacccagcccagaatgagagagatggaatgaagttcagcaggttggtaagtgattccgagacgcctctgtacgctggatgcaaagcaaaacacacaaagttgtcagttac

SEQ ID NO: 25434 - DNA, 955 bp, Oryza sativa
gaagatggatgcaactcatggattgcagattattggtatgagtgctactatgcccaatgttgcagctgtagctgattggcttcaagtaagacaacttctgtaatttttgttcatactattatctgtttttttaagaaatgctgttatctaccataaacatgcttgcagtgtaatatcttacggtcattcaccatcattttgacaagaataatgtattatttaaccaaactgtctaatgaaatacagtagtaagtagtaacaagttatgtatgctgatttgctgaacttcaaagtttcacatgtatattttttgtgagttgattttccttttaatgataacaccaccatacttttgattattatgctgaaatgaaatagtgtactgtgctgaatgtacaagtagaaaggatgctgggaaccattgcattacagtgaggattctactgaattagctttttttttttccgagaaaaccataaaatttagcctgtcctgaggttccttgtagtgtctccacaaggtggtggagggctggacaaacactgtgtgcatcattttgacagttatgtcttaagggcctaattagaggcatctaaactacaaatgactgatgcaaccaatctgatttttatgctgcagaaggacgaagaatttactgctcaagtatttcactgaaaataatgtggaactgtgcgatgctctatagtgttactatatttgacaaacagtattagacatgctctataggctttcaacagtatttgacaaacatatttacagtggtacgggacattgacataggtgttagagtatgacttggattcgagtatctgattcagcaaatttggagaaaaaggattcgaagattcgtataatacatattttataaacatattatataatataaaatattaacatgtaaaatagtcggtcaaacacttaaaatacttttaat

SEQ ID NO: 25435 - DNA, 640 bp, Oryza sativa
ccagtctaagggacaaaactaaggagaacatgacaggggagactgcaggagagggagaacaaaaggaaggtaatgtactaagtattctttattgctaacaaaagtaaaaatactatctattcatagtgaagttctaaaattactagtttcctctaaaatgttcagaacataatcatgcaatgctaacattttcaggaaaagatgcagtgtttggaggctagcaaaatggcatgatcaagaaggagttggtgatactcaaagtatttgaaaaactaaaagcttacatcaatcagtatctagtcttctactgcattaggtagctaaaattcacagatatcaggcttagttaactttaatcttctactgcacaaatgttttgttattctcaaacggttttcttttggaagcattggtcaaagaagatatcactgagtgatcttaagtggtggagtagatagcatcagccgtttcccccctaaccgtacaatctgcgcatccccatcctgtctgctactcatgtaatgcgcgaaaaaactcccatgcgcatttttaagtttttatttttttaatatttacagaaatattataccatccctgccaaccaaatggagggcggcaaggtgtgcgcattggcactgag

SEQ ID NO: 25436 - DNA, 1494 bp, Oryza sativa
ttaccagcatatatagccatatcaacttttgattcgtatatatgaaggttgatttagttagagaaattcggttgtgagagaaggaggctagcaaagattcggttgatcaagctgtaccgccaggccaggacgtgctgtgcgcgcggctgtgccgcttgaccgcagaaccatacggaattgacggaccaattgtgcatacggacttagctaaaataattgttgatttttggcaataagaaaagcgagtagcacataaaatctaaagtggatgagtaaagggacaaaattttatacatgttcaggccttctcgatgagaagtaatactatactcctgttttggggattatatttgtcagatgttgtatcaatctgacgatcgagttatggttattgttggcggctgttaaatatcgattttatgccatcaatacctgtataatttatacagaaataataaaacattcaacatagtggtaggctttaattctaacatattccataagtgttggtgtatatttggatgcaggtaataaaccaccgaattaggaggaaatctagactaagttgaaggaaattttcatccatacaagtgttgggctttttaactccattttaacaccaaaatgcaagcccaaaaacctgcgaaatggataaggcagactgagaaggaggcccaggccaaaacttgggccagttgggccaagccaggtttcggccaaatcctgatcatcgctgttgatctcagggtttggcatggacgctcttgatttactcctgatggcagttgcagggcatttccgatcattcgcatgctctacaaccatcatacctacttatttaaggagctctcatcctcacttcatatcacacactccaatcttgagctgaattataagaggctctattgtattttattgtatactagaattagggaaagattaaggtcgtagaagaaatcggaggaattccggagttatcggtgatccttttctatttcttatactttgttatttgctttaatagaaatatcatttcaagtaattaagatttgtttagtgagaactattattggctagttcctaattagcgtatgagatcactgttcactataatccgttaaaatatagtgattgctttagtgagttacaaacactacagtagttattgattgcttaaacgtggtgtttagatagttaatttctagtggttgctgcgtatcccatagtacgttagaggcgggtgtagaggtggtgaccgccctcaagagcacttaattcctccttgtttgtgtacgtggtagagcgacatctgggaacagtgggttaccagtgcctgaagtaccatgttaggattaaaattgtaacattgtttctcattagtaaatcttctctaccctctacccacatttgctttgtatccttggtgaacctgaagaggaactgaacacacacgtttccatgaggttaatcaataccttggaatactcctaggtg

SEQ ID NO: 25437 - DNA, 9288 bp, Oryza sativa
ggcccctcatttcattggtatgaagttcggcccatttggaggtgtttaattgggtttatgggtccaaaactccttaagttcggatacgagtttgattctcatcctccttcatgtatatttcctctcaaccttggtagtttgtcacctgtatatgaatatataccaacactcgtggaaattgttagaaataaaccctaacactatgttggatgttttgtagttatggttttatgcaggtattgacggcgttaatttggtactaaacagccgtcaacaatcagcccctaggggcgaattctacgagccacctccttcataagagccaatttttacaactggctacgaaattcgccccaaattaataagtatggttagggaaaaacctttctttggtcttgaccaagaaaactcctaccatcatctgcgggaatttgagcagctttgctcatgcctttagattcgaggcatgaagcaagaaactgtacagtggaaattgtttctgttctaccttcaagagagagcaaaacaatggtacacatctatcgtcaggtgtgtaagcggtaactgggagaaattacgagacaggttctgccttgccttttttcctataacccgtattactgcgcttcgtgtggaaatcctcagtttctagtagttaaataaagaatcaatcagtgaagccaggtccagagttactaatttagtgcgattcggtccaaggttatccatacccgaatacgtgttgttgcatcattttcgcacgggtttagataaggagtctgcattttatctagacattactgccggagggtcgttcatacatataactctatccgaaggaaaagtaatcctagactgaattatggaaaaaacttacttcatggaacagtgcaatgaacccctccctgaggcatatgtggctaggatcgaggaacccttgttaatcgaatcaaagactgaaccgtctacttcgatcaattcgaccgaggaacatgtctctgagccatcatctgttgataaaaaagaaatttgaactccaggatgtgctccaatgttcaggtatgatcttgatgaaaattatggaaataccttgaactactttagtaagaagagaccgcctattcccttgccacctctcgatccaatagagcttgggtatctaaagggaacagttcaggagttgacatcgattatgagtgatcatgaaggcagagctttcatccgaagtaattcggataaatagcgcttctcgaaccattccgtatcatttagatgggaataatgttagtattctttatggtccaactgttggtgctcatattgtctcggaatcctttgcgttcgcttatctgagcgacatgatgtgctcgagggtgtcccgatctttcaatgagagggataagtcgattggatggagtgacgttggcgatccaactacaactatccagggatgttgcgccttagcaatcgttacactaacttcagaggcggtcatgaatctcgacggatgcacgatcagcccaaccacgagggtatttgttcctgcaagcaatcgagaaccagcaagaacaagatgaacaagcaactaaattttcgaatcaaagatgttggattgaatcaatagaagtaacaagtggggttcagtaacaagcaatccggcgatctaatcgaccacgggatcaactcggcagagtagcgacgctatactttgatctaaacaaaacccgagaaaccctgaaggggtacctaactatttaaagaggtaggaaggatgaccaaggggactctagggtcatgctccacctggttggggcgcaccccacatgggccccacttgggccggagtcccaaacgaagttacaagcccattggcccaatataggggatgtagcaccttgtttttgcaatttctgtcgactgagaaggaattttggaacaaggctggatctgttggaaagaggattccgagagctttccatcaagtactcacggacccaaaacggaggtcgtatgcacatctagccaccatttgaattcagcacagtagcaggtggccgaattggatttcagaatttggatggcttgttcttgaagtgttattcttgatccatgatgtgagcaaaggttgtatccatggtagccatggtcgcatcatgacaagacaattatgccgacaaacaaattcttcaagcatcccaacggaaatcttattgaaggatttgggattgtgcaagagtgcttgtcattcatgacggcaaggaggtgatcttggatttccatgtctttgaaatccaagattttgatgttctaatcgagcacccgattgagtagctcctcattaatactgctcgattagacagcctcaaaatttctataggagggaatgaattctcaattccatcctcgcgggcaaggtttgccctaaccgattccttaccagaagaagaatatgcggaggaagtaatggccgttcttctgcatgagtctctggagtctcttcttgaaaatgaagtcccagatttcattgtaaaagaagatgagcactgtgaaactttcgaacttccaatcttagaatcaccgctgtgacctccgattgagctaaaaccccttccgcaaggaatgcgctatgcttttctatatggtaataaggaagctctagtcattatcagtgacaagctttctgatggcaaaaccagtcgtcttctagccgtctttgaaaaacatcgcgctgttctaggctattcccttcaggatctgaaatggattaatcccgtgctctatactcatcgcaagcccatcgtgcctgagagctcaccgtccagagaaccccaaagacagctgaataatgcgatgagggaagtcgttaagaaagaggtcctgaaactcctgcacgtctggattatctatcctgtgcaatacagcgagtgggatagcccagtccaagtagtgcctaataaaggaggaatgacggttgttgcaaatgctaaaaatgagcttatcccgcaacgaaccatcacaggatggagaatgtgcatagattacaggaaactcaacaaggctacgaaaaaggatcatttttcactacccttcattgatgaaatgttggaacggttggcaaatcattcctatttttgtttccttgatggatactctggctatcatcaaattcccatccatcctgatgatcagagcaagaccacgttcacatgcccgtatggaacctatgcctattataggatgtcattcaggctgtgcaatgctccggtctcttttcagagttgtatgatgtccattttctctgatatgatcgaacatattatggaagtcttcatggatgacttctctgtttatggaaaaaccttcggtcattgcctctagaatttggacaaggtcttgcagcgatgccaagaaaatgacctagtgcttaattgggaaaagtgccacttcatgttccgcgaagggattgttcttggccatcgagtgtccaagagggggattgaagttgatcgggctaagattgaggtgattgatcaactcccacctcctatgaatatcaaagggatccgtagcttcttaggtcactctagcttttatagaaggttcattaaggacttttctacaatcgtcaagccgctcactaacttattagctaaagatgctccttttgagtttgatgatgcgtgcctcaagtcctttgaaatcctcaaaaaggcgctcatctcggctccaatcatccaacctcccgattggacgttacccttcgaaatcatgtgtgatgccaacgacttctctgttggtacggtcttgggccaaaccaaaggtaaaaagcatcacacaatctgttacgctagcaaaactctaaccggagttcatttcttatgcagaagttgttaaaattgatcaggctaaaggtaaatctcaagtgaataatctttcaatgttcaagaggctatctgacaccaagggtgattttctcgttcattctactaaggcctccacagaagttttaaattttaatcagtcaaagggtaaatctcaagtgaataaaccttcagtgttcaaaaggatgttcttttccaatggggattcttacattcgccctcccaaggcttcatcttcaggtacgaaaatcctaccaaagcctgttctaccgtgttcttcgcccatttttttgaattagatgccattttctatgcccgccattactcttgtgcatcattcgggctccctttcaaattcgggcttaaattcggcgttatctgggggtttcaattgctcccgctgtttgggcgctggtcatcggtatgctgattgccccaactcggtgagatgtcgggcctgtttcaattacggccatctagcccgttcctgtttggcccattcaaagaaaaaagtctggaaattgcggtcgatcccgaaatcagcggaaaaatctttggtcaggtttccttctagcgtcgctttgtcttcgcctctctctctcaggtttcctccctgtcacaccccgaagttctcctcccaagcctaaaatttaaatttttttttaaaacgaccccaagaaaatgctggtgaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattcctgggaaaatcctttttccttttttctttttctttttcctctctttttcctccatttttccgaatgggccgcctgcccattctctcctttcttccccctcctccttgttgggccggccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgccgcgtcgcctccgcctcctccgggccacgtcgaccacgcccgcgcgtgcgccgcgttccccgcgcccactcccctctctctcccgctcgcgcccgtgcccgagatggccgggattcgattttcgaatcccgcctctctctcctcccccacttctcccacgttggccggcgaaatcccgcctctcccggccacgtccggccctcccctcccctatttaagcttccccgtcactccctctcgctttttccttttctcgccaaactccctcgtgctctccatcgctcccgcgccgtgcaaccacccgccgccaccgtctccgctactccgaccgccgctagccgccgctaggctcaccgccgcaccgcgccatcgctgccgtcgggttcgcgtggctgagatccaccccgtccacccctctttcgtcgaggtctgtcgccggagagccgttcccgtcgtgcgacggtgagggttgccatgtccgccgccttcggccggccttcccgcctcctatggctcctctcttcctctctaatctctttcgtttcgttctttaggtcgtcccggtcgccgtccgccgcgtgtcgacttccctccgtcgctcctcgtcgccggacgccgccgtcccctccggtgaggactccttcccctttcctttacttcctcgattccccgtgcgtcgctgccgcccgcgctcgccgtcgcctttggtcgttgccgccgtccactgccgtcgctttcgcgtcgcctttgcgccgtcgcctccgccgccggatgccgtcaccggcaacgcgacgcgcgcgtgccaccgccgttagccccgggtcgcccggtcggctttgatgccgagccgagcccagcagctgcctccaccgccgcccgtccgatcggcccgagggcgatctgggccgtcggtcccgtggaccggcgatggaccacccgcgtggtcccggtccacggtgaaccgctccccctgagccgctgaccggtggggcccgcttgccggcgccgcgccccctccgtgctgacgtcagccctgggatttattgtgcaataaatgatttaaggtttttcttgtatagtaataaacatagtgaatcttctaaaattcataattaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgaaatagtcgccgaggttcctccagcagcagagcaaggcaagtcatgcttgtcacttgaccatgttgatcctatattacaaatgctctattgttttctttcaaatattgcattgttttataatattactatgggttgtttacctattgtcatagctatgctattgatgtaccatgtttctttgtcaacttggggttctaacatgattagagttaggactagggattgcttagccatgcttagttcaactagttcacaatggggaaaaaatcctattaatgtttagactattggttctaatggtttgttggattagtaacaccgctttggtgttggttaattaaaataaatcacatggtgggctgtgggtgcatggttttgctggtcgctcccatggcagttaaggaccggttcgcaggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtggcatgtcggcgcatggaaacgtgtcgtggggctgtgtcttgtgggtacagttgtacacatctgatcagagtaaaactattcgaatagccgtgcccgcggttatgggcggtcaaccagattcaccgtgattagtctcaccttagtgtaatcttttgaatttggatagtttaggtggatggatgggcctgtcgcaacgtgggatagcgttggacagtggatgattaatattaattaattattacaactgtttaatctttcaacttctgtttataaatgctcgctttatgcaaataaaccacttcagctcttctttgatgattccctgcatcatacccctattccggtatgacttgctgagtacagtgggtagtactctcagtcttgctctatttttcccaaccccagagttcgagttcgggtcaggtgaaggtttctccgaggagtaggtaccctctcgccctgtgcattgtagagctggcctcaactcttgtaagagatgttctagtgaattcagaacctgtgcttctcggtaattggttccatgcaaactttgttaaacatgatcaacttgcaaactggaggaactccccattcactagagaaggatggttaatgattctaggcattgccctacaccttaagactagagctattattgaacaggctactaacctctgtggggaattcattgactggcactaccgcgataaggtgcttggaagggtattggtcaaggctagatataaatctgttaatgatatccctgctaagttggttttgggtgatgctacggcttttggaggattaggacaatcttggacttttcatgtctttgtcctcaacggtatgccaacatatatcttgccaggtgatgaggaccttttacccatatggcagatgctctctgctccacaggacaacaatgcagaacaacaaaaacaacatttgggaaaattttgattttcatgctgatgatcagaatgatgaagaattttagggagagaatcacatggctgttgacatccctgcgcagcaacctcaagactctctgtcagttcatgattactctacatatgatttagagacaacttggcacttgcagcagcagcagcatctgggttggcagattattccttatggcctgcctcttccatcgctcccgattctcaacttacccgaaccattttgccgggcggtcgctcagggaattttcagacctttgcttcttgcctttcagcctcctttgtgcaagcctgtcattgttctttagagatggtcccttgccagaactgtttgggaggtgaaaataaatgtgatcttgtttcaagacctggaagtcagtccaagtcctgcaaagaggcagaaagtggccattgtaggaagacatgtagcaagatcgctgcaatttgcatctgatgaatccagccttcaaaatgaaattcaagcaactcccaagcccaggaaacagagacaaaaagggcccatatctactgagaatcttagaagaagcccaagattcctgggccaagaaaagcaagacctagactttgacaatccaaaaaagaaatccaaagtccagccagtcagagctcttcttcctgcaattagcaagggtctaccccctccagtccctgttgcccaactccagaaaatcggggtggaaaagtgtggccttcttcctgaggaagtggctgaagcaaaactcctcaagaccaaaaaatgaatcaatttactcttgtttgtaataatgtggctatgcttagccctgctgccctaaagtgtaatagggtagttatctctttctatcaaaactgctttcagtattacttctggacccttcttaagttatgtttaagctctcaggctaagtgctactctcttttgctgtttcatgaaaattctcaagccttttctgttaattgctggtggatgttcttcatgggtgtgcagttaatctctacccatttcagtatatctctctctctttggttaaatgaatctaaatcacaacagaaactgtaatatcctgtgctagaatatcagaggcttaaactctgctcaaaagtggcttacactctctgagaagatttctgaatcttcctgttcaataatctgtcttcaggaaaccaaaagagatttttttgatcattcttacatcagaaaactttgccctagaagatttgacaaattcattttccatccttcgcttgggaactcagggggactaatagttatttggaacaataatacagtttctggaactttgattgaaaacctcccttttgcaatctccatagagtttacttctaa

SEQ ID NO: 25438 - DNA, 1201 bp, Oryza sativa
gggtgattttaccttcattcggtcagtgcaaaataggattcttcctggggaagatatgaatgacattctgatcttcaatgaaatcattagtaatatcgggttgattgaagtccctttaaaaggtttatcttacacctggagcaacatgcaggaacagcctctcttacagcaacttgattgggttttcacatctctagcttggaccctaaaatttcctcacacctcagtcatagctctggctaaatacatctcggatcatgcaccctgcatgatttcaattgaaacttcagttcctaaatccaaattattcagattcgaaaacttttggactgacatgccaggctttatagatgtagtctcccagttctagagtattcctgtcagaggttcaaatcaggccacaaaactgaatggcaagttcaaaaatttgagaagaggtttgaaaagttggagtaaaaggctttataatcttcatgctatcatctcaaactgcaatgaggtattgttatttctggataatattgaagaacaaagacccctttttattcgagaatggaattttagaataatcttgaaagaacatattctatagctgttgaaataccagaatgagttttggaagaaaagatgcacaattagatgggttaaatttggggatgaaaatcctaaatattttcaagcttctgcaacagatagtcacagaaggaacaagaacaagatctcacacttaaaggtggaggacagaagaatctcagctcatgaagtaaaagcgcaagtcttactaaattctttcaaaaacagaatgggtactactgaacatatacaaatggtcctgaacctaaacagtctgattcatagaattcagggcctggaagctctatcctctataccatctaggaatgaaatggatcgaattatcaagaatctaccaattgacagagccccaggaccagatggcttcaatggactgattcttaagtaatgctggcatatcatctccgaagataactattctctagcagaacatttctttagtggaggatcatcaattcagaacctaaacaactcctacattactttaatcccaaagaagcccaacccagaaaccccaaatgattacagaccaattgccctacaaaactctgctctgaaatttatttcaaagataatggccaatagatgtcaatcagtcattctgaat

SEQ ID NO: 25439 - DNA, 1975 bp, Oryza sativa
ttaggctgaacatcttgagcaacttcttgagccgctaggcagacatgttcgaagcttctatggaaatcaggggggagggtcacttcctaaggatacatcagttgctgtatgtaccatagagaaggccaattctttggtaaacaagttgttggaggaaggccgtctttctgaacttggcataatagtaatagatgagcttcatatggtaagttaaaccaatttggtcctcaaaatttctccattttctttactttcaagatgttgcattggcttcttgcttatgtttacttttgtgagtcatgggcatgggtcccattcatggcggatactcaaacacagtatcttccgctgacataacctattcccatgacaaatttctaacgtgtattgggatttaacttttatttcacctaataggcatctgtacacttaagagatacatacatagtgacattaagtgcatggatgtaatcatatctaagtaattcagaaattacatagctatttgacatgatcttcaacattttcaagctaaccattgacaagacatatagataagagatttatactagttgatcttagtcttatagaattagtacttattgttctgaaaatcagtttatcttaatgacagtatttgttgttgttccatgtaaaatggttttgaaaaatgggaaattggtttggtaccaacaaaatattacccttttaggtttgtacactgatatttttggttcacttccattaccttatttgaaatttctgtgctctctttgcgagaggaacacttgtaaaatgcctgacttactactgtatgttcctattacctgttgccacttggccagctgatgctggcgagtgaagtgatatagattcatgagagagagatacagaggggaaaattgccatgataagagcaaattgggcaaatttgagagcgctgaagtaggtaaagcgatttaggtgggatggaaaattcaggtggtataaaactaaacaaatcaaaatttggtggtatgaaaaattaccttttcatttgaaaaacataattctgccatccaatatattgtaaatgcggtacttccagaggacatgccaatgtagtgtacatacaatataatacatgtgatttttggcctatactcaatatttgcaagtttgaaagttcttgatcacactgcgaaatgaatctcttcacattacaatatttgaagtactaacagtgtgcatgtgcattacaaccgaagttggtcttcattatattggaacatattggtgtacttttttttttttaaaagagaagatgagtttaccataacatattggtcaatgcttttgattagggaccagtctagcatttctcgttgctttccccattttttttgaaaaattcaatgccaaaaatataacaaaataaaagtgtttcgagaagcatttgttatgtcaagaatattgtgtctctgagtcccaagtcctgacctattcctgtttacctttcccctcatgcaatttgaagttcttttcttcttcctttggaagtcctttggatgttgaagaacatgcaatttttgagtgaatcgcacattgtgccacctattattaccaaagtttcactttgtaccaccacctgagcaatgcctttacttcagactaggttagatatcatttccattgcactttggaccacctcttcctcttcacccctctcagcctttcttctctccaaaactttggctcatcaacatcactacaaagagaagagaggaggaggatattgactgacaggatcaaattcagccactggcagtgccatgagttgaccaattgacagcgtgaggaggcggtctggtttgactagttcggccaacacaagcttgtccacggtacctctattagcagagccctgccactgtgcccctttgtcaatccctactgctatccgctgcactgttagacacagagttccagatggtgg

SEQ ID NO: 25440 - DNA, 2590 bp, Oryza sativa
taattcttgatctttttggtcaatatgaaaggctgagtgtgacaaagtcttttgtgtttcaagtggcattttactttatcgtaaaactaaaattggatgattcatgtgtatctgatattctgctgcataattaggctgcactttaccaaacagaatttcgacctgttccgctggaggaatttattaaagtcggtaatcaggtctttgataaagatatgaatgttgttcgcgtgcttccaaaagtagctgatcttggcggtaaggatccagaccatattgttgagttgtgcaatgaggtaaatactttgcgctatttagtctccagtaaccgattccttactatctaaaatatatgtgtacacatctaccttgttttgcttcccaggttgttcagcaggggcattctgttcttttgttttgctccagccggaaaggctgtgaatcaactgcaagacatgttgccaagtttttgaaagtggcttctgttggatcaagtgacgttggctcagaatttccagatgctacatttgcagttgaagccttgaagaggagcccttctgggttagatcctgtattagaagagacccttccctctggagttgcataccatcatgctggtttaacggtattgtaattttactataatttctcatatcatgccatgaagagttggtggaccttatttatgccattgtcgttgcccctaagcatttagaatctgcactgcgtagctgaatgaccttttttttactacattttagtagatgctgttttgaatttattactaatttctaaaaccattccattacttcatgacaacctttatctttcagtaggactgtaggaaacatgaatgtatgcattgtacttttcttgatgtctattttgacaactattctcctagctattgatgatcgtgagcttataatatgtagtcatttctgtttcatacaagtacggctttctcttttggcaggttgaggagagggagattgtggaaacatgttaccgtaaaggtcttgtcagagttttggctgccacttcaactttagctgctggtgttaacttgcctgccagacgagtaatatttaggcaacctaggataggtcgtgacttcattgatggaactcggtacaagcaaatgtctggtcgtgctggtagaactggcatagatacaaagggagagagtgtaagatatgaaactttcatttatactagatgtttcccatgaattcatcagcttagtttcaattttttatttatgtatctggttgtgctgatgttttcttgtttatgaatgtctaatactttgatatttgaaatgtagatacttgtatgcaagcctgaagaggtcaagaggattacaggtattcttagaagtaactgtactcccttggagtcttgcctctcagaagataaaaatggaatgactcatgcaatcatggaggttgttgctggtggaattgtgcaaactgcaagtgatatccatcgatatgtgaggtgtacgctgcttaactctactaaaccttttgaggatgttgtgaagtcagctcaggactcccttcgttggttatgccataaaaggtttcttgagtggaataatgaaactaaaatatactctactactccacttgggctagcagcttttggcagttcacttaatcctgaggaatcgttggtaggttactttctttagttattttcaatattttttaaatttaatcttacaattttctatttctctgtgtaggtcgtgctggatgatctttcaagggcaagagaaggctttgttctggcatgtgatttgcatttggtttacctggtaaccccgataaatgtagatgtcgaacctgattgggaattgtactatgagaggttcatgcaacttacttctcttgagcaggtatttctgttgcatcttagaacgttttttctccaacaattagtctgagtacatgtaatattttcatatcctatttgtgtatatcaatagtaaaggaccacagactgattcttgctattgtctatattgtccttatagcctgacaggcaaccatccttttcaagtgaaaaatgtatatatttttctctttacccaagtaaaaaggtgaacactaagatgacatattgagatgatcagataacttaaaatgtatcaagtgatgttgtcaaggaggtggcattaaacagtatgttgttttactcttattgtaaaatggtagtgatactaaatcaaataatattcatgtaatgcatcacaaggccatgaactcatgcacccactttacaagttcatggcactatgctagaacttactctattttatctatagtattgatgcttgttggtaatgtgcagtcagttggcaaccgggttggagtaatagaaccatttttgatgcacatggctcatggggctgcaatgcctgttcgtggaaaacctcagcgtgctggtatccgcaacaggtcaccaacacgaggttctggtggaaatgcacttattaatgagcaggcacttcgagtttctaagcgcttttatgtggccttgatgttgtcaaggcttgctcaggtataattcaactctgcaagat

SEQ ID NO: 25441 - DNA, 934 bp, Oryza sativa
ctttcaagtcacttggtgtacaagttcctcagtttactacacctctactcccaactatcgatgaacccccaactcgagatagcatggtttctgttggcagaggtcaagctagtgatgatacaaataactgcttcagttatggttctcaaagggcttctacagagagaactttagggaacgatatgcaccctggttcttccatacaaataacagagagtgcaagaatagtgaataatgccaacatcgttgtccaagtagcatcacctttctccatagaaactaaattaagcagcagaaatgtggctgacaaaggccctgttaatgcatataatttcccaggagggtttgacagttttcttgatcaatggtctactgttagtgagttttcttttgatcttcattatgtcaagaagtcaattaaatcatcttcaacctatttcgatattcttggtttggctgtctgttgggaaaattcacctgtttactactgcaactttccgaaagacctaatgatggctggtagcaatgactccattgaaatgtgggacgaactaacgagaagatggaacagagtaatcgaaattatgcgacaaaacagtgtcaaaaaaatgacctggaatttaaagttccagattcaagcattgaagtatccctgtgtttcttgtcaacggctctctagacttcatcttgactacaaaatgttgaagaatgttgaagtcctcgacaacttgtatgttttcctacaaccagtttctgtccacagtggattggacatatgcttggtggcatgggttctctggcctgatgaggaaagtaaaacagtgccaaatcttgagaaggtataatatcttatgctgtgatatagaactcatgcttggtttcctctttaaatgttttcatggcaatctctttcaaccttaacatttcccaatga

SEQ ID NO: 25442 - DNA, 12457 bp, Oryza sativa
  unsure (1)..(12457): unsure at all n locations
aaatcgagatggcagatggagaaatcagatgcacaaagcagctcataatggttgctgtcggcgtgctgcacagacacgggcattgtgttctgttttgaggaaattacttgtttctcaaaatctcaatgatttactcgaaacaattgagggcccattggtacgttctacccttgccaaaatgcaatattgtcatcaaatgctttgacattcacattatatttgttgggcaggtaaatgttcttgctgatatggaactttggggaattggtgctgacatggatgcatgtctccgtgcgaggcatatcataataagaaagctgaaagaactagagaaagaagcttataaattagctggcaagagcttctcactaannnnnnnnnnnnnnnnnnnnnnngttctttatacacacttaaaactgccagttccaaaaggttgtgggaaaggaaaattgcatcctagcactgacaagcagtccttggaccatctaaggtataaatttgatctatttgttgtgtgtgtcatttctaggcattgcaaattcattatattagcaagtgtttttttttcctttcaatgtgccagtcacaaacttttcatgattcaagcatttttgaaatttaaaatgtatttccttgtatatctagtctcaacaatggttcactgacataatgtcttcatgttgcattatgtctggattgaagtatccttgtgtccattctagtttctgcatgttgaagatgtcattacggtgttgtcttgatctaagctggaattattggggtgccatcacattttattattatgtctgattacagtatgtttcaagagttgcatgtcatgtttggcttggtgcttcaaagaattatagtaaagtgagggtcagggaaggaagaaaataattcttacgcctttcagaatgtcatggcaatgctggctcagaatttgttgaacatgccaatgagttggccagggaaactttattacaagtagtgctgtaatctgtatattcttttgatgcttcactcaaccctcacgtaattttttgcaagtttcccaaggaaagtgtttgcactggtaacaataagatttcagtaaatgtggagaattgctcttgttgaacttctaacttagatcatcactccgtctaatagtcttttgctctgtttattcagggattgacatgtatttagagatgctttggttttgttcatttttaatacagtgtcatattattatgctctttttattcagggatcaacatccaattatatctgtaattaaggaacatagaacattggcaaaactgttaaatggcaccttggggtccatttgctcacgggctcagttgtgcagcaaatcacaaagatacatcatacaaggaaattggctccagacatcaactgccactggccgtctatcaatggaagaaccaaatctgcaggttatgttacattattgctagtgttttgtataatatgattatattcataggtcatagcaatgattgactgcattttttccttagaaaaaaaactgactgaactataatttgtagtgtgttgagcacttggtggatttcacaacattgaagaatgatcatgattccacaagcatgtcaatggttgatcatcatgaaatcaatcctcgtgattttttcattcccacccaagtattgctcactcaacaattgtttcatgctgtatatattttcctatcgcaagtaaggtaattttgtggtctcctttttgctaggagaattggttgctggtaacagctgattactcacagatcgagctgcgtttaatggctcatttttctaaagatactgcattgattgaacttctaagtaaaccagatggtgatgtatttactatgattgcttcaagatggactggtaaagcggagtccttgatctgttcaaaggaaagagagaccaccaaaagatttatttatggcatcctctatggaatgggtgccaactctctagcagaacaacttgaatgcagcccagaagatgctgcacagaaaatccaaagttttaagaggttctttcctggtgtctcttcatggctacacgaagctgtggcatcatgtcgtcataaagggttagtttgctttgtcatagccatttctgccttttatgctctgatatgttttccctttgatttttttatcttttcttttgaggtgaaacattaggggtagaccctactcgaagtatagagtaaattgcattggtggtacatgaacattttttaagcgagtacacaaacttataaaacacttattttgatgcgcaaacttgttttgtgcgtgcgaacctaggctaaaaggcatatctggctgctattggtaagttgggtgctaattaggatgcctcgtaggcacacacatgagaacatagtactgagtaaacgtagtactccctccggttccataattcttgatgttttggacaatgacatggttttcaaaatatatctttgactttgtttttctattgtaatatattcaataaataaatgcatgtttacttttcttatagtactttgaaagataaatctatatatgttgttctatttcctttaagctttatatttttaaagttattgatgatcaaagttataaaagtttgacctctaccttggccaaaacgtcaagaattatggaacggagggagtactatattataacgatgatactacaaagaaaacatataaaatatagacgaatgatgcagtggatagaaacaaagaaagaacaaactagaatcaaaatatagaggtgatttgcacatgtaataagtctcttgtcctcaggtatgcacgtaacatcgtacttagcgtccaactcggtaaatttagtcacaatgtgttgttttagcatcagtttgcgtgcattggacaagttcatgtaccaaaagaactgttttacaagtttgtgtacttgatcgtacccatctaacaagtttatgtaccgccaatgcaattaacttggaaatatatatagcagttttaggcaccatgttgccaaggcagaaagcacccacatagatacacccgttgcagtactgtgaggattgttgcattcgacgtgggcatcgtcttatacccacaagtgtttttgagatagaaattgtgaagaaaaaaatgagtatattgtatattggggcacctatcattgccaaagtttcacctattgatcgaatgagcaatgttttcactgagtgagggccaggtagtatttcctttttgttgcactttgaagtttgaaccaatccctccctccatcgctctcactcgtcttccttaactttggatggccatctccttgatcaatggcagcatgacatgaggtgaggatgggagtcggcaggctccagtttggcaacttacagcggtgtgaggtgatagggctgcagcataagtaatttacctgctgctaccttgggcgtggcacaccagattggaatgacatgtgtccagctggcacatctttgtgagctctgccactgctcccctcattgagcgtttgccactagtagccaactagccattgatcgaggaggctggaaaaaaaaaagaattcaacttgagttaaatttgtttgaactagtttcaattagatcaatatgttgacccgtgtcaatcatttttgttattttgaccagtgtggtagctggcaatatagcatgcatgattgttaatgaaatctaagttttccaagttaaaaaacatattgatgaagcacattttctggactgttcacaatgccttgtgcactactccctcatcccaaaataagttaacctagtacaggaaaataaggtaacctagtacaggtgcctgtccagattcgtagtactatgatatatcacatcctgtactggtttacttattttgggacggaggacggagggagtactagaagctgaggacaaccttaaacaagaaacagctaacacacgggtgaataggtgcatctaattcagttaatctaagaccagtgcaagaggtgtattcacagtgctatgaaaagaagaatgggggtacaacacgcatgaggttgcgtaacctacagggaaaggcacatctgtgctttctgccaatgtgtagaagtacatatcttataaagcatgaatcctctgcttcattttataaccacccacatgtcaatacttaaaggtagtgcctaagctattatcacttatcaggtatgtggagaccttaatgggaaggagacgttttctttcaaaaataacagccggaaatagcaaggagaaagcaaaggcacagagacaagcagttaattctatttgccaggtaatagagcaaccatctttcttaagctgctaggttcttaattcactgcaatacagtatttaagtgcaagtctttccagggttctgcagctgatattatcaaagtggctatgattaaagttcattctgcaattacaaatgggagcacggtgggagcaacagttgattcaattgatgtggctatgcagaacttttctgaaatcagaggccgttgtcaccttattctgcaggtatttgatgaagctatcatgaaatatcccatttttcctggtcatacatacatatatgtatgtatcccattttccatcgttgttctgttagtttgcttgtttagatgatggtaatcctcttctgtgttttaggtgcatgatgaactggtgcttgaagttgatccatgtatggtagcggaggctgtaaggttactacagactgtcatggagaactctgcttcactcttaggtatcactttctaatctgaagttctgaatcggatactgctagttttcattttcaagctgaaaattgaatcgctatttgtttctttcaccagtgcctttacgcactaaaataaaggtaggacaaacttggggttctttagaaccgttccatctagaaccttgacgcgatggtgaatgcttctttggagcaaggtcccaagaaatcatctgtttgttaatggaaaggctaaggtgccattgcagtcagaaaggctgggtcaggttattcttgcaaacttctctgaagccatgtttgatctgccaagtctgacaccactttggattcgaacttactgtagcacgattgatgttgccaggttacataaattgataaatgcattccttatttcataccttctaaattctggttttggaaatagtttttgttctatcaaatctgaaacttgaatcaggtgatttctctttctgcagggccttcggtctcctttcttttattacgtgccaccttgaatctatataaaacaggttacattgcttcagttacggagtccattgttgagaatgaggattgaaggacaggccaacggttccgactgaagctgcagtaccgcctatacaggattcatcacattattcatagagcagacaaggggaacatctcaaggggacatccacttctacagtatatatatattttttttgcgaggacttctacagtatatatgttgtactgtaaatggacagactgtaatagcttgttcattcttttttgcctgatgtcttgattatgtatatattgattatagaggtgttgctcgagttgaagacttgtgaaactgtcatgttgcacagtacttatcatttatgagagtaacatcgttcgttgctctttttgtgcattgtattgtacagtattgggttacattgcactcgagcaaacttttgcgagtcgtgttgcttgcttattttcaatctatagctgcatctttcttggtcgccctagctatatgtatggtcgttgttgagaaatgaggaatgactgccaaagcaacaaattgaccttatttacgttgaagggcagggtgctgctagcgctttggctatcaagaatgctagtattcttttttttcctatcctttacaaagtcaagtgtcacaaacgaatcgctgtgttccgttcttgattgtatgtcatcctttgcattccattggatgtaacatcgtcttttctttcttgccaaattagatattgtctgcgggaatgtaataagttagctgatgctatagtatccattggatgtaacagtcccccaaacaccgatcttttgggacggtgcacctccgggcgttgagggtttggttgccggcgattttgtcgctttcatgggttaatggaaacatgaagttttccttaaaaaaaaaaactttgcattcctttgtcgcgcagaggcggttcgtccgtcagcttttccgatgaagcaattgccatattgccataattgctactgatactccatcccaattgttcttggaaactatatcatctcatgttgttttcttaaaataaattatcataaccatctctcttttcttccatttcatctctctatcccctcatatattgaactggtttcttacatgataaatgatttcttcatctttttgttttctctgctcaactcttttgcaacatcattttttttcttcttacttatcaacatattaatgctataaaaattagttgaagtgaagggtttcggattgcactaaccatcatatattgcccatttgcattgatgttgatcggtgaaatcgtacactccattccacgcacacgacgcatcgtacattgcacaaattcgggactagatacgctacaacccactaacttaggtagggatgtgatcccttctagtacgatgaatctggatatccatatatcaaaattcattataataagggaccacctatacatttgtcgacaaattttctcctaaaaatttgacagatgtaattatagtataatcgtagtgtaattacactgtaacttatatgtaattacactgtaacttgcaggtaactacagtgtaacttgtatataagtttcacgtaattttgaatcgttaaatctattacaagatttgttttattgaggaagaaaaaaaaatcacgacacacacatatgtgtaaggatttattctcacaatctccattttatcgaaataacatattacacagatatttttgaaagttacatacaagttacactatagttacagtgtaattacatgcaagttacagtgtaattacactatgattgtactgtaattacatctgtcaaatttttgggagaaaaattgttgacaaatatatagcaaaatcgttataataaaaggggttacatcctttttagttgagttttttttttaaatggagagagtagcaacgagcaaagcataattttcgtactgtaccattttgcttgggaacgaacaaaactagagaggctgagcaaccaacaagacacggccagggtggatcgcccatcccgtccctgtggtccagaggataagccgcaccaccacgcgccgacacgtggctgccgacctgatgggcctgccagcttggccggccgcatcatccccggcgaagcggcagccactcctccccaatcctctcggcagccaaccgtggccatggatgaaatgacatgatacgattgctgtttatataagctgctggtgaaccagcgtacagggcctcaacagcactgctactggacatactctactactactagccagtaagctagctaactaactacgtggctatggcccccaccgtgatggcctcctcggccacctccgtggctccattccaagggctcaagtccaccgccgggctccccgtcagccgccgctccaccaactcgggcttcggcaacgtcagcaatggcggaaggatcaagtgcatgcaggtatatatgatatatacctcctcaggcttctcctttaaagtcaaggatcaaattaactcatgttacgaaattcaaattaacctgatttaaatttttacattatttattcaggtgtggccaattgagggcatcaagaagttcgagaccctatcgtacctgccaccactcaccgtggaggatcttttgaagcagatcgagtacctgcttcgatccaagtgggtgccttgcctcgagttcagcaaggttggattcgtctaccgtgagaaccacaggtctcccgggtactacgatggcaggtattggaccatgtggaagctgcccatgttcggctgcaccgatgccacccaggtgctcaaggagctcgaggaggccaagaaggcctaccccgatgcctttgtccgtatcatcggcttcgacaacgtcaggcaggtgcagttgattagcttcatcgcctacaagcccccaggttgcgaggagtctggtggcaactaagctaagatcaagcatcgcgctggtggattgctgcctataataatagtatgcagctttgttttgggctatgttgatgatatatcaatatataatatgctatatatttttattttacagtttggttatgtaccatctcaatggcctctgctcttaacacatatgtaataatctcttccctccctctccggccggttttattgtaagagtactacaattatcgttgggtgaggatatgtgaaaacaaagctccggctatatacacacaagatatgtatctagagcatatctgataaattcgtcgacaataaaaaaaatggatggtatcacgtaattatgtttgtttttaagtatttgtttgcaatgtttgtttctatgtttaaccgaatgtattgtgaatataggatctgacataattatttgtgtaagttaattagtaaacgaatgtatttctttttgagagaacaatgatttgatcttttgtgcaacggctgataagtccttaaaaaaatgaataaatcaaacaacaataatttatctcagcacagtacatctcagttcacctgactgagcacgttagcaacgagcacagcatatttttcatattttgcttgggaaaacaaacaaaagttagcaatcaacgacacacggccaggttggatggatcgcccgtctcgtccccgtggtccagaggataaggctgatagccatgccagcctgcccgcccgcatcttcaccggcgagccgcagccactcctccccaatcctgtcggtaaccatccaaagcgggaaatttaactatttgccactcttatgacatggtaattaacgatttgccacgttctgtcaataacacgtgggccctcatgtgtctatgacatgtaggtctagtgacaaatcgttaagcactattcgtaagagtggcaaatagttaaaagctccatccaaagcaacgggcatggcttacatttctaatcatttgagagggtgtttccttgtgtatctttttctaaattcaatacaaatagttacttctttaaaatattaaaaatatagagtatagtgatatacaacactctaaaaaaaacatcaagtttaaatacaacgtacacattgagaatcaaaagaaacggaagtcgaatgtaaatagtactcttttttatatatcaactatgaattgaatttggatataaatataaatgttattaaattgtttgagaatttttctataactatttgaatgatttttagaaaaaaaattcctcaagcaatgcttgagtttaagatgggggtattcacttaacctttacaaacctcatgtccctagctagtagtgtttagtgggaaaaagttagggtatttaagatagttggttaatagattagaagtggtgtgagataggagtaaaaagaagtggatttatctctattattataaaaattgaagatgtttttgtcgatacgttggtacgttatccgtgcatgagtcgatttttaattttgttcgcttttggaaatacatatccgcatttgagtcacttcgctcacttttagaaatacataaggactcgtataagatatctatttaaaaaaacccgcatgctaacttgagatgattagactcctaatgtagctcatgattatatatatatatatatatatatatatgtgtgtgtgtgtgtgtccaagccaattatcacagtgaatttcatcttaactaaaccatataacaacaataagattaaaataaccttcgcctgttgtgaggcacggacatttttttcatgttgagaaaaacgatcgagagtgacgtattagatgtagttaaatatatacatatgagatatatctatatatattaactttatttcatattttttttgggttttccggaaatgctcaggatcgatcccattgggtctgcccctgccctttgagatcgaaacagttccatagttggcgttatataaggtgctggagcctcaaattgagacatgcaatcatcctctctttatttctactgctaagcacataactactctagtactaataagctagctaactaagggtctgttaagattgatgccaagagacatgcaatcatcctctctttatttctactgctaagcacataactactctagtactaataagctagctaactaagggcctgttcagattgatgccaaaataagccttaccaaaatttatcaatgccaaaattttgataaattgacaatattaccaaaattttagtaagattggcttaataatgttgccaaaattatataaacattactaatatttagtaacaaactaaacgcagtcacataattattaattttaccaaataatgatatggttgaaaatgtcatcaatctaaaaggccctagctacgtaactatggctcccattgtcatagcctccttggccacctccgtggctccattccaggggctcaagtccaccgccggcctcccagtgagccgccgctccaccaactcaggcttcggcgacatcaccaacggcggaaggatcaagtgcatgcaggtaccatacgtcctcagcttcttcttcaaagtgatcgtgtaggatcgaatacagagaagcctattaaaggtagtgtaaatctctatctttgtttagcttttcggtgacatgcaaaacgtgataaactattagcatataaataattaagtattaattattataaacttaaaataaagtttatttgattctttcaagaaactactatataaaaattatttttgcaaaaaaaaaacaaaccatttaaccatttgaaaaacatactaacagaaaataaaaaaaagttgaagtttggagttgaaaaaaaaagaaacggctaaaagggatgaatgttagataaaatcaaagaaagtcagacagtcaaaagtttgaaaaacaaaaactaacccaacctaaaaatcctaaagaacatttctggcggtctgagcggacccatcgtactaaaaacatagttatgtaaaaacatgttttctctaaaactagctattggattaaagccaaaacttgttataataaagtagacaaaccatagaacaactccactgggtgaatttgcaaaccaatcaatgtttaagagaaaacatcctcaaaatgtctgttgcctcaaattttaccaaatctaaacatagcctaaaatttaagaaaatttgaaaccttccatatctgatctatgaagtattagaaatgttattaacttaaacaaaattgccgaaaaatgaagaatcacaaattaatgacaagacgaaacaaaatgtaaaacctacacaaccgaaaaagatcatcgacgccttgatgattgaatatgatctttattgtcaagcattgtccataaggtgtagccacaacacctctcacaaaatctctcaaaaccctaacacaatgagccctaatatctcgaatgtctcaattgtctttaccctcaaggcatatcctcactctctatttgtacccatggatgtggttgttcatagccacgagctcaactaaaaataggaatcataataacataggaaacccctcaaattaaggttacactcatccttttacaaatacggactcaattacaactcaaacttggacaccttccaaacttgacccctttccatacacatacatatcctcatgtatcctgcatgatctcctttcgcttgagcatcctacataatctcctagattgtctagacctcaacgtttcccaagtttactcccgattcatcagtgggaatactcccgttgttttaagcaacacctacatatagacaatcaagaaactatatccaagtacaagttctttccaacttaactcacattaacataaatgtagttcataatacacacatgaaacatctagaagtcataaacattaagcaccaaatgcaaaactcaattttaccccgaaaccgactccaaccaagaataccctggaccacctttagcattcctccagtcggtccaccatgtactagcttgaccatcaaggtcggtcctccatgtataggtcggaacatctagccttgtccagaacgcttcgctaatttaaacacttcaccaaagtcaattcaaacacttgtacaactagttgttcatcctaaaaccttaaatcagcacaatgattacacggatcaatcaaactaactgatgttcaaaagttcagagtgacctgatt

SEQ ID NO: 25443 - DNA, 15081 bp, Oryza sativa
agctcgaggaggccaagaaggcatacccagatgcattcattcacatcgtcggctttgacaacgtcaggcatgtgcagtgcattagcttcatcgcctaaaagccccccgagttacaaggaaagcaactcctttgacgtaaaattagacggatagaagtccctaataggtggagcccatcctcatgggaccacacatcaagggcttcatggcctacaagcccctgggttgtgaggagtccgacacaactaagccaagatcaagcatcacagcacaaaagtaatgtctctttagcaatgcatagtttctaggagccaaaataatctatatgcattgcctttgctgttgttacaaggatatgtgctaatacatggttatgcttggtaataacgctgcaatgttgcaacggataagttcagctggaacactactttaatatacgtttctaccttctataattgccatctttattttgcattatatttttttttcagttatcataataatcaaattaattgtatgatataatattggaatgtttaaatcacatcaataggcaatgaacatcaacgcatcatttcattcataagtaggaacgatatattttttgggaatacaatataatcttacaaaaatgcttttgcaaaatcaaattaacatgtcccacacctgaatcgaatgctccaccaaggttgctagaggcgtgtcacgagtaccttcgatagaacctgccgaaattagtttggggctgtccaggcgaagcatgacaacaaaaccctgattgctgtgaaggcgaaggattagggcgaaccacgtggcaaagcccaggaccttcgcccccaagccaaatgtcttcgcccagtccaatggtcttagggcccgaaggggtcaactagacaacgaaggcccaccttgcggcccaagaagatgcccagggttaaattttctgtaattatcctcataaatgtccctatcgtaagtgtatctatgtaaattcccttgtaccaagtaaacctagggtgcatgcgtttgtactaagcctataaatagaccccaaggggcatttattggggggatccaaaaatttcaatattaatacataatttttacatttccacaaagagtgaaccacatccttcgacggacgcagttgtcattcgacaatagctggaaccgtctgtggggaacccagaccaaaaccactaattattcctccgtcagtttgattacctcagttgttggtagtggtcttttgttgttgaggttgtccttgaggtaacgcgcgtaggtgggcacttgcattgtgtccaacaatggcacgatgatgtggattttctggatcacctaaacaaaacgagcaaactgctcgtccaccaatggcttcttgtatctttgagggaatggcaacagccttgtgtcgcagtactcttgcggcaaggtcttctctggctgaacctcttcattaaccgtgttgtcagatggtgcttcccgagtgtggctagctcctgcaggattaggatatggcggatcgcgagtggacttacctcccctcatcgtgatcgccttaacattttcaacagaggatttgggttgccccagaatccttccagattcattagcaggtactagagcagctaattgtgccaaccgggtttcaatcattttattaaaactcagctggtcttgaaatgcagaagcgaagccatctagcttaacatttatattttccagggtcttgtcattagcagctagctttttgctaagagcatctgtagttttggtttgcgcaaaaacaagatccttcaaggaaggttggttagagaaattaccgttattgttgcctccttggaaatatgggcatggctggttctactattgacctccttgtggtcggaacccgttgttgttgttgttgcccatatacatcgcctcttcatgggtttctgagtagtcgttcctagaatgacccgtgccgccgcagacttcacacgtaaagtgcgagtctcatgccttgacggtgcctttaggtcatttctcgtggtcgtccaagcgttttatgatgaggtccagttttgcagcgagcatctccgtctccttgacggtgtgcattcttcgctgacgggtctagagtcgttcctcgctccagcacatgttggagaccttcttctctatgagatcgacggctcctctgcccgtcttagagaagaaggctcctccagctgccgcgtctaggtgatcacgggacgtgggagtgagtccattatagaagttctgcaggatcagccagtcgtccatcccatgatgaggacaggcagccacatactccagtagtcgttcccacgcctcgggaatagactcgtctcttgtctgctggaaacttgagattctcccacgtagggcattggttttgcccattgggaagaactttgataagaatgccgttgagcatttgtcccaggtgttggtcgtagcgaagttggcataaaaccactgcttcgctttcccaaggagagaaaacggaaacaatcggagcctgacggcgtcaggattgacgcccttcatcgtgtacgtgctgcaaatctccaggaactgttgcaggtttgcattggcatcatcgtctggcttgctacagaatgggctagcctgcgtcatcgtgatgaggctggacttcagatcaaagtccatgtctcccatgttgatttgcggcccagtggccatgttgtcaacagagggagcagcggactcgctgagggtcatgtcagccatggttttgaaggttggtggcacgggaatggctggtttctagtaacaatccggcccaggtggggttggccgaggcccaacaaattaaggttgcccggaccccaacagttcttgggcacatccactcggggaaaggcccaatctctctaaaagactagtccaataggggaagggtgactctccctttaaggtggcttcctcctcccaagctaagcaaggtgggattattcagaggctcacacggtcgccgcccgacttttgcgtctttgccatcgggtaatagtggaggatgtcctcatcagtttctttgtcgggagagttttctgtggagcaacgacccgcggcttgacgctccaaaagaaaacttctggattttccttgaaactttccggcaagttgaaatcagtcatacactaccctgtttccacaataaaagtgaaaacaaccaaggttagcatgcaaagcacaatgattatacagaggttaatataaagtattagttatgtaatctcttttataaatcttctccggcaacggcttaaaaatgcttattggtatttcttaacgacattactagaaatataattcccagcaatggcgcagaaatactccttgtatattatggttacagagttcatccgcaagcgcacggatatactattgtagtatttcacccgagagtattcaaagggtatcgtatttgtttaatcccgtgggaagattataatagagagaaccatactaataatttatatattacttgtgataaccaaagtctaaacaggggttaatgtaatccaaagggtagagtgacactaagcagaagaattaatactctcatacataattatctaaactaagtggaaagaaaatagagagaacctattcctatatttctagtgtttgatgaaaacaaaacaacgaacacacagaaataaggaaaccctgtattttattaatcacgattcattaacatgaatgttacaaatacatgagggctcccgtaggagttcgccttttgccttcgcgaggaatgcttaatagaaagatatgctgactggagattgcgtgcagtccgctgattcccggcgcctagcaatgagactaccggttaattacatccataggacgagcctacggaacacctccgattaagctgcgctttgtgattgtcatcttcaaaattaattactcgccgaaggttgaggttggtgcagatttaatggtgaatatagtgaatgtggaacaggtggctttatttcgccaaaacccgatcacaatacactaccaacacgtcggtgtgcggagagaatttggtgaagcgggtgacatttgcctcgtcggtacccagtcatgtatcccggccttcatcaaacatagattttatggtttcttttgcctcgtcggtgcccagcaacggtgtatccggctcccgtccattttagacgtgttaatagtatagtgacctggccttgtcggcactcggccatgatttcgtctagcctcatcggtaatagacaaatgaaatgaatgaatagcagtagccctgttagctttagccaatacgtcgcccggcctcgtcggtctcggacgtagcacaaatattgatgaatcggccatttcatctcgtcggtattcagccacgatgacgacgtgtattttaaatctgcacgcctcgccctcatggctagcgttgttttattgtgcgaataatgcttgtcttcaggaattgtgagaattgctcccatccatccgatagatttttgagagggaaagaattgctcccgtacatgacatgcacaaggcaatatgtgactcatctgacatgaatataaatatgtatagatcatggttggtctgatgctaataagactcaaactcatcctaagtttatacaaataaatatccacatccaatatttgatattgataatttagacggttcaaccctcacgagggtcaggctcgccttgtatttatttgcggcccatattaatcgcttgacaaaatgacgtgtgcgtctgcatgcgccactggggatacttatatccatggctacaattcacaacgcatccacgacatattcaccagtactccactttactgttttaccgtccaggctgcgcaactgcacaaccctacggtgtatatttgctccctctagaagataatgccgggctatgcataatatctgcacagtactacgacgctgttgtattgtcgatgacaaatagcttgacgaagaaattatgttgatgaagcgcggctcgacggaaggcgaatgattaatttagagttgcaccagcgacgatgaagcatactccttgacgttgacgattactttgccttctcctgattcctcccaaatatttgtgtggctataatattcaccatcaccagcacaggcctgcatcttggcgcagcgcctggcggcggcgtgtacgcgtgtgcgcccctcgcgaggagggcgatcaggccctttatataggcagagcagcagcaacggcgcggcctcatcctcgcgagttttcagcgtcgtcgacgtgttgtagataatcaatcaaccacctactgtagataaggaaattaacaaatcgcctgcatgcagaagcaatcacgacattaaatagctaatgacagtgggccccatgaatatatcatatgtgtttgtttgccatgatttatctcctcggcacagataaaccatgcacaaccatagagataatcttaagattaggatagcaaatgacagtgggccacacatgttgtttgccttggcttatcacttcgttattagagataatgcccaaatcaatcacaacaaaccaacccaagtacgtataatgctagtactagctgatttttccatttcaccaactcatatctcttcaatggttgattcgagaagcaacccctgattgccgagtttcttatgacaatccatcatgaccatccaaccggggctaaatacggaggagtaccctccccaggaaagtaacttaggactatatacacgcgcggaggaatacccgtactgagctgtcaccatcaacggcccacctcgcttccgcatcatataaccccaaataatgatatccagtaatctaaacaccacgcttaaattaccaaatactactctaatatcatcgtcatgacatagagtcatcgtatgcacgttcattatacccacactattgcatttcccagtttagctagcatcataatcaatataactcggatatatagtaaagttagtattcatatactcgtaaagtaatacaataccagagtagtataaagaagaatattctaataaaagtactaagtcttacaaaggaaggaaaactactagagctatattcgaactcttccgaagactctgaggattgaagattctattctatttctattccactgtactctagagactatactaaacttgagaaatgtatgaagcttcttgcttgaggtgtgtggaagaagtgagaaggtgaaggtcttatatagctttccaatgacggttgtgacggttggaatggtcggatataccctctaactgtcattgggagctaatccacaccgtccacgccaagccctgcatccaatggtgatgtggggggttcggtcgaacccactggttcagccgaaccatgggccggcccaaccagcccacatttcggctagtggcctcctcgtgttcttctcttcccagacttgtgaattttagcccaatttgagtatgccacttctgagttcttgccccaccttcctctaagtccgattctcaacagcgtccgattgatcgatcgtttattttgctgtcgattctcctccatttatgtttattctctgcaagaggttagtaatcctggcactagtggaatatttcttattttaacatgatatgcattgcaagtataactagtttttatttattaaggtaatattgatgggcgaaactgatcgataacgaccgtcaacagtacccataccttgcatctgtacatttgagatatacagcatagtagcaactcctgatcaacaaccaagtttagatttttgtgaagtcctttactcgggacaagaaaaggttcaagcttgggcgtttttgattatggtcgttatcgatcagttgcgcctgtcaatgttaccaaaataaaggagaactagttgtgcttgcaaagcatatttatattagaataagtgatattccactagcactaggattctaacatcttaaatacaaaataggggagaatcggcagcaaaacggacgatcaatcaatcggacgctgtcgagaatcagacttgaagacaaattggatgagaacaccaaatttacaagaaccaacaagcccaaaattcagaagtctgcggagagaagcaaacaaggaggccgcctgccaaagtttgggctggttgggccagcccagggtacggccgaaccctgggttcggccgaaccagccgcagcactgatggatccagggtttggctggacggtagagatcaactcccaatgacagttggagagtattaccgacctttccaaccgtcatcaccagcctataaaaggccttcacctcttccatttcaacacacacctcaagcaagaagcttcatacattctctcaagtttagtatagtctctagagtatagtggaatagaaatagaatagaatcttcagtcctcagagtcttcggaagagttcggctatgcctctagtatcttttccttcttttgtaagacttgtactatttatagaatattcttctcaatatatttacggtactttccttcattctgattattcgagtaccaactttatgaaatattattcgagttataattgtttagctaacttactcgggagatgcaatgctgtgggtataatgttcatttatatgattactctatgtcatgatgatgatggtagagcagtatttggtagcataagcgaggtgcttaggctattgaatatcattatttagagttatatgctgcagatatgtcgaggtgggccgctgatggtgacaactcagtacgagtattcctccgcgcgtgtatataatcctaagttattttcctagggagggtactcctccatatttagccccggttggatggccatgatggattgtcataaggaactcgacaaccagggtggtttctcgaaacaccaggagggcatcgtaagggggtattggctatataattatatagtagataatattgactaaagtgtatgtatgtatattaaaagtatagcaaatgactcttttcttattctttccacttagtctagaattaatatgtatgagaaaagtgaatgcttctgcttagtgtcaccctacccttttggattatattaactcttgtttagactttgattattacaagtaacatataaatattagcttggttctctccataataatctttccaaaggattaaacaaatacgatacccttggaatactctcgggtgaaatgctacaatggtatatccgtgcgcttgcggatgaaatctgtaaccgtaatatactaagagtgtttctgcgtcattgctggaaattatatttttgataatgtcgttaagaataccaacacgcggtatcctacaattaaaaccgcgaagtcatgatgtcacgtaacaaaatttaccttttttagctacggagtacgtgtgtaacgacttgtctttaagagctgctatagataaaatttgccttttttagctacggagtacgtgtgtaacgacttgctttaagagctgctatagatacataattaactgacaggtgttggctgccggaattgttataaaaatctgtcgatagatttttaacaaaataatctgtcaatttttagactacggtttaagttaagattagtgctagggtgctagaaaaatgcaaccgcgcgagagagctggagcctggagggaggaatcgagcgcgtggacatcatgcgctgctgttccaagctacttaccaactgagctagcaggtattgatggttttgttgcaaagatatatttatattaaaattaccgccgttacactatatttacaatgtaaatacactataattaaaaataaaacatttatttattatgatgtaatttttttatctggattgtaacttttctactacttggtgtaatttctgttgttgttaagcccagtagttaactagtgtgtttttttcttcctttttgctagcgtcagataaagttccatggtattagagcaggtacaatagtaggctattagccagctataaacatattttaataagataaaaaataagagataagagaagcggactacagatttatagtcagctgcagcacggactctaagatgcagtgtgtgtatgataggtgtgaccatatattaatagtatagtaagcagctgttatattgtgtgaattgactattagatttagctatatataaattaaagctagtagtgagctatcctattaaacttactcttaacacccgtacttgaatttgatagttttaatctgaggcgtacgtagctatttggtggcttgaaaatctgagtgatttagcagccagccagtcacccgtgctttggatcagcgaacggcagccactctttccacatccccggatcaaccaagcgctgccttccaatgccacctgcgatttggttatttatagacgtaatggattaccacacaggtcctcaagccactgctgcagcgtgactctgctctagcacctcaccaagcagaaagctagagagctagcaatggcgcccaccgtgatggcctcgtcggccacctccgttgctcccttccaggggctcaaatccaccgccgggctccccgtcagccgccgctccaacagcgccggcctcggcagcgtcagcaacggtggaaggatcagctgtatgcaggtatgaacaagccaacataggatcagtacaagcttaattggtatcttcatcctcatcacacacacaggaaattaaagagagctcatcaactttaacccatatgatttctctgcgcaggtgtggccgattgaaggcatcaagaagtttgagaccctgtcgtacctgccaccgctcacggtcgaggacctcttgaagcagatcgagtacctgctccggtccaaatgggtgccttgcctcgagtttagtaaggtcgggttcgtctaccgtgagaaccacaggtctcctgggtactatgatggcaggtactggaccatgtggaagctgcctatgttcggatgcactgatgccacccaggtgctcaaggagctcgaggaggccaagaaggcatatccagatgcatttgttcgcatcatcggcttcgacaacgtcaggcaggtgcagttgattagcttcatcgcctacaagcccccgggttgcgaggagtccggcggaaactaagctagttggcaagccagcaagctcactcgtgagctctatacagaggagactcgattgatctattcggttttggcagctttgaacgttcgaatcgggccaccttgcattggtttcccctttcccagtttgttgcttcagtttttttttttcatcttgtttgtgtcaacatcagctgtgtatgtatgtacatatgtatgtatcaacataggttgaagagcatgcatatgtgaatgctagcaccaggctaatcatatgcacatacacatcgtaataaatatattgtacaaatcgtcaaaaacgatacttatatgtaatactatactcagaccaaacttgatacctctggtttccatttcaattatgtgtggtaggacatgcatagcattgttgggaattacttaattcgtttccatgcaaacagttcaaagatacacgcgcgcaaatacgggcgccctcgttcacatatgtaaattattatgtatacatataactctaatcagataaaattcaaaatgaactgcgagtccaagctcgatcatcctgaaattgcctcctcttctacgattctatacgtagcactcatttctgaattgaaacttttgtgagctttggcttttgatcctcgggtgttcatctattgatgcatacattcatttgaactatatttaagccaaacttatctaacgcagttgaattgtcgccttctgtcatttcaaggaaatttgttgctttctgaacctttgtgctaaagttggaattttagtccattgttttggcgtccaagattttttttcccacatcatgacaatttttaatttaagaaacacgttaaataataattttataatatatcctcatagatctatttgcaaacatatagaccccacaaacaaattatttctgtaccatttgcaattccaaatttgccaacattagctaatagtagtgtgttgttctgatttagttcaaaaatacctgctaacgataataaaatttaaaagggtattccgtcgcaaacctgaactgtaccaattttgaataatgtactccctccgtttcagaatgtaagtcattctagtatttctcatattcatattgatgttaataaatctagatagatatatatgtctaagatttattaacatcaatatgaatgcggaaaatactagaatgacttacattgtgaaatggaggaagtacataataaatgattaattaatactgaacagagaaacaaaagttgtcatcatcttaatagtcctttctcagtgtccaactgttcaggagatagggttatgataatactagaccacatatgtccagtttcaaaggataggttcataaactagaccacaagtgtcccaactacaggattagataggaatcaacttgtgatgcctagaagacgtacgtaaatgacaaggacgtaggaaaacacacggttcattccatgtttctgggtagtggacatatcatagataccagcataggaagtcacgcatttgcacaactataaccatcctaattatacattatatatatgaaaatatactaatgatattagatgaacgaaaaatctgttttcattactgtcgagaagtaatcctctctagcgggtggtcgtgagacccctctttgtgagttcggccgggggagatggcgcgatgatcaagagacttccacttgagatctaactactggatcgttcacgagtatgcatggaagaccaaggattatacaggttcgggctgctgggaagcgtaacaccctaccctgagagcccgaggggtgtgacgtggcaccccgagccccctcagccacctcagcgctatccgaggggcgggggaaggcgaggcgcatggctacgtgactaaacgggaaggatacttccctttactgtgtgtacccccgggcctatatcaccgacaattatagtcacacttttgtgcaaccacaaccgccatctatatttatattatttagcttgatttatatgttgtatatgataacaaatcacccaccataatatattgggaactttaaattcatatgataatttaagtttacataactttatcattatttttcactgtcttcaccgctgcaccagtcgccgccttttcaccacctccactgttacatgacccttattctccccttagttttccattggtgtctgttttatagcttaagcacatagatacatttcatcctgtatatttcaactaatacaatacattaaatcataagtttgaaagtcatcctcaaaacagagcaatttgaatggtatttccaaacattggttctgctctttaaataccaagcaaatcaaactgactactaccaggctagaataagccaatcaaattggtgtcacaggctgtttgctatgctgatcttttcagcttgtatccaagcgtcaaacagttctgaatgacccaaaatctgttatgccagtagaatattactcagtcttccaagttaagagtcaaacaaaacagggaaatgagaacaaaatttcaactattgtacttctgtccaccatgtatccaaaatttcaactatcgtacattccttttctcgaacaacaaatatgtgccgattgtagcaagtattgttcagcatgacactgatgttgtctgaagatcttgattcatctgagataaagatcgaagaagttcagacttaaaaacaccagtacgtaatatacaatatatctcagatgaatcgtacgcaatggctattaagactttgtccatgattcagtcttcaaccaagaccattccatgtatatattttccaataccagtttcagttattaaaatccatagttgtggaagaaacatttaaatatgcacattccaactactccctccgttccctaatataagagattttgacattttacttgcactgtttgaccactcgtcttatttaaaaaatgtgtgcaaatatcaaaaacgaaaagttgagcttaaagtactttggataataaagtaagtcacaaataaaataaataataattccaaaattttttgaataggacgagcggtcaaatagtgtaagcaaaatatcaaaatcccttatattaggggacagagggagtatttagaagaggaggtgtattcgcactcataaattattgatgttaatgggctaacgacagatcattttaatcaagatttcaaattcagaaacgggcagtactaccataagtttgaggaaattgttcattagaaggattgatcaccttacggcattgcatgctaccttacagcattgcatgctattcgctgcagtcatgtagcaattcaccaacaccgccatcatcttcacagttgcatgggagaggtggggggcatgtcttgggcagccagaaaacatctgtgagaagcagtaatccttgggcctctactatagctatcaagaaagtgcagaagcaatgaacatgctatgcatggcctgccatacgttcctgatatcagttttaaattccttggtagattgtacttgatacatactcttagtttccttgggctaatgaggcaatctgatgactcattgtagacagtaagctaatgtgattacaaatatactggtcaagtggtcattatgaaaaaagttcatactaaaaaatcaaatcatggtcaacgtttatattagtcaacctgcatgtagtatcttctacttcgtccctttcagttacaagacattttgactttagtcaaagtcaaactgtttcaagtttaactaaatttatagataaatatagtaatatttataatactaaattagtttaatcaaatcaattattgaatatgtattttcataattaatttgttttgggttaaatatgttactacttttttctataaacttaatcaaaattaaagcagtttgattttgaccaaagtcaaaacgtcttataacctgaaacagagggagtactaaatacctcgatttaacagttctaccttttttgtaagaataatatgactaattattatacttgttgtcacatttgccatttgaacttttgttaaacatatcaaatgcctaggaatgcatctcagtatatcaaattaggtacatatacatgtattgatatgatttttactcaatgacaactgtccagacattatgtttcttaataagtaaataagaatctggtaccaatttcattaatttacttggcaaattatgtagtagcttacagtaactgtttgtcacaacatcttcatcagcactgtaaatttttctatgtaaaatccatctaatggagcaacttttttgattgattatcgcaaaatgttaagagccatcatcagaacatatgcagtataatatccctatttaaatagattcttgtgtcaattttgacagtttacctttgaatcaagctgtagcgttgatgtgctgtataatcgcacatcactgaaaacgtggtagacattaacagccgctggttgtggagaggagcaagaggaaggggtcgtcgttgccgtggctgtcggttgaaatgctgtgcagtgaccagatttagttctcccagacctctgaatggcgggatccagaggtgcacgccgacggggatgacgtcggggggtgcacgagaaggatagcttgttccacccctaaccatccatttggggggagggggggggataggaaaaaagtgggggaagtagagacgcagcgacaccggagaaagaggaggcgacactagctagggaggaggacgcgatgacaggggatgtggaggaagcggcggtgtgggtgtggaggaggtggtgaaggcacggtgagcgcgcgcggagcaagagcggcgtctcagcctcctggcttctccatttaattcggagaaaaagaggtatttttgttcatggaacattgat

SEQ ID NO: 25444 - DNA, 1428 bp, Oryza sativa
cctctgagctaagtgggcttacataacagagatagtgtaacaaatagggatatgtatagtataggaaatccgtaaaatgtcatatcttaattattaatcttagctattaactagttcgaaattggaagttctacttagaaaacaatactagaacttcataaaataaagttagatagatttttttgaactttcttttttctctaattcgcaaatctatttttctaatagaatctattccaatttctatattgaatttgattttagatatttttaatttgatatggctcggacgaataatctaatacatggaaaagaataaataatatatatacgaaaacataataaagagaacatgcgaatttcttgtattttcagtccatcattatagacattttttgagatattttgttttttttgttatttgctaataatttaatgattaatatttcactaaggagaacatagaatcatagcaaatgaaattgctaattctgattagcaaaaaaaaagaatgaatatcaagcgttatagtatgattttgaatactctaaaaaaggaacgcggtaggtgggggagagaaaaaccttgggatatattgattcgcattgaattgcaaatacatcaacgatagaatcaattcaatgctgaattgcaataagcggagtctcacaactagagacgaaccgctagactacatagagtaatgaatccaacgattcaaaaaaaactaacagatggaggaaattgcacaagaaatcctggtctcaaagaaaaagaaaatggggatatggcgaaatcggtagacgctacggacttgattgtattgagccttggtatggaaacctgctaagtggcaatttccaaattcagagaaaccctggaattaaaaaaggggcaatcctgagccaatccatgttttgagaaaacaagtggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaatgattaatcacagaactcatatcataatataggttctttaattcttttttaaaatgaaaataggaatgattatgaaatagaaaattcataatttttttagaattgttgtgaatccattccaatcgaatattgagtaatcaaatccttcaattcatagttttcgaaatctttttaaaagtggattaatcggacgaggataaagagagagtcccattctacatgtcaatactgacaacaatgaaatttctagtaaaaggaaaatccgtcgactttctaagtcgtgagggttcaagtccctctatccccaaaccctcttttattccctaact

SEQ ID NO: 25445 - DNA, 2684 bp, Oryza sativa
atccataacgatcaaagtcgaatcgtgagcctattaatgaagcaaattcaatgaaacaacaactggtaccatatagaaggggccataaactagagagtcttgaccaatttgaaagatcttttagtgtagttgaaataacggaattggaacttgtttggtcaagtaggggaaactcaatcaaactcataactgtcttaatggaatcttttccttcttttttttgtctgaatattcagttaagaccattccaaggctccttttcgccatgcataaactaaaccaacaactaggataagcacgaaaatgaaagcttcgataaaaacggatatacccaatacgtcgaaactcattgcccaagggtagagaaagaccgtttccacatcaaaaacaacaaaaactagcgcaaacatgtaatagcgtattcggaattgtaaccaagccccccccatgggttctatacccgattcataactagaaagcttctctggtccttcacgaaccggagctaaaagtgctgaaatccaaaatgctaaaataggaataaggcttgctattattagaaatgcccaaaaaatatcatattcgtgaagcagaaacataaatgtactcccattaatgtggaataggcggaactgaattagtcaattcaagtcagcattgtcaatttatacagaatttctctcttttcctcggtgaaacaaggatcggtttttctcaaaccaaagggcttagtttagcctttgtttcctctttgccacgtcttctttaaagattcatccaatggaatcccgactccctttcttttttatttcctttctatttaggtatggtggagacataattcttatagaaacaaaactctctcgcttcacgttgtctcattttctctagaatctctagaaaaaggaataaaaacgaaaatactacgaattagagcctaattaagataggatgactaatgtatgcagcctaatgaggagtaattctataaaaataaagaactctatttcagaacgtagattgatttagatttaggtaatctatagatatagataagcaaagtaatatacttcaaacaaagtaggaatttgcaagatggagaacatcttgcagttgatttgatagaaattcatttttcttttcctgtctctataattttcgatgaatgagcctctggtaatccttttctctctattttatggcgcaggcgcctgtccagtctataaacaagtactaatagggaaatgaaaactatactaaaggaaacgtaggatatctctcctaaaatctaaaaaaggacatattagggctatacggattcgaaccgtagaccttctcggtaaaacagatcaaacggattattatcgaaatgattcgaactgtttcaaagacccaacatgcatttttttgcattgggctcttttatcaactgatagaaagatcagttagtccaccatagtttttctttacggaaagataatgagatggctccctgcgctctgattgattatttgtattatgatctatctaagagcaataccaaagtgtttcaaaggaggattaccttgacttaggtctgcctccggcctaaattaaatcaacctaagtgaaatagagtctctatcgttccgctacaagagttgactatgagacttcatacaccttaaagttcatagaacgaaaagaatttttttggaggcccttatcctcattaagcctagcatttagtgggctggatatttaccttatcaactagcaaatcaataaaggttctatttgtttaggcacctggattggtacctgaatcggactgaaccaactatttgtcaggcgatggttcctattctctcgaatccatgaagtaagacattgattttgcaagaagatccactatgttcattgcataataagctcccatgaaaagcattggcgcacgtgtaaacgagttgctctaccgaactgagctatagcccttgtcagagatatcttaatatatagagaatttcttgtcaagatgaatattctctaatagtagaggatatcctttgatctgtttactataataacataccaataactaagcggtatttgcttataaaaaggattcgatctataatcaatcgaagtaaagggtcttcctttgtggtgataaattgcctacttaactcagtggttagagtattgctttcatatggcgggagtcattggttcaaatccaatagtaggtaggtagatagaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaactgctccacagaaccgccgttaaccatttatcgttgaggaggcgtattctcaagggacccatatctacagctgtgttaatgggggcgtggtttggtaatacgcccaatttggccactattagtagat

SEQ ID NO: 25446 - DNA, 7763 bp, Oryza sativa
ggtatttatcccccccaatattgcaagtttcttacgtccaaacaaagtatttacttgttactaataaaaaatcaaaaagtttagactacgttcttccttagatcccttcttttactccgatagtattgcatatcgcaatcgatgcaaagaaaatgaatgcatttccatactataataaaaagtaagtgtaataaatagagaattggatcatgtcacatgacttattccactcctgccatctcggagtccagggaagcgcacagatagagcaaggaagagaaggggggaaaaatgaaaagaaaaatatgggatgtggaaggatcccattgtgaaaagatgttttcggaaggatcgcggggaggtttcaccgtttgagagatccaacagctcgcattgtctggtgtagaaatcagacggcccataatttcttgaagacgtgggtttattgagttttacttttcacttagttagataggcattcattagctagccactcttagcacctaagagcagtcctactattagccagctatagatatattttaacgagctaaaagatgagagagaagaatagtgggttacagatctgtagccagctgcagcacggactccaagacgcagtgtgtgtatgacaggtgggaccatatatcaatagtatagtaagcaactattgtatgaattggctattagattggctatagatgaattagagctagtagttggttatactattaaatttgctctaagaggcatcatgtctgaggttttgtttgaaattcaggatatggaaaacgtaggaacattaaaaacataacataggaaataataggaatatgataggattgtaggtttaaaacggagtgattataaagcataggaaaactgagcaaactattgttcggaagcgcaaagaaaaactcagaaatcttattcactaatagaagtaactcgataacatattatcaaattgtacttagatggtacaagcaactgatgtgtgggccaaggaacagtaaaccatcgttacaaaggccaattgagttgatttatttctccctttgcatcggtcctatatatggaaagccagcaaaaaaaaaaaagagggactctcgacatgacaaacggctcaaaattttttgggtttcagccgttttttctcaccgtgcgataaatacacgcgtcacccatcccctcccgcacaaaaatcccacccgagtagctggtagtgcgctttgcacaaacggcacaacaaaaaaccgcttgtgtttgttttgtccgtgtgggtttagtccacaaaagaaaaaggcccatgacgttttatctttgtagaaagcccacatcccgcaaggagaaaaaaaccaaggactatttttatccgtgtaaacaagcccagaaaaagaagcacacatcgtgcaactcttattttttaggaacccacatcctggacttcttggatagagacacacaacctgcacttttctgtgctgctccagtacgtcttgctgcatgaaccatgctggtttggttttgttagtgatatgctctagaggcaatcataaagataattatatcacataatatgtttatatatttatccgacattgttctttaaaatagataacacattattggttaatgaatatgtgattctttcatgagactttttatgttgtatgttactatttctgaaggatccctgatcaaatatcatatgtggaacaaatatgtttaaatgatcagcacatgtattaattgatgattatgtttcatggatcatggtatagagataccaaattaataatgtggacacatgttggggaacatgttgttggatagacccaacatgatacattgcaagagccatatgtgttgtgttatcagtgatctcatttagtgttggtgttgaatccttagacctgagattatcatggttcccaacatatgtagtatcttacttagggactgctaaacgctactccgtaattgggtagttataaaaatagttttcgggtatgctatgaaacatatagttagatatgtataatcaagatgggatttgctccttctatggagagatatctctgggcccctcgatgttatagattatgaaagtgcatggccataccaaaggtcattgaggagtcaatcacaagttatatatataatatatcacatgttcgagtgaatgattgagctattagaggatgtcatatatctagccttgagcttaatcgatatcatgaggcaaaggtgttcatacatgtatacactagatattcagccgatatgatctttatgtatgcccggtgggtcaatacattctgctaggggccaccgttgacacgtggaccgaaaaggagttttcgggttacagctgagtgtacatgaacctacaggattgcacgcttattgggccggaataaggggattagatggagatccaatatgagcttaattcgaatagggatccgagttggagtcctacggaccttcacggatcctatatatttgtgaggggtatgaccggcggaggtattgcatcacgtgagaaagcctagccgccactcccctccacgagcaaaaaaccctagccgcacgcgggtgctagcacatctgcgcgtggcgttccgtccctgtacgtgtggatactggtagagacgccgctgctttgcggtgctgatcagcgtgggagcacggcgaggagaacgcacgaggaggagaaggtcgagccggtgtgatcgactacttcctctacatcgacgcgcgctacatcgcgagggttccttcgccttcttagcgctttcttccactgcgcagcgcgtcgagtggtaacgatctatgatctaatacttgcatggttcctgatttacgcagtaatttatactatcgtagcctacgcgtgtctcaacaggtttcacatttttttttcaagaagtgttcctgccaaacaaaataaaaaggttatattaggacgacatgattgcatacaaatatggggagcaaaatactaggttcagaaaactgtcagagttaattctgaactgttaaatatgttgaaaactacgttaaccccaaagatgcaatatggcgtgatgcatcattcatgctgagatgcaacaaacatgtattgacgttgtgttgctattggaaaattactattcttggcctagttctttttccaaacttcaaacttcaacttcctcgtttttcattagcacgtttttcaaactattattaaatggtgtgtttttaataaaaaagtttctaagtagaagttgtttaaaaaattccaatgaatctattttctaattttatacttcaataattaatacttaattaatcatgtactaatgagctttctcgctaaaaatctctctcaactcacctatcgaacggggccagtagaacaaataaagagcatcagataaagtagcccatagtctcgcgcaccttgcgcttagatcgaaggagtctgtagtttggcgtcttcaggcgccggagtgtgttcataatcttttagccctcgattgtaaccctatgattgatgagtaataaagcttcatgtttccctcgcaaaaaaaaaaaagaacatcagacaatgtgtagcaaggaaaattgtgtagttgttatgactcaaactaaaaataggtgctatgcatgcacagttatagtcaaatttgtgggcacaaattttaattgctacatcaaggaaatttgcattcgcaactatagcaaatttgcaagcacagctagaaatctatacctatagtataattgggaacttcataggagctcccacgttaaccagtaaaatcagatcgttaatttgatacatcatataatcctaaccattgattataaactctaatctacattagcatgatgggcctgatgtaaagcccatccaatcaaccgctttaattatagtgatgggcgtgcgttccactccagtcttgcacctaatcttcgttttcttccacaaccttatgtcaatcaagagatcaatcaatccactgctcctactcttcctctcagagttcaatccatggtgtttttttttccctggtcatcaatgatttgcaaatagtgataatcatttactcaattttgatgcatcttcacgtagccaaatcaaatagccgatgaatcaaatttaaaacagatctatgtaggccatgccctagctaatctagagcaggaagtttcatgtaaatctcacacctccttgcaatacatagacaattgatcttctgattttatctgacaatagattaaatatttcttctttccaggtgattgctagatattataattgaatataccataccagacatgttctcttacagtttttgccagtacttgttttctttaataaagaacatttgttgcatgccttaatacaattataaataatattcattggttcaacatggtccaggataatgttctgcttataatattggtaccttggaaaatttgatcttcaaaacaaaatgtatacaataatttacttcccaagctacggtaaatagcttaaattcatcagtcaatattaaattccatattttacttttttttaaggtgattgctatatgtttctgcagggcaccataatacatttgttgacggttgttagcgatcagtttcaatcgtcaatattaccaaaatagagaagaactagttatacttgcaatgcatatccatgttagtataataatattccactagtattagattcactagccttttatagagaataaccattaagtggaggagaatcgatatcaaatcagatgatatatcaatcggacgatgtcgagaatcaaacttatgtatgaatgggccaagaactcagaaatgacacaaccaattgggccaaaattcacaagtctgcagagaagagaagtctaagaggccaccagccaacttgtgggctagttaggccagcccagggttcggccgaaccaatgccagcaccgatggatgcatggttttgagggaacagtggagattcactccctatggcggttagagggtattaccgactattccaaccgccataaccgtcattatatctacctatttaaagagctcctctttcatttcactcatacacctcaagcaaagctctctcatattctctcgagtttagtttagtgttcttaagctagtggaataggaatagagtagaaatcggagtccagaagccttcggaagagttcggatatggctctagtagctcttctcttctcttttgtaagctttgtactattattagaatactcttctttatacatttatggtattaaaatactttccgagtatatgaatgccaactttatattatgtttatgttgtactgattatactgctagcttatctgggagatgccttggtgcgggtataatgtttttatatgcaattactccatgtcatgacgatgatattagagtagtatctggtagttttggcgtggtgtctagattacgggatatcattatttggggttatatgctgcggatgagaggtgggccgctgatggtgacagctcagtacaggtattcctctacacgtatatatagtcctaagttaattttctggggagggtactcctccgtatttagcttcggttgtatggtcatgacggactgtcgtaaggaacttggcaatcaggggtggcttctcgaagcactaggagggtatcggatagagggtattagctagtatatcagataactaggatatatgtatactatgtatactagaagtataggaatagattctcgttctcttttctttccactttgcttagatattttagtatgagaatgagtagctccatgctgttgtgtcactctgcttagactatgattatattaacccctgcttagactatgattattacaagtaacatataaattattagtcaggttctctctaccatgatctttccacgggattaaataaatacgatacccttggaatactctcgggtaaaatgctacaatggtatatccgtgcgcttgcggatgaactctataaccataatatactaggaggatttctgcaccattgctgggaattatatttctggcaatgtcgttaagaaatatcaacaagcatttctggcgccgttgccggggacgattcataatagagattaccagaactaatactgtaacagccctaggtcaattaccaggtaattagaaatgcaattatcatcacttaggttgcatctttactttattgcaagtaattacatgtgatagcaatttaaactttaaccggcaaaaccaaagcaacttctaaatgaaaaataacttgaacagaagtatatgtgtttaatattttattcaaatattagtttatttatcatcactaaatataaattttgtggaatttttactctctgtttaggcctcctaaaaattcaaaccaactttcagcctaaccaatttcatcttttcaccagatttaaaacacttggaatttatgtgtgaaactttgaaaaatggaacctagaaacctacacctatcaccacaccaaatttctacatttttgaacttgttttacctagtcaaattgaatttaccaagagagggaaagaaaataaatattggaaattgcaagaacgaatttatactcagtttttcacccacctctctcaccctcatagacagccacgacttgggcccacttgtcactgaccttgggtgcctctttagccccacaacacacccatgggcgtgctcccacctcaggacttaagggggtagagaaaaccccatcttcttcctcgcctttcatcttcactgcttgttctttcttttcttcatcaagctgagctctcatctcacttctcctccccaaatcccatccaatagcctaagatcaatccctgcatgtaagaccacaacaatccctatcataaaaactttgcatccatcccaacatcttgcacatgcatggagagttgagagagatcgagaaggaacaaaagagtggtggtttcagcctgcagggctgcagcagcagcattttgttttcctccatttggtaagcttccatttcatccatggtgcctcttttggattccctccatgttgaacatctatagcaatgttctataggttgtccactccattgctgcagctagaaggtggctgcaactcaccccgagttcatatcttttgatttcggttgaagcagccctaggcaacgtctcttgccgtcagcccaagaccttgctccatctcttgccatcagcccgaggccttagcctcgcatgaccctacgtccaggttgctaccatgtgagcgaagtccgatggaagttggagaaaaggggagtgaaaatagaaatcgatttcaaagatatctattgagctaaaagaggtatgcgctttaaaaattcataactaattcatatgaactccgaattcagtgaaccaaatttctgtggattaagaaaaacgtgatcttcaatgttgtaaaataaaaatgaccaacttttgtactggttttcccagtaaaaatataaatagctaatatgtatcccttgtgtggtctagctcttaataaattcgcaagaaattattggtaaaagctaaaattgtgaaaccaattttgttgagcttatattttagtactctttgctgttgtggtgttgtttttggcaaaaatacctcttaaatcttgtttagcagttatttagcattcccatgattttaacttgtaaaacccatatataaatgagataa

SEQ ID NO: 25447 - DNA, 7537 bp, Oryza sativa
ggcatttcatggattatctctatataaataatgacaacagatacagctgtgaaatattttttcttagaacctgtgagtgatgtaatttactctaaaaataatcattattatgaaatcttggtttgaaatgcatgttacttgtaatgtactaaaggaaatgttaatatttacagaactgccattttcaacacctgagagcttgtcattttcatatctcccaaaccataagtgataatctagtgattctttcaactaaattcaagttaaaatatgatctacccactatatttatttcataatttattgatcattttgcatgtgcatgtttatttggctcttattcgcatattacttcttttcgatagattcggagattccggagagtaacgagccatatcctgaggaggatagtgactaccctcagcagcaaggcaagcacctaagcatatagaacctgtgctttctctaaaaatgatttggttgcaatctatacgtatatatatatgcatgtattgcctagatattaatattgtcgatttatggtgtatgggtagaacctatttatgcatttagttcttgtgatattgctgtccttataccccattaccattggttgggattgcttgggatgtcttattcattaatgcttagccatgcttagtgctaatagaactatagtgatagacagtgctattaattgtggtatatagacaacttgcattattgggcataaaacttgagcacttacactactaaataatggttgatgaaatatgttggacttggacgggtgatagggcaatgatgggaggttggtttcccctgatgcaagtagccccgtctaggttgttaaggactgaacattttgacatctaatcaagcaccctacgtacttatcacatgccttattttgggaccggcttgttcttactagttctattgtgatcatttataccacgttggagagttgtgaggcaggtagcctttggagggcctcgggtgcctaggtttggccgggggtgcctcccgcgtggcgcgcccgccttggtcacatcacgcacgcacgtgactgagtcgtcgggaaggctagcgtggtataggtggttggggtggggctaagaaagggcatgtaatgagcttgaatcacttgtgtaccgcagttgacggggtgtgtagcatttgatctttgttcatttcgtgtgggaccagttgtacacctctgatcagagtataatctattcgaatagtcgcgtcctcggtgatggacaatgcttgatgtgttagtcagttatgttagcatcaaatgtggattattatggatgggattatgttcgatggtggtgttggcatgttgtgccatgttggtatagactttggtagtccatggttgatgatgagagcgccgtttgggctcatttgcttatacatttcagaattatatacttgctgtccataaattaaaatgatgctagatttacttatccttgcttattttactcattaattgctcaataaaattagctttatgcaaatgttgaacctagagacccactatagcctagaaagcttgcatacttctctctcccttatgtatatataattttgggtaagacttgcgagtacaatcttgtacttaacccggtgtctgcaatttcaagagaggattccggttatgagttatgcttcttgtgtggtaattgcttagacgagggcggcgagggcaatgagtgatctcttgcagcttggctcttgcccggttggtttgcattagtggggttgtggcaccaccggttttatcttttgcttatgaactctatttgagacttccgctgctatatttatgtgttgtatgttgggacctcggaccctattatgtgccatgtacctcgctgcactttaaccctattatggtacttgctatgtttttaattgcttccgatgaaagtgtgaggctaatcacattcctggggactagctaagcatgagtaacgagttttgatcgcttgagataattggggatagcgctttggattgagtcactggggtatacttttggtcgccaccttcgagtggttgacgggcatatgacggagtggactggcaagctatcttacggttatgtcttgcgctcactacttgacattccggttattataacagaaggttgtcaaccgcgatcatggacacattgaggacgaatggctatttatgcgtatatggatcccacttctccaatagtatgtggtggtcgcgttggacactggatggtataatattcggggtgtccccaaatactttatatttacctctgtataatcactgccctttgcaggctaaccttggttgttttcacttttgttgtgaaaacggggtagtgcatgactggtttcaacctaccggaaaactttaaggaaaatccagaagctttcttccggagcgtcaagccgcaagtcatcgctccgtagaaaactctaccgataaagaaaccagccataccagcttcaccgaccttcaagaccatggctgataagaccctccgtgaattcgctgctccctttgctgacaatgttccattgggccgcatatcaacatgggagatgtggatttcgatctaaagtccagcctcatcacgatgacacatgctagcccgttctgcggcaagcctaatgaggatgccaatgctcatttgcagcagttcctggagatttgtagtacgtacaccatgaagggtgtcagtcctccttaaaggctcttgtctttgcgcaagctaaaaccactaatgccttaagcaaaaagctagctgtcaatgacaaggtcttagagaacattaatgtcaagctagatggcttcgcttctgctttccaaaactagctgagctttactaagatgatagaaacccagctagctcaattggcttcataggtacctgcaagtgaatctgggagaattccggggcagtctgactcctccattgaaaatgtcaaggcgatcacaatgaggggaggtaagtccactcgtgatccaccgtatcccatgttgatggtcgttatcgatcagtttcgaccgtcaatattactaaaatagaggagaactagtgatgcttgcaatgcatatatctgttagaataataatattccactagtattaggtatactaaccttttgcagagaatgacaataaagtggaggagaatcgacatcaactcagacgataaatcaatcggacggtatcgagaaccagacttacgtatgaatgggctaagaactcagaaataacacgacacactgggccaaaattcacaagtctacggaggaggacaacaaaggaggccgcaagcaaagatgggttgggttgggccagcccatggtttggccgaaccatagggttcgacggaacctcccatggcgctgatggatgcaggttttggatggacggctgggattgatccccaatgacagttggagggtattatcgaccattccaaccgttacaaccgtcattacctgcctataaaaggagctcatcttctcacttcaaacacacacctcaagcaatagctctctcatattctctcaagtttagtttagtagtatctagctggtggaataggaatatagtagaaatcaggagtccggaagtcttcggaagagttcgggtatgactctagtagcttttctcttctcttttgtacgctttgtacttttattagaatactcttctatatacatttatggtattgaaatactttctgagtatatgaatgcctactttacattatgttaatgttatactgaatatacggcttttgtgcgggtataatatttacatatgcaattactctatgtcatgacgatgatattagagtactatctggtagtttagatgtggtgtctagattgcgggatatcattatttggggttatatgctgcggatgagaggtgggccgcttatagtgacagctcagtacgggtattcctccgcgcctgtatataatcctaagttaattccctggggagggtattcctccgtatttagccccggttgtatggtcatgacgggctgtcgtaaggaactcggcagtcaggggtggcttctcaaagtaccaggagggcatcggatagagggtattagctagtatatcggttaactagaatgtatgtatactatgtatattagaagtataggaatagattttctttctcttttctttccacttagcttagataatatattatgagaatgagtagctaatgcttgtgtgtcactctacccttggaatactctcgggtgaaaagctacaatgttatatccgtgcgcttgcggacgtgcgcttgcggatgaactctataaccataatataccagaagtatttctgcgtcattgctgggaattatatttctagtaatgtcgttaagaaataccaacatcctaaccctataggaactaatggtatcgccaaggaagcaccatctagtaattcggctgatgaagaggttcaaccagagaaggctgtgctgcaggagtactgcgacacacggttgctgccgtttcctcaatggattaggaaaccatcggtggacgagcagttcactcgttttgttgaagtaatccagaagattcacatcaacatgccgttgttggatgctatgcaagtgccaacatgtgcccgttatctcaaggatatcctcaacaacaagagaccgctcccaacaaaggaggtggtcaagctgacggagcaatgcagcaatgccatactccacaagctcccagagaagaagaaatattcgaggtgtccaacgatcacctgttcgatcggggcacaatagttcgaccaagccttgtgtgatcttggagcaagtatcaacgtcatgcccaaacacgtctttgacaaattcaacttcacggtattggcaccaacaccgatgcgcctactagtattaaataaatacgatacccttagaatactctcgggtgaaatgctacaatggtatatccgtgcgcttgcgaatgaactctgtaaccataatataccagaagtatttctgcgccattgctgggaattatatttctagtaatgtcgttaagaaataccaacaacattgtattccctctgtttcataatgtaagactttccagcactgtctacactcatatatatgttaatgaatctagacacaacatctaaataaatatggacaatgctagaaagtcttatattatgaaacggaggaagtattttatatatgattctatatagtattttgaccattaatgactgaggaatcagactacatgataacaattttcaaggtttcatcacaatgtctacctctacaggaaatcaaataattccagaaaacactgagaaatagaacagagttttatatatttgctccggcgcatatatctcaacctttcttcattttgctcatctagttatatttgggagtcgtacggtgtgagaaatacgcgggagtagatcgttgggaatcacaacatcacaagataaatttcgctagcgtcggcgtgtatcgaggcacatacaacaaggtgtagcaagcgacagatcgattaattgcagtctgcagaccagtcgaagcacacgtaccacatcggcagccagcagatattcttcaaatatttagtagcttacatatgtaatctacacatgttagttcttgagaatatctcatatagatcaggactgccagcaggaggaagcgacatggcgcatatacacaacgctagacaagatctgctcagaatactcagcacaattatgtataaatgtcgtattcatatacatgtgtttcgaacacttttgcatcaatatttctctttatatctaccgaattcatgccatttgttttttttatgaattgtcatgttttggtcaaggtagtttgattttgtcgtcaaaatttatattttaaaattatacagttccaatatcttattatatttataataacttaaaatacttataacattatctatctatagaatattcaactatccacaaagaagaacatagtaagtttattttcatttggatattgctaaaacattagaaatgccaaacagatacaattctatactttatgagctgctaaagaggatgcatgatataatgatgttaaaagatatctcacatccacaatataacgattgcattgagtctgaataggaccacaattcctgtttacaaaattaaatactgaggttattagcaatataggatttctggaaaataatattaaaaataaaagaaaatacagaatagtttggacaaaagaatatattgtgtttgttcgattagtccaaatgactcttttttaaaaaaataaagttaccctgtgcaacgcacgggttaacgtctagtaagacaaaatacaacatggagatgcgtgcaatttttctgattgatgctatgcaagcacatgttcagaaaatccagaaaatagattgtgcacattaaggccctgtttagttcccaaaccaaaaaaatttcacccttcacatcgaatgtttagacatatgcatgtagtattaaatataaaaataaaactaattacatagattgaatgtaaattgcgagtcgaatcttttaagcctaattgcgccatgatgcgataacatggtgttacagtaaacatttgctaatgaaggattaattaggcttaataaattcatctcgcagttttcaggcggaatctgtaattcgttttgttattagtctacgcaaatatgtgtacgtatatccgatgtgacatgccaaaaattttcattcgcgaactaaactagccctaaatctacttttctgaactagttactattttcctttcaacatacggttaaatttgtataaaaaagcaaggagaacatacaagttctaagattttcagatttctgaattcgaaacatgcacagaactgaacatggtcggtgctaactaataaaacatcatctttaactaaatttgccaactaaaatttcagaacataaataaccactatttgagtggaaaatgcgcgtattgacctagttactagttactattaactgttgaattttatgttggcaacatgaaattttggagaataaaagctgacctgaaaaaagagaatgaacaaatgctgtcccattctttctgaacacagccattttgaaccccttatccacacgcaaggattccctttggcactagtcgaatctgaacacgcctttcacgagaaaatatcaatggttgacaaaaacaaatatgatattgatagcactgtcagtctatcacaagcatgcattagctactcagcacaaaaatattaaaaatttaacagttgatgtattaaaaattcaatacaaatctactgaatctcatcctatcccaaactcaagatgcattacttggccaagaacctatcctttgcagtacatagctcaccttccctacttcaagaaacacacaattttacaaaaacaatcactctgacttcccttgtctgatatagctattagaaaattattagtcctagtaga

SEQ ID NO: 25448 - DNA, 3142 bp, Oryza sativa
ggagggcggcagggtctacttctgtaaatattttcaccggtacaatatttctataaatattaaaaataaaaaatttaaaatgaaaaaaattctcacatgcgcgcgatttgttgcttcatcatgtgggttttgttgggccagagccagcagcccgtcttgggtggagaaaaaaaagcccacaacgttttgtcctctgtaaataaaagcccacagtcctagaaaagttgtgactttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgctctctggtggggcggcaaggggcccgaatgcaaaaaagccagtcggggccggctattttgcaggcagccccttgccgccctctagccgggtggcaggcctcgctgcctataaaaggcctgctgcccagcccccagccctcattcttctctcctcaattccagtgaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttttactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggattgttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggtgagggaccaagtgctgaagtaaacgagacttctgtggaggaggtcaacgcacgagaggacgggggcgtagtagctctagtgggcattcaaccaggtggagtggccgacgagggggagactgtcggtgccattgtggataaaatggagagggaggattctgacaacgagcgtgtagaggaaggtgattcgtcagatgatgagacggatattaatccagaagaatgggctagtgaggatttttctgggctgatcgtctctgaagaggatagtgtgagatgggagtacaaagaaaatgaggttattcagggagcgatttatagtaaagcagaagatatgaaggaggcggtaaaacattttgcagtgtcacttcatagagagttttgggttgccaagtcgaaccggtcgcaatatgaagttcggtgtgttaaggaaaaagatggttgtccctgaagagtgcacgcgtataaggggaaatggaaggattattggatagtgtcagttgttaccaagcatacatgttttctacctggtgttcagaaataccacaggaacattacatgtgcatttgttgcatctgagatgtatgcgcatgtcattgataatctcacatatgaaccaaggtcaataatccgacacattgaagagacatacaagtatactattagctatgccaaggcctggagggccaaacagaaaataatagagatgatatttggaacttacgaagcctcgtatgacaatttgccacgcctgcttggtgttatcgaggaaagaaaccctgggagctcttacaaagtgaagaaattaccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctaaaattggttaaaacaaaagttgttggtatgaggccaaatgtatgcctgatacatgataggcacgctggcattctgcgagcgataggagagttgcagtttgggagtatggaacgaggataccccggtgtttgggaagatgtacagagtaggtggtgcatgcatcatatgggagctaatttcttcaagcaattcaagaacaaggagctcatgaacatgttcaagaggctgtgcaatcagaaccaggagaaaaaattcaatgagctttagaagagattagatgagttgacagccaaatgcagcgatcagcgtgcagcggctccatcgaccgccgttgctgaccctcctcaagctcttggacctctcccaacggatagtccaacattggttagaagaactggattggagattcggaaattttctcagtggattctgcatgaatcaaaagagaaatgggccaaggtgtatgacacaggtggtgctagatatggaataatgacaacaaatttggcagaagtttacaactgggtgatgcgcggtgtccgtggactgccactagttggcatagtggagttcattttacatgggacatgcaggtattttagggatcagttccaggcagttcttccctctatgccgaacaacagcattttgtttggagctttcgtgcagaaaaagctagaggagttgcgtaaaaaggccatgaaacatcgagctctagtgcaaggtacccaacagctcatgtttgagatactatgtcaagataaggcaggcaggggtatctaccgcaagagtgaagcaggagtgtgttctcaaagccgacggcacatgtcat

SEQ ID NO: 25449 - DNA, 5265 bp, Oryza sativa
atatcatacatggagcggtgagatttatagtttcggcatagctggggagttcacagagactaacgatgaagtactcaatattcctgacccatcgaagctccgaggtaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgcctggctacgtggtgtagttcttatgttctatgtcggcatgtggatttgcttgtaattcgtttcgaacttatcgatgtgtttatgtttcgccgtgtaatgccagacttcggcatgtcatgtctttaggtctcgtgatgtaacgtcggactaaggcgcctaacgtctttaggtatgctgatgtatgtcggacttcgacacgtaatgttatgttatattattgaactctacatatatgttaaattgcacgtcatcgttatgtaccactagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttgttggacccggcgatagatcaccgacaccggtctcaccttactgcggtgcagggggctcagcttgggacgatccgggcacggacgtgcggtgagctactcacagttcacgactcctttgtcgagaggtacgaacagtgttttactataagttagttgcactgtaatattttttataatgacattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgccgtgcggtgaggtagcccctaccctacaggacatatcgtacttgttggggctaccgctagcaggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcactgtgagtgtttttgtaccgaaatgacaatcgtattacatatttagtccgcagttaaggtgcctaacattttatcgacggcttgctggttgagcagctacaggcggaggccgacgagtactcctacagccgatgtttggaggcgtacttgctctggctttttggctgggtgatgttctgtggcggtcacgggcactcggtcgacaagggactcgtgcactacgccaggagcatcgccgacgccgcggtaggcgtggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgctgtcgtcaggtacgttgcatcgatcttatcgtattgttaagttaattgttaagttaattgtacatcacatcgatcgtctcgtattgcagcgccgatgggcccacgtccaggttaggcggtcgtatcctgagtttgttatggagttcgaccgccttctgccgactgacgtcgtgtgggagccctacagtgccacggctacccaggctcgtgtgccgttgggtctgtccacactctgcaccagggaccaggcgtactggatgactacagttccgatggtcttcgacatctgcgttgagcctcacgcccctttccgcgtgatgcggcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctatgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgaccaacgtttaggcgcggggattccggtacccatagaggagcacctgacgatgtacatgcggatggtggagtcgatgcgctcgattctccgagtgctcacctgtcatgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccaccttcctcggctaggccttctgttgtgccccccacaggtacttaaaaaaacaacattacttcgacaatcaatttacatacattcgatgtcttagcttacaagggtcccgttgtcgatgtgtaggtttcgcccagttcgctatgacgcaggccgcccacttctcccaggctgcagggtcagtgtctcaggcagctgtgtcgacctcgcactcagcgcagttctggcagtacactgggacttcgtcacaggcagccggcacgtcgagtcagggtccaccactggaccatgctgggacctcgtcggactgcttgttgccttccaccttcctcttcgacatcactgacttcgacttcgcttcaggctcgacagaggacgtcatcggcccctcacagctgggaggcgcaccgccggtgcagacgcaggaccaggcgtaggccactccttcgcgggacactcgtgttacccgtgctgtgccaccggatcatttcacctactcccaggaccacgtgcgagcacaggcccggaggatcaagcatggttgcggcgcgtggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccgactttcgtcaatggctagacgccgaggtgttgaggatccaaactggtgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattcttcgtaacactactctattcgacagacccgcactacggcttgcgcatacatcgagtgggtcgatacagaaaatcccgttctcgacttaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcattgtcaggttcttcgttccataaatcctacaacattgggtcgaaggttctttgtttgtccaaatattcttgacgacgattttatggtaagaatattttgattacatgaatccttattttctcacaacatttactaactttgcttgctttacatctattctttcctcctaggaaccaccaaggagatgtcaatatagagaatggatagacaccagaagggttctaactccacctagccgtgttatgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctctctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccg

SEQ ID NO: 25450 - DNA, 1253 bp, Oryza sativa
aacgctatgctacgtgcagcgcgcgcgatgcaaacacgtgttgaatccgacgtttaggaattcggctgtaatcacaaatattttcagccgtgtgccacatagacagtccattaaatatccttttggtcatgaattaattcgatggacgttctcactcgtcgccgcaagtccagtggcccactggatgcttccatctcctccttgataatatggctctcttcgtccacaagcgaagaccgtcggtggatcaggcaccacatgcttggataggcaaaccatggccaatccttccacatccttgcatccacgaagcattgccttccaaccatccaatagtgacctcacccttggttatataatgacgaatctgtgcagagagagcctcagtactcaagccggaggcagcacactgcaacttaagtttttctatagctcctagcaagctagcaatggctccctcggtgatggcttcgtcggccacctccgtggctcccttccaggggctcaagtccactgcgggcctcccggtgaaccgccgctccagcagctcgagctttggcaacgtcagcaatggcggaaggatcagatgcatgcaggtatcagaaacgatacgtttcaatttctccttcaaagtgctcgttgttcatatatattaaatgttggcccgattctattatctgcatcaattcattcaatcaggtgtggccgattgagggcattaagaagttcgagactctgtcgtacttgccgccattgacagtggaggaccttttgaagcagatcgagtacctgctccgatctaagtgggtgccttgcttggagttcagcaaggtcggattcgtctaccgtgagaatcacagatcacccggatactatgacggtaggtactggaccatgtggaaactgcccatgtttggatgcaccgatgccacccaagtgctcaaggagctcgaggaggcaaagaaggcataccctgatgccttcgttcgcatcattggctttgacaacgttaggcaggtgcagttaatcagcttcatcgcgtataagccaccgggttgcgaggagtcaggcggcaactaagcgctttcgttccttcgtgcatgttctttctttttctttttttttttgtgtgtccgtgttaagctgcacgtaattgttctctcgcgctccgacctgccgttgttgcaagagtactactacaactatcggtctatcgttcggtgacggtgagacagggcacgtgaatgcaagat

SEQ ID NO: 25451 - DNA, 699 bp, Oryza sativa
aacagtagtttctgcagtacaccaggaaagcaacttctagtttctagaacttaaatttccagaacatagacgagtgagaatcatccacagcatagcgcaaggtatcacattcatgacctaaatggcaatatctcccaagctctgctgtcaacaaagtcagcatatccttgtaacgtgattgtttctgctgaagcacacgaatgtatgcagttaaaccaagccaaatggtttcttttcgcctaagcttcagaactggacgcacattatagtgcagctccacatcttgcatccgtctgacaattaggctatgcatgtatctgcttaacagcaaagtataattattaagaaagacacatgatttccaatatatcgcatgatttcaaagcatgttcttctacgccatacatcttaaaagaataaacctgataattacttcataggttttagtaggattaaaaaaagggtataattcaggtacctgaaggttctcttaattacttgcagcagttctaatttgcttacgttggcatcggaaacgcttcgaatataacagtggaacttcattgcacataacaggaaggcttgataaatatttactcttatggtaccaggtgaattgatattggagtcatagaaaatgggatggcattttggacgcatataatggcatagcttgctgtggatatactttgttgaaga

SEQ ID NO: 25452 - DNA, 1065 bp, Oryza sativa
cttcttgaccatggagcaacccatctttgaattatcagtgttggtatttcttacgatcacagatagaatccgcaagcgcacggatataccgatgtagcgcttcccctacggagtattccaagggtaccaaatccaagagaacatgtataattatctcttcctcccgttcatccaaggacacaagataaatatgggtagagggtagagaggatttcttagtgagaaacagtgtctaaggaaagcttaagtttaatcctaacacaatacttcaggcacttgtaacccgctgttcccatatattgctctactatgtacccggacaggcaggacttaagtgctcttaagggctgtcaccacctctacacccacctctaacgtactgtgggatacgcagcaaccactggcaattaattacccagacaccgcgtctacgcaattaattactactctagcactagccaagcactaaagcaaacactatataattaatggactatagtgaacaatgatcccgtatgctaattaggaactaaccaagaataattctcactaagcaaatcttaattacttagaatgatatttctattgaagcagagtaattaccaaagtacaagaataaagagagcattaccgataactccgggattcctccgacttcttctacttcactctctccctattctaagtatactatagaacatgtaaagaagctaaagcatatttagagcctcttgtaattgagctctacatcttggtgtgtgtcaaatgagggagaggagaggggtatttatagtgtggagcttgcttgggagtgtggagatcctccatggcatccaatgagcatattcactctcctcatgccaagtgtccatttggatgacggttggagcgccggaaacggtcataaccatcattgggaagcagttatctaccaaactggacttgggccggggcgaacggcctctaccagggttcggccgaactcaggggttcggctgaacccgggacgactccgttcgctccggttttcgtcctggacattcatttcgggcccctcatttcatt

SEQ ID NO: 25453 - DNA, 428 bp, Oryza sativa
tgttaagagtactaatttacgagtttgatggcttttgagctattactttcaccatttctctaatagtaaagctactgctaccaccaccaccaccaccatcattgcagcactactgtagtctcagaacctcagactaacacaacatacacaaatattttaatagaaagtttaaacatagctagagtattagaccttggccagaccaagtagaagattcaaaaagagcttttgcaatttcaggaatagatgcttcagcaatggcaacaggagtacgcaaaccagacttataaagagcccttgcacgtgaaccctgcatcccataacatattaacatataaaaataagtaggaagatatgatgggacaaaacttaggatttatcatgcatgcaaagtgacataagcaaaccttgacaaatggaattgatgt

SEQ ID NO: 25454 - DNA, 409 bp, Oryza sativa
tcatacgcacatgcaatacttatgatggtgtaagtcgggcccaaatgccatacacacataggaggtaaagttgttgttttgtgataaatcgttcactattgttgcagttttgtgaaatacccatgtaaaattgtaacaaagtgatagttttgacaaaataattgcaattttgtgaaattctcttagatatatttatagcaatattcatgacagttgttattgataaatatgcagtgttactgggactcgcaagtcccttttttttttcttttaccatgttgacacgcgtgcgtcaacgcatgttagacgtgggacggcacccatgtgacagagtccaaaggaaagagaggagagttgcaggcttgcagctgctgataaatggaggaacgaagttgcggtaagaggtaaa

SEQ ID NO: 25455 - DNA, 999 bp, Oryza sativa
  unsure (1)..(999): unsure at all n locations
ggaaatttattaaaaaaatagtcataccagagaagtttttattaaatttcaaagttttaaaatgtttactttgcatactattgatgagaaaaaaaaataatggagcaagcatcaattggtgttacaaccctaataaacnntggctggacattgnnaagaacatgctnngaaccatctnncttccgttnnggtgganntgattgannnttttcaccaannntttcattttttantttgtactnaagttgagagtanaggaacttttgaaggttcacttttctnngttaaggannnacttgaaggttattttgtatgtttagaattttcctggatactgaactacagaaatatcctaggctgtacagttgagaccaggaattgaaatttcttttttgtgctgtagctgtatatttcgtgtaattcaatcagctcttttattattttgctacaaacaatcatcaatcaggctggataacactttttgtttttacaaatcagggtactatttgtagaatactaaaggaacagtttcatcatcttctgtatgagcaaataaaatgcaatattttgaagattgggcaaaagtattacttacaacaagtagggattgctcaaggaagcaagttatctcccaacctgtgttccctgtactatggccacctggaaaattcagtgctatcaaaatttctgcatgatagcaagcttaatgcaggagaggctttttcggaacctgaatatttgttaatgaggttcattgatgatttcatatttatctctttctcactggagcatgctcaaaaattcctcaataggatgagaagaggttttgtgttctacaattgctacatgaacgacagcaaatatggctttaatttctgtgctggaaatagtgagccttcctctaatagactctacaggggtgatgatggagtctcattcatgccatggagtggtttgctaataaattgtgaaactttggaaattcaagctgattatacg

SEQ ID NO: 25456 - DNA, 5078 bp, Oryza sativa
  unsure (1)..(5078): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaattttggctgttgatttgtatctgattctagtcctataaaatgtcatcagttatattatttgatgagccacatgataattatattctttaataatacaagcacatgtagagtgttcagatgaattactccatcacaatatatagctacttctagtgctcaaatcttgtcgtcgcaaccaattacaacctcctcattcaatttctccacctaccttctccatctcaaccaatcacaacaatctcgtgtttcacctgtcttcttaatctcagtgaattttttttctagaagtgcttatattttgggaacggagggagtattaaataagctgacaagtcactacatgtctttgtgtcatcagtgctacctgtggaaaagtgcaaacatggcggaaaacttatctatttgtcatgacagttcaaattctggagttaattcttcgtttagcagcacttgcaaaattgttactcaacaaagctgtgaaacatgtggttccataagaagagcagaatccaaagatccaagtgaaggatgtaattgtccaaaatttccttctgatggtagatcaggagagtgttgcaactgctatacccacaacaccaggaaaagaaaaaggttatacagttggcagcgccgcagcaaaaagaaacaggtctgttctgtggatgagtcttcagcagaatggagtaaattaaatggcagtaatttcaatatgtctaatggtccatcggagaacctggctggaaaaatgaatgatcaagcacaatctgtcgagctcacagtagataatacttctttggcaaggagcaatgatgacagttcttcagaaatcaaagtaattaatgctactatcttgtcatcagaaaaatcaccttgttcagtgttcgacataaggggttcccagggtttatcttgtcattacagcctgtcagaagtccagtaccaatctacatgtccccaagttgggccctccagttacttacatctgaatgtcagcttcccagccttctattcttttttttacctcttgcttttaagcttgcatttcattcataatggacaaatatccatttatttaatatttttgtacttctgtagttagtttatttttttatcaatttaatttctttgagaacacaattccgtttagttattttgagaaaacatcttttaccgtttagaaaaactgttatttactgaaaatgtgccagaatcaatagtttggatgtataaatagtcaatgtatgggttggtgtacatatattttttaaaatatactccaacagtagtcctgtaaaccatacaactggaaatgtcatattctgtcttgaggataccattttaggactctaatcaagtcaacgtcttgaacaatatgcttgcattacttgttccttgatgaacttactgtaataaagccatgctgatgttctctagtaattatagtttctttggtttgtattgtttttagaaaaaaaattccttggcattgatctgatgcactattctcttttaggatactgttgtttattgggtatgaacttaaaactggaccctttgctggccctggcatgtgggtagaaattttcactcctttagtgtatatccacaaatcattcattcactttttcttgcacatataatgtttctcataatatgtttttcaatctattcttcctccagagtattcttgaaattcaaaagcacatttctgttgaatattttactgcacactatcatggaactttttaaatgttctagtcgtttcatctttatattttttcttgcagagttgttccatctgcttcaattgtataatatcaaatgcatccaaacatttatcattagattccttgatatcaagaaatggtattttctataacagaaggacaacctatagtgtcttccattgcaaacgtatccttttgctgcttcatgtaccctcaaaatctgtaacaagatttgcgaatgcaaagaagtgttacttgtcataatgatggggaaaaattgagtgaaacctgtgcatgagtgcttattttgtctttcctgttggggcctaaggtgaataggtgatgaggtgtttggagttctggaggaaaccagaagcagtttgtctaggaaagggaggattgtacgatgaggtgatgaggtgtatggagttctggaggaaaccagaaacagtttttgtctaggaaagggaggaaaccagaaacagtttttgtctaggaaagggaggaaaccaaatctataatgttttcttgcttgtttctgttacactagctaatgcgctttttaatagggatttaaatagtactagatctcctacattgcaattcgaatatggaatcttctgttgtgttactcagtagcttgttgctagatgtagattgcaatactgatttcctgtaattttggtagcaaaggacacatttggccatcatctttagataattttgtagtcccattcaattagctttaattaatgcaaagagttcttttcttttctttaacattccgtgtcattgtactgttctaaaattttactatttttatgtaggctaggacatttgattttattacaagtagttctatcaattcagtttttgaacaaagttcaatgggaaaaaaaatagaggattatgcaattggtccattaccactgttggattaacatctcctatgtatggagcgatctttacatggcatgttatagtcacatatcagatcccatgatgtgttgaaatctagcattgcctatgattacagtatgttgtctgagtgttccttaatccttactgctgttagacatattaagcaaaaggaaaaggccagatgctctatctcttgtaaagcacatatttggaatcaatagttgctgtgcaagcttattgaaatacaactgccacgaatctacaatcagaaagtctaattgcttgtgagtcattagatatggttcttcagcgtttcatatcattagttactcttgctgttggatgacacacttctcactaatatttacgattctgtccacatattgtaactgcaatgcacacatcaatgtgctgtagcaacacataaggtgttgtttaatactaatgatatattacagtcgatttcctagcattagggatgccgtatttggaagataattcatcaaccctgtgcagctctgtgccaaaacaatgtacttttgagtattgatccaaattgttttttaagaaaaaagtattgaatcatttttttttgtaaagagctcactgattcaaatttatgaaggagaaattatgttgcttgtccttcaattttttacttggtttaatttttcctctcccaaatgcaaaaccggacaaaaccaaccctcaaccctcaaaatctggcaaaattaatgcctctgccctatctaatacttcctccatgtcaaaatgtaagcatttttgaggttggcacgagtattaagaaagaggtgagaatgattggaggaagtgtgattggttgagaagagaaagtagatgaaagagaatgattgtgattggttgagaggagaatggtaggtggagaaataactttattttgggacaagatactgtgctaaaaataactacattttgggatggaggtagtcgtggttttgacttacatatggaggacccacttttcattgaggatttgatggttcaccattcttctgtccagtgtttgccatatgggcccaatgttaattctctatccctccgtagcatgtgtgcccaccacctatatgttggtaaaaactgttgaaagggagcagagggatgagttttagctgggtttggttatgcacttatgcatcttttttgtacggctggttcgtggttttgggggtccttttggtcccttctgtgtaatttccttttcttcttaatgaaatgaagtgcagtcctgtgttttcgagaaagagggacaaatcaaactgagaagaattgagggatggtaaacagtttattttttgtgaaaataattccaacctgactttactaccattattaccattagttagggtggtgcgtcagtacacaatttttttttggcatattttggtcaatttctagactgtcctaattaatcgtttctaggcaagtgaatgcaaatgcttctatgcatgtcttgaaatcatgtggtctttgcttaggaattagcttccatgtttttcacactcgtgcaggatcataggcttgtctttatattattcttttcgagttacaccctgcaaatgtgaagttttgacatttttactatttacggctttcactaccaggtgctgttggctgcccaaatcaattaaaaatctcataaggaattctaaacgttgccaatataagaaattatttctgaagcattgttctgtcaagtgtaaggtatgtttgagatagttcgacctcatttactgagtaatatcataaagataatccaatgtatcagctcatgagtcatgactattctgggtcatgtccttttggtaaattatcctactgatctttgcaacaagttgttaatgttaaacttcagtgcttatctgttgcttcccacattatacattttgtcaagtatagcaagccacattttttgtggcaatctaactgattatcacaccttttgtcaaggacattttattcaaccatataaaatgcctcatttcgttcaattgtatttaaatgcctcaaccctccacaagcaagtggaatg

SEQ ID NO: 25457 - DNA, 1714 bp, Oryza sativa
caaaaaatgtatttctaatctcatgggacccaacaagtaatttaagaatgctaattatgtgggttaattgtctcaaaattccttttaatcaattttatatatggaatgtatgcatgtatggggttcattaaataaggttattgtggtcatttgtctatcctcctaatatgtcctaaattagctagaatttcaatttttatgggacagaggtagtataatttatctgttatgctgtataaaatattttttgttgtttcttttaatgtaaatcatctttcatgtgctacataagatattttcgtgctattatcttttgtgtaagcaaattctctcctataccacataaaaatatttttttacaaaataaaaataccaaaaaaatcttgaaacttataacaaacttctttgtaatgtaaggaggccacataaaaaaaatcattttttttaaacttctaatgagatgaatcaagtgttaaccttttatttttctaagggtatttttgaaaaaaaggcttagcccaatggtgtattgtagaataattgataaaatcactggtatattatggaaagagacaatgttagtggcaaatcgttgaactggaacaaactcagtggcatagagtagattctctattgaaataatttctagatgtttcatacgttgcgctaattcaaattcaatagacctagcaaggataaacaaatcatgtagctaatctgtgattaatattgtaagtccattaaatttatagaaaaatgcaccatttgcgacatcaaattggtttcatgaaatccaccatgaaatatgtcttgatagtagtgcattcatttattattgtagatgttggtgagtttttctatagacttggtcagagttgaagaaaaaagtgacttaggaacagaggtagtatagaaattcgttaatggaccttaagtaaaggaaggatttattgctaaatattaattattttgtaactatctgatattaaaatcattaaaaagataacttttgttccatgataggctcaactaaatagccattttgtatttacaaatataactatactcaaatttcaacaaacaaaaaacaaattgctgcttctgagatttttaaacgcttcatgctataaatttttttaatcaaccctgcatctaaatggtttgaactagtcatactttgttcgtgtttgttttaaagtcatactttgttattattcttcatgcagcaaaaatgcagtgcagttatcaatttatctgttaattttgctacttacaaaaaacatgccaagccaccatgcaatatgtaatgcgagcaagaattttttatactagatatattctagtctattgactaaaatgttgatcagacatgccaaataaaatttgaacctgtatagcttgctgcctggagtacttatattggttgcaatattatctgacatgagtttttatggacagcctgtcaaaatagcaaaaatgttgtatataatgttataagagaagaatgacatcacttatttttgctgtaaaacaggtggcacctgatgtgaccaagaatgatggcaaggcacattatccacctggaggaaaagcagcatattatgatcgatcattttctcgattggaagcgtatagcacccatcaacaagtagcttcttttgtttgggcagtgctgaaacgaatagtaccaaagccattgcttggaaactctttt

SEQ ID NO: 25458 - DNA, 1245 bp, Oryza sativa
accagttcaaatctggttcctggcacagaaaaaagggatcttccgaataggtattgatacaaatacctcgagatgggttgggatacatattcgttaataatatagatagagtatgattttttcatctaagtagataaatctctaaatagaggcacttctttttctgcatttttgcatttcttaattttctattccgctattccgacaaatatttttttattcttgcttatcttatcttactttcctagttgttctaagtgatgcacgtggtacaaagttcgtggtagggaacttctttgagtcatcatatttttctgttcatacgaaggaaatgaatatgtgattttccaacgaaatgaagcccttttttgcttagtctatctgaaccttttgtataattggaattaattagaatgtaataggtattctgtttcatctaggaacagagcgtaaaaatattccttgacttgcataaaatctggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgattatcataagagattcccaccatatcaaaagattcgcgttcttgaaaatcggaacttctccaaatccagaagacagatgggattctaggattatccttttgggcaaagacttttatgcatacttcttctgggttatctataccatactgtattctcgtaagatgatacacgctagctaaagatccaccgggtgcaacgtcataagcacattgggaacgtaaataattgtaaccatatacatataaaatgacagcaatggaatcccaatcctctgcttttatttgcaaagtctctattcctcgatgatcgaagcccaaagatctatgaaccacctcatgtttgactagccaattagataaccaaccctgctgcattatcttgatctctcctcctttgtataaatatttcgcagttcgaatgcaagtttgaaatattgccctgctctttctttttcggcacaaagagctcctcctaattcactaatttgtaggaagatactggacttttggatttgaaaaaagcttcagaagatatgtctaaagtagatggtgattgatagagcaattcttgctcataagttccagtattagtactgcgccgaacataaagcttgcggctgg

SEQ ID NO: 25459 - DNA, 721 bp, Oryza sativa
taaagaggacattaggacaaccaaagttagtgctgctaactggaaagcaaattacctgtgcatggagtaatagtaaaggaacgcatacctgtgtaacaaaaattgattaaaaatagaatacaaatctttttcatgcggctattgaagattgagaaaatcaaaggcatgcttcatgtgataattgcaatgcagacaccaattctaggtaacaaacaaatcaggtgttgccttacccatatgggcttcgtttcataagccgattcccaatcggacatgcgaaagaattttgtcacctgagcataaccttatgacaaatcattcagcctcaaaggctatttcaaattttagacatttgtgatttttataccacccaccagcatggccatgccaaatgctattccacgggataaaggtggttacctgttaccacacgacttaaactcagacatgagcatccatgacaatttaaaaactctgcaattttgtttcagtgacaatgttagtttcagctgtaacttcagatcatgtgagatactcatagagaatatttatatgttacctagagaatgatcttttcttgtaaaaaaaataatgttaattcaggtcaaggaatcagagagataataaaatcaaaaactcaccaagcgaatgaccttttatgcttgattgtgactctctaatatttgatggagatttaaattgaaacttggtaaatcgggaa

SEQ ID NO: 25460 - DNA, 14507 bp, Oryza sativa
cagcaattccaaccttttggctcttaatgctaaatctactcaggtccctactaaagatttatagaatactccctccattccaaattgatctagatatagtttttttgagattattcctaaatgatctacatatttgtgctcatttattgagtctattcgttatttgtgtattggagtaaatggacattgatgcatgtatctatgcacacaagtatttataacccacatgcaatatcttgatttgctgttggctaggaaatattggagatggtgcatgcattgagtttgttgctagaataaatatagtatgaaagagttattagctttcttggtcttggtgtacctatgaaatatgtagatcaatttgtaatggagggagtactcaattagtactaagcataaaatgtaatttgagacatgcataatgctagccattcttaatttaattgagcttgtgccatgcatcatttaatttgctagttaatatcaggagatccttttaatacttagcttcagttatgaattttgttgggctcaattttcctcggatgtatttattcttcctatatactccctccattccaaattgatctacatatagtttttttgaggttattcctaaatgatctacatatttgtgttcatttactagagtctattcgttatttgtgcattagaataaatggacattgatgcatgtatccatgcacacaagtatttataacccatatgcaatatcttgatttgttattggctagaaaatattggggatggtgcatacattgagtttgttgctaaagtaaacatagtatgagagagttattagcttttcttggtcttggtgtagctatgaaatatgtagattaatttggaatggagggagtagttggtacccactaagtgcaattatgactataaagctgcatctagaaagagccacgtcatccaaataatcctaaccgtcagattttatttggactgctaattgctatcttagatgtgaactatctcagatcaggctcagatgaagaaatggttcagcccatggaagcccagccgttgccacagtccattgtcttgccctcaaccttttcggatcccctgtccccgatgcaattatttacatgatctcccccttccccttctcttgaatttctatggttctcctgttcactgctttttttttttgggttcatgcatggattattgataataattatgagttcaagatatcaatcttttgggtgcataccaggagatggactatgaggcaaaataaattaacatatatgtatttcatcctcgcagttttctgttcatccaagcttcgtgctgaaaatttgtttggattatgtatttttaacttgcttagtttgcaccaataccagattgtgtagattaaagtcttttattacagtaaatttacggataggaggctctacgaccaagtttatactcaggacaaatccgttctactttatttcaaattatgtctgatcttaataccttttaaattagcctcatatatctctttttttcatgctgtgtaagttccaattcagaattacaattggctacaccacgggacatctcactaacttaaaggtgattttgttcacttttctttgagatcaactgtatgtacaattctgaatgtgcctctttttttttttctatcaaggtttcatgtagtccatttggactaatcattcatgtctcttttccatattatttcctcaaagcaagaataccactttggtaggatacaaatatcccacggtaacacacgaggtacccatctaattttcctgaagtcagtgccagctagggttctaccgaacctctggtttggccgaaccaggcaaactgtctctctccaccgcctttggtgagaggctgcaaggtgcgcctctcagtcggttcccaagtggttggccctactttgagccggtttgaactaacttgtgggcttttcaatccgtgtgctcgcacgtgattcgtcggatgtatgtttcattgtatgtcggcttcatttcttcttcactttgatgtataactcctgcatccaagttaattctctaatcctaatacaactacattatttattattggtatttttccctttactagttgagtgcccatgcgatgcaacggtgaaaaagaaaatgtgatattgttaagtaatcatggtggctagacccttccaataatacctgactgttgctggtcacaattgagctgccgctagccacaagcattatgaccattcgaaccattttcctgttattatggttagagtaatgcatgtgctgccatagatgccattgtctgcagctcctagcccccttccagttgtccatacaaggatatgacaaagtaacaaaatatcaactaaataatcaacgcagcaaattaaactgtagaagagattaatcatcacctagaaccaaacttgtcagatcaattggtgtccatcatctatacaaaaatttcaaatattgtcttgctaaatctacacctgtgctaaaggaacctgtagtgaatccgatccaaaggagccatgcttgttctgtaccaaatatgctgaatttttgttataattctttttactgaaaagaatgctctatggctctacctgccttaaaatactttttttttctcttaacctttatgttcattaccagagtttcagctaacctgtaacaatgcaagcattgttattatagtaccataatacatattcaaaatgattgtgatagaagttagatatatgacttactgtgatccaaaaataagatgagactgttgttgaatctcttagttaaaaaaactaagaagccagacatatataaaccgatcatccttctcccattcttgcaacaacatcatcttggccaggatattgtcttgcacattatatatacaggctttataatttggaataaaatgagcatgggatcttaaaaatttcataaacaggtgctcactacttaccatgggattagattgagcagtaccaaatttaatatatatagcagagtgctcagctgccaacatgagtaacattattactctcacgaatttacatggattttacccgtttaacaaccttctaaatgaagaaccaatttgtacagaagaatattgttattaaagaggacattaggacaaccaaagttagtgctgctaactggaaagcaaattacctgtgcatggagtaatagtaaaggaacgcatacctgtgtaacaaaaattgattaaaaatagaatacaaatctttttcatgcggctattgaagattgagaaaatcaaaggcatgcttcatgtgataattgcaatgcagacaccaattctaggtaacaaacaaatcaggtgttgccttacccatatgggcttcgtttcataagccgattcccaatcggacatgcgaaagaattttgtcacctgagcataaccttttgacaaatcattgcagcccaaaggctatttcaaattttagacatttgtgatttttataccacccaccagcatggccatgccaaatgctattccacgggataaaggtggttacctgttaccacacgacttaaactcagacatgagcatccatgacaatttaaaaactctgcaattttgtttcagtgacaatgttagtttcagctgtaacttcagatcatgtgagatactcatagagaatatttatatgttacctagagaatgatcttttcttgtaaaaaaaataatgttaattcaggtcaaggaatcagagagataataaaatcaaaaactcaccaagcgaatgaccttttatgcttgattgtgactctctaatatttgatggagatttaaattgaaacttggtaaatccggaaacaatcaagcatcagcctaacagtagtatatggaagcatgggaaatctagcctaaatttgggcaattattcgaatagcaggaaccatagcatttttgttgaatgaagttatataataaaattaattatgtttcataaaagcattcacaggcagcatgttgcacaaaaaaaaaaacccacacttccaggcattttcttctttcttcagtaccatgaggctgttacctacttggatctttctacgcatttatatagaataagtaaaagaaattcagggaaactgctaatgtccaattcaggttggttagataccttgatttcccctcataattcaaggtgcaaacaaagaaataaacaggtgcatttacaacaacagtgagcaagagcaaattaaggaacctgttgactgctcaatcagattggttacacatactttgacttccccttgtaattcacagtgacaaagaaagagatgaacggccgctttgacaataccaacagtgtgcaaaaaaagccaaatcatcataaaaaagggggccgatggggctgcagtagaaaaggctccaggagcacgatggagggggcagagagggcgcccgggtcgccagaggccgcgtctaggtcgcagcggaggctggaggtggcgtgagcgcccgccgtgcgacggggaccagggggtgacgaatccggaggtcggggcggagatggatggaggcgtcgagggcggcggcagcggggtggcggcgcggacggggctgcgacgggagagagcgggcgagcgagaggagcgcggggcgttgcggaggaatagatgcggtcatgcagagaaagaggaagtcaggaacaaatgcggaggagcgtggaccgttgattctgcaggacgatccttccagcaatcttagccttcgattgtttaggactcaccaccaacactacgcttttttaaaatagtaaagattctccaatacaagtgaaactacattttttataactgagatatacgtgtaagaaatgttagttctccttttatttattacagtagtcgatgttcgaaatcggtacttaagaactgtcaacaataccacataggtgattagatgatgagatggagataagtagagagatgatgaatctattgtatatgttacctcttaatttgttgatatataatatgtatgaaaatagagataatagtcgcctctgctataaaaagtttgctcttggacagtaccagaataaattagagtggaccatgctttaaaatgcgtggcaaatattggcaagaatcaagatggggcctcgggaggttggcttcaaggccctgtcccatagattttttttttcccgctgagacctgattaatgatccgatcatattcagatacgctgctgctcaatccggccagttcgagaggactgattggccggtttgaaatgatcaagtgatcgttaaaacccccaaaactttcctctggcgatcgatgatactcatgaagttcccataggccatagctctgcgaaacaacaaaaaagtacttcttttcataagtgcggtatctagctctaccatacaaactgtataccgtgctacagttccttatgctacaaaaacgtccaaaggtgttcatatggtgctttttccacaggtaacatgctttactggaatgcgtgtaaagatgttcatatggtgcttcactgatgactgatctaatcagaagtataagctcactttgcagccgtcgttcgaacatttccaaaacagaaaaggtggtatgatctccatcatgccaattaaacatgacctgctaaatagcatgatggatctgacaaagtaagattatgacaacaaataaagcttcagtaaatgaccataatagcttgaatgcataattacctttatcttctaaacatgcgttgattactaaaattcagctaagctccttcagtgatctcagatagttctgtctgtgaagttggcaaccatatctcaatacgactacctccagtccctataattgcatcaggtctccgaggcgatatcacacgcaaaacacagccatagttctcaagtatctcacgggcaactgttaatcctgcaatgaaattccatgtcatattatcttcatgcataccatccgcaaggtctgacccgaatggagcaaggcaatgcatctgtgtctgtaaaatgatagaaatcagaaatttgaaccaattgtcaatgataaataaaaactttgctggacatgaaaatattcttacagtgcttgaagcaatacaagcaagtgaaccaaagttcaaacaaatttaggcctccaaaatatcgcatctaaaataaaatatctcaatctggtgaccatcagttaactttaggtttcactagaaaattgaaaaccgacactatatttcattattagtacattgcacaatagtttgaatgagatgctcttgtattgttgtcccaaaggaattctttggcacactgatgaaaagtcataattacattggattgatgtcccataattctccctatgttttatgttttcttttgtttcaaaactagagtgggtgtgtgttttggctgtgtgcatcttagttatgcagaggccaataaagtttccattatctaaaaaaacattatgaaacactaaagagccttacaaatgaaagaacaaatgtacttaccatgtattgcatgtcaggaccatcatcatcaatgacaacgagaatgcctcctgcaggtgcttcaccagcatatatctgaactcggccaccaagctgagtgcgtagaagagcaccctctatgagattactcagcgcttgtcttaaagcagattcctcaacagcaacttgaagcgggtgtgaaattcctgttacatctagagtgcgttgctgcctaaaagcaagcggttgagctgctccaaccaaatcttccagtacaacagagagatcacatggtctgcctgacaacaaataaagtgacaaataatgcacaattgaattgttggggactaacatctaagttattttttactcaagcaattaaaaatatggtaacttgagatgtaaacaaataaagtactgacatacaagtacacgggacatgggcgacatgaggtcctcaaaagagcaaataccccaacactatccaaatcgataaaagtgatttttttcaatatatacactattcatacaaacaccccaataaatcaaatgcaaaaagaaagatttatgggaagggacaagatggacgattgttttgtcttgatcaacactgtgaaacaagaagacagatgaaacaaaaattagttcacaaaagaacaaagaatgtcagaaaaacataaatcttttctagcatcaattgaatttaaaatttaaatctttactgatgatggtccacttttttctgactttgtttttcttcttctgtccaccaacatatgtgaaaaccacttctagttggtaggagggacattttttatctggtttctagttttaagagttaggagatgagttttgtttggttttgtagttgagagaccaaaattaaatcgattcaactgggtaagggaaaagaaataaacttttctggacaaaaacatggagttggtgcttgaggtaaaagaacagtttaggccgcgttctttgcaagtgctgggaccacttcctccagcacacaaaatggagcgacggattatcgcatgattaattcagtactgtattagctaaaaaaacttgaaaatggattaatatgatttttaaagcaacttctcaatatgattttagcagttcacaaaccgtgtgcacggaaaacaagcattgcgaatagtagtgtttaatacataggcattgatcaagatatatgtaatgaaaattttcagaaatttggtcaatgtaaatatgttttttctttggatcagtagatctttttttaagaaaatgatggttttattctccacttaatttcaatgctacatgctttcctgttccctttttagttgcatatttgcatagtacaatggatttagatttcacatatgttttgcataatatccttctacctttgtaatggatctcaaatgcaaaactttgtcagtctgaaactctggcaattaagataacataaacttgaaatgtacagtaatatttacttgatattcatggtaccacaatagaacttttgctagtacagaaaaacagaccatgaaatttagagtattatggttttctcaaatattgaaatataagcatggttaggaatagtgtagaataactaggatatgatgtttcatgaacccaacagctagatttatttgaaaccattgaaatgttatgtgcatttttatttcagtaaacaataaaatagttattacacaagaaatggtccagcataaaataatctgtgcaaacaactactacctccatccctgaatacaaggagttttagagttggacacggttattaagaattacttagaattaaatggtggaagattgtgattggttgagaagtggaggtaggtgggaaaattgcatggtgggttgtgattggttgagaagggaatgttggtggagaagttgttataatttggggcaaattctaaaggctaaaagttgttatattttgggacagagggagtactttagaagcacatgaaaactatgacaaaaataagttttactgaaaacaggagtgacactatgcattgggtactggtaatcaatagttattggtctgtgatagactacacttattttgaaataactaaaactgaactacaagtaaatcacagctacaacaatttcttggtaaacaaagcattcaacgcatgaaattagtctactatgtaactgagagttcaacatcttggaatggcaaattgaagcaaactgttacctagcgtcttggggttgaagaggggccagccagagaggtggcatgggtatcaccatgtctccattgtcagaatcatgtgatgacaacgaatcaactttctgtgaactattcttaggatctgattgatagtgtggtagagttcttgaagaaggtgacccctgaattttctttaaggtttcctcattgtacctaactatgttcacctgttcagataacatgacaaaaattcacttagggatacgtgaggaaaaatcataagagataatggaattatccttgtatgctaaaacattgtcttaattaagttttatcatttgggatgtacataggtctgctcattggcctacaccactgaactgatggttcacttttcacttaattttgttcccatttgtaggcacttttcccattgcatccctatatgtaccccattacccttggtatccatttccagcctaacgcttagtagcagtactttcttattttttttattttccaagctaataagaaagaggtgtatttaagtagagcacacagttttgtcagtgatttatgaaatgtcattacaatgttaccttagtcagataaactgcatcttgaatctgttgcaaagcatctttcaaatgatcaccttggatcataacgtcttcaacaatatcataagagatctgcaaaaaatcaaattaggatacccaaccaggaaagcgtccaagacaacttcaagattcatttaaacaaagtgaaaaacaatgaacagcttaatgagaattgatccacatacctcatttctctttgtatgaactgataacatctttgcaagagctcttatattagcgaggggtcctcgaatctgccaaagggattcttgtaagatgaatactatgatgtttttcagttggtactttgaagttaaaaacttgcctgttctactaagccactcattctaatattgttttgccaggaagcttgctgaagcaaatatgctttctgcgaggaatgcacttatgtgaataaccaaaatatataactagcaatgtaaactagagcaggcgaggaattcagttatggaatattttcttcagtttatcaagagcatatctgttacacatgcccatgttttatgaataaaacatcaggaaatatttcacatatgcctgctgtatatcaaaggggatgcctcaaaactgcattcctaattgcatgttttcccaaattccaaaataatatgtgtctacaagaaaggttataggcattggctggcaacagttaatgattccagtcaaaaacagttaatgaatgattttattttgaataaaaattatctaatggtcatgaacaaactacctggtccatgacataagccattgctaaagttcgagaaatcataagtgcactatttttccattcagtaactaactgagcataactattagcttggtctccagaagtttgaaaatcccaagtttcccctttagtatatggagttatatctgatgacttgtctaagaatgagtgtgatggtatctgaatatcagaagtctcggagttctttgtacatccaactagttctgggagctccgcaacaaggaaaccaacaacaaatgggtgtttcaccattggaaggactacagctccaaattcagttatgatttccatctgcagcatatgagatatagtaatcaatgaaattaaaacaaataggaagaactgacatgattaaacttgaaagctcaatagctgctgtaactaaaactggatgagcaggtgtggcctgacaatctctttaacgctaacattgccctactatttgccagttgcatgttcagttgattaaaaaataaataatttactaaaacaagtttatacactaagttttaacccacataaatggtaaataatgttgttcccgctgtatgcacaagtgaactctgcattggttcataggcacatccgcacatgtggtgacaagaatgaggtcaggtgttcgttaaccttttgtccaatcaatacaattcttaaacgaaataaggtgcttcattggcagtattacaactatgaaaagtaccatgtggattaaaaggcaatgaataatttacctggtgttttacaagaaaagcttccgctgctcttagtccagcagatatggtgaaattaccaactagaatcactgtatctcctttagaaacattagtttcaggatataaagcaactcgacgtaattcaagctgatccataatataactgccagcaggtcttacatacaccttcaaaataaatagataaaaacattttctttattaatttatgaccacataggttgaaataagcacctaataaattcctaacaagaaaagaatttattcatctaaatggcagataagctaaaaacgaaacaaatggtgacatgattgtttcagattaatcgcggaactagttatttgctctcatactttacacctccaaaggatgaaattcagaatttgctacaaaaaacatgaaaactgttggcactcacaaacactttgctactccatttttgtgggctgaggaatcctagtgtcatttgcaggggctaatagaaaatttccacaaatgaaaatatagcagttacatttccttttgaaagaagaaggggatgcacttcaaaaccttttctacgtagtctagaagaaaacaaacttctacactccttattaattattagagtaaatttcacgaaaccacatattttacggtgaaacttacataaaatccttggtattttgactggtggcacataaccccagccatcatggttctaaagtttcacaaaacctcgatgcatgttgactatggatttaattacttaaaattttaaaatatagagtgcatataattttttataattattgcgttcttgactaaggttgatagtttaactcttcactaatttgcaaaatatcgtttcagatatattgaaattaatcgagatctgtctaaaggtgggttttatgaaacataaggaccataaaacctgtggttatatgccacaagtcagaatatacatgtggttttctgcaacttaaactataaaacttgtggttttctgaattttactataattattattcagttaaatttaatcatcaactgttcatgaacaaatgttgtgcacataagcacaattggacctggatattaccatcctggactcctgatatcattttgttgtcatccttaccttattatatgttctccaatgtttcgatgtactttttgttccttaaaataacataagatggtagtacctattctcatctaataactatattgctcataggtgacttattttgagcagaacaagactgtaggagtagcaagcaaacctatatagtgctatcaatacatagggaaaaatatagcttacagagaggacggcgtcgcgggagatgaccacccggaacatctcgagctgctccccgcacagtcgccggaagtcggtgctgggctccgtgaagcctccctctcctcgcagcttctcattctcctcccggtgcaccctcctgaaacgcaccggcgacgcgctcgaagcacgccggatggcctccgccacggccgcagccgacggcgtgccgaggtcctctacctcttccccctccccctccgctggagccgcgacgtgacggagcggctggcacgcggcacgggcgagcaggccgtggggaaaggagtgctgggcttcgatggcaacggcgggtctgggattgtggggggtcgggaagcgggggaggcgaacgcggagggcgaggtagggggtgtcgaggagtggcatcgcggtgcgggaggaggcggtggcaacaacgccaaggggactattgggacgacgacgttggtttggccattggcgagccgcgagcgccagaaacgaccggcgtcgaccggattgcggagagcaccggacacaagtttccgctaccgcttcctggtgtggctgaacagtggcttcttgccggggctgcgtgcctgtgcccacaaacccacgaccgtcgcgttagccagagaaacgttatccttgtatggatggattatagtttctccctttttaaaaacttattttacaaataaattattaaaaatacctattcaataactaaactattttcatggcacaaacatcattatggccatggtcgacgctgccattgatattgcatcgtcccccttgccttccacataacctaaattacggttgagaaagggttgttgtcagtgacaccaatcacttgtttatgaaaaatagtttttaaaaaaactaaaatgtaaatatttttttcttataaataggttgtcagcaccaactactcttgtgctgagaacctatttgtaaatattttttattaaataagttgttatatcttcaatatatttttctttacgtttaacttgtcattgattttgtgttgaattgtttactgttgctaaagattggaattttttttcgatcactaaactaagttttaggcttagtatacgttgggagaaattttttcaggatttaaacgttaaacggagggttcattttcaacactagcataaacaagttaatgcatacgtatgtttatattaaagttctcatccccggaagttctcaagtacatctacagctatttcccgagcaaactcctaggcttcatcaattagctcaagtgcgtgctcttctgacgtcccatcggcgaagccatcctagcggcagttatatccactcggggatacaaagattttgtcatcgccaaggcctggctagctcccctggtggcatcctctttgatactcttgaaatatttgcttggagaacttcttaacttgtcaaagatttctatgccatcttccgagttggagcccaagctattttgaaatatggcattaaggactggggtcggtgcactagctatttcatcccgcacaggctcagccctttctacccttttagcgaagacatcaaattgtgcctaggtttttggctttatgggctacaagtcaagattgacattttatcacaaggtatataacggcaactatggtagcagtgggttagtatgcttacctgtcacgcccaaaaatttgaaaataattgaagaaatgatgcccccttaaaaaaaatagaaggaagatgaaagatgtgatacactttctagctgaagaacttatttagattgatttccatcaatttagaagacatgccttagtcttatgttcaggaattttcgttgaactttagttttccattcaattgtgaactcggctgttttgtggatcttttttttttggctgtctacgtatctgttgacagaaaatcctacctcctatctttcaaattaattttggacaattggatctgcttcaagattcgttcagaccccttaactctaactcctctcctcctcccccatccagatcgcaccgccactgctcctaccgtcccttgcacgatcccccgtcaccaccgccccaccgcgccgccgcctgcctcgccggctggatggagggcgtcaacggcgctggcgatgccccccggccagcctcctcccccttccccctccttcctcctcgagccgtcggcagcgtgatgcccctgccaccaacgctggcccactggtgtcctccagcccaacggctctagtgccaccgtcagcgcctcgccacccacccgatccgccacccactgccgggcatccctctaagcccggcgaactcccccttcttt

SEQ ID NO: 25461 - DNA, 11798 bp, Oryza sativa
  unsure (1)..(11798): unsure at all n locations
ctccccctcccacccttcccaccccacccacccccaggaccctaattcgtcggcccttcgctagagtttgggttgtcgctggcgccggagaaagaagaggagttcgtcggagttggagaagaagcagttggagcacgaattgcgaagcacatccagtgaaccaaaatttgcaaggtttggaggtaggttttctgtcgactgaagtttagcaattctgttttttttttttcaccgtgctggatggtttaattttaactacatttttttattgtatacagagcgttgctattttacaattgttggtatttcttaacgacattacagaaatataattctcagcaatgccacagaaatacttctggtatattatggttacagagttcatccgcaagcgcacggatataccattgtaacatttcacccgagagtattccaagggtatcgtattaattttatcctgtgggaagatcatgtagagagaacttgattaataatttatatgttacttgtgataatcatagcctaagcaggagttaagataatccaagggtagagtgacacacaagcagtagctactcatataatatattatctaagctaagtggaaagaaattagtaaaggaaatatattcctatacttctagtatacatagtatacatacattctagttatttgatatactagctaataccctctatccgatgccctcctggtacttcgagaagccacccctgactgccgagttccttacgacagcccgtcatgaccatacaaccagggctaaatacggaggaataccctcccagggaattaacttaggattatatacacatgtggaggaatacccgtactgagctgtcaccatcagcggcccacctctcatccgcagcatataaccccaaataatgatatcccgtaacctagacaccatgtataaactaccagatactactctaatatcatcgtcatgacatagagtaattgcataagcaaacattatacccgcactaaagcatctcccagataagctagtagtatattcagtataacaagaacataatgtaaagtaggcattcatatactcggaaagtatttcaataccataaatgtatatagaagagtattctaataatattacaaagccatacccgaaggcttatagaagagaagagaagagctagtagagtcatgcccgaactcttccaaaggctttcggactcctgatttctattctgttcctattccactagcttgatactactaaaataaacttgagagaatatgagagagctttgcttgaggtgtgtgtgtgaagtaaggagaagagctccttaaataggcaggtaatgacggttatggcggttggaatggtcggtaataccctccaaccgccatagggggtgaatctccaccgttccctcaaaaccctgcatccattggcgctggcattggttcggccgaaccctgggctggcccaactagcccacaagttggctggtggcctcctggacttctcctctccatagacttgtgaattttggcccaattaatcgtgtcatttctgagtttttggcccattcatacataagactgattctcgacatcgcccgattgatttattgtttgtgttgatatcgattcttctccactttatggtcattctctgcaaaaaggttagtatacctaatactagtggaatattattattctaacatatatatgcattgcaagccttactagttctcttttattttgttaatattgacggtcgaaactgatcgataacgaccgtcaacaacaatcactgattctctctttatagtatacttgagaactccaaaaaagtgcatgttcccataaaattgttgcatatacagttaacaaaattaaatatgtacaagtatttatccgaagacatatatgtgtctttagtacaacatattaacaaaaataaaaatatgtattagactggggcatccaaatacatgcaaacataatattgagatgttataaagcgcctctaagagcgtctccacgttaattcagttatggcgcaaatgtttgttctaaaaatgattatttatttatagagaaacagctaaaacgactatatgtgtttatggagacgtgcttcaagcgtgtccagtgaacgtctcagattttgtagaggtgttttgtaaaatgtctctatatttttgagacggtcctgggggaggtgttcctataacgctttataaaaatgcctcaactatctactagagatgaaacaaaacgtctctattctttataaaaatgtcttctttgggggtgttttgttttagtggggtcctattgccacaccgatacaaggttccagacttctccaagtttttagggcaagatgatatatctacaatggaacacatcagccgattcttagctcaatgtggtgaagcatcggttgaggaggctctgaaagttagattttttttccatcatctttgactggattggctttcacatggttttcatcattaccatcaaattctatccgaggatgggccgatcttaagaagcaatttcatgattacttctttgctggaatcaatgagttaaaacttttagacttaatatcggttgagcagcaagaaggagaatcggctatggaatatattcagagatttcgtaatattcgcagccaatgttatgatttgagcctaagtgatgagcagttagtagatcttgcattacaaggattgtcagcacctatcagagagatttttttgccacgagtttgacagtctggctcatctaatgcaaacagcatcggctctagttttggagttatcaagatcagacagaaataattttgaagcatgagttctcatactccaaaattggggggcatgtgttaacagtgaagtttggtaagccccgaagtcaacatcagagcttcagagtcctggaattagccgacgggaattatcaagatcagttctggagttatcaagaccagaattttgaagcatgagttctcatactccaaaattggggggcatgtgttaacggtgaaatttggtaagccccgaagtcatcatcggcctagagtcagtattggcttcagagtcctggaattggccgacgggaattatcaagtcgccaatagtcggattcttgctatattcagtttgtgtttagtgtctgattcggactttatgttttccttttatctttagaaagtttctttcttgtccaaccaggactagtatctacaaatgggtgtaaatatgtatacccggggccattgtaaactatctctcaaatcaatacaactaccctcgtcgcattgccaccatctctactgaggtttttacttatcatccggtggaacttggcacctgacgcggggctgcattggctttcgattttcagcgaaggggtaatgtcacaccctgaagttcttctcccaagccgaaattaaattaataaatgatctcaagaaattgtctgtgtaatggcaagagagaaaccctaatttaataaatgcaaataaaaatcgaaattggcatatggaatttttcttgggttctacatgtcaaaatatgctaacaggatttttaatggaattttcagagctctagaaataattttaaccaattaaaacttagcacaagcaattattaaatccctagaaattctttttcctttttcctttccttttggccccctccttttccttcttgggccactggcccatttccctcctcccctcccgcgcgccccctccattgggccggcccagccgccccgcgccccctcctcgctccaggacaccgacaagtggggcccacctgtcgggcccgtccccaacctccggccggcgcccgcgccgcgcctgcaaccgttgccgcctgctctctcccgcacgtgcatgttgcctgctcctacgccctctcccgtacgtgccgcaaccgccgccccactttcccccgccccccgcgccgcgcccgagatggccgggattcaaaaatcgaatcccgcctctctctcctcccccacctcccccacttcaccggccactccccgcctcccccggccacatctagcctccccggccctatataaagcacacccgccccctcctccacctttttcccgttctcgccgagctctcccgtgccctccatcgtcctagcgccgcgcaccacccgccactgccgctttagccacctccggctgctgctcgccgccgttagagtcgccgccgagcctcgccgtcgcgttcgccgcctcaagcgccacaccgtccacccctccgttggccgaatctgccgccggaacttgcctcccaccgcgcaccggtgagcttgccattgccaccaccttcggccggcgtctccgctcgttttgctccccctctccccctcaagtccctctcatttgcttctttaggttgccccgcagtccgtcccgccgtcgccattgctttccgcttgtcgccatcgtcaatcgtcgtcagtgaggcctcctcctccccttcctctctctctcgggccacttagccgtcggccgctcactgccggtcgacgccttgcgccgtcgctgcgtagcaccgcgccgccacgcgccagggccgccgggtcggcttcagccgcccgcacgcgcccggccgcgcgccgcctctgccgtccggggctgttcatcgccacccgtgtggcagcccacgtggccgccacgtcagcgccacgtgtgcgccacatggcgctctcttccccggtcccgtggactcggcccaccatggaccggcggcattgagccgatgacatgtggggctcgtatgttggcgccgcgcccccccctttgctgacgtcaccagggttaataattgcacaataaatcaattaagacttttctttttatagtaaaaacacagtgaatcttctaaaattcatagaaaattcatccgtgccccgtttaagcccattcaagtctcagtaaatcgagaaaaatgtaaagaatccattaaaaattgttttgttctctgtttcagtagtcttatagcctgtttgcattgttttccttgtatgtcgcatagatttcgtgtctcccgacgctccggtgtacttcgaaatagtcgccgaagttcctccagccacagagcaaggctagtaatgcttttctcttgaacatattgatctcatattgcaaatgctctactattttcctttaaatattgcattgttttataatgttactatcggatgattacctactgtctcagccatactatttgttatcctgttccttgctagcttgggtcgtaacatgactagatgttggattagggattgcttagccatgcttagttcaactagtacacaatggaggaactacattaatgcatagacttcagattctagtattgatgttggattagtgccactgctttggtgttggctaattaaaatatattaaatggtgggctatgggtgcatggttttgatggtcgcgcccatggcaattaaggaccggttcgcgggattccctggaagaatttatcgtacttaccacaagccagcgtaggcaacggctgggcttgtagtgtggcttttctctagctgacgcatccaggcaagggtgggcgtgatggagcgggatgggccctgcgacggcctttgtcgcttccggattcacctaggcacgagaggggattgcccgctgccttgcgaggagtgggggtgaaacctgaggtgtggtgtgcttggttagaggggcttatgtgaagggtcctttcacggcctctttccggtatgtcgtggtggcatgccggcgcacgggaacgtgtcgtggggttgtgtcttgtggtacagttgtataccttttatcagagtaaaactattcgaatagccatgcccacggttatgggtggtcaaccagattcactgtgattagtctcaccctagtttagctcgatggaactgattagttcaggtggtgggttgggcctgtctcaacgtggtgtagtgttgagcagtgattgttttaatattggttaattactacaactgttttactgctttcaactactatttataaatgctagctttatgtaaatgaaaccccttttagccttctttggttatatcctgcatcataccctccgttccggtatgacttgctgagtacagtggatagtactcagtcttgctctatctcccaatccctcagagtttgagtatgcgtccgatggtggtttctccgaggagtaggcttcgtccgtgccatcgaggatgcctgtggagtggtgttctccgctactatccaagtcaaggcttagctctagttatcctttaatttccgttgcatttgtgtaagacttttataatgtttgtaagacgcggatctgtatgtcaactttgtcatttgtataccctggccggtcctggacaggggttttattgcacattctacttggaattctattcgggaatttctgggtgtgacaggtaagtcctatgttccgccggacttggcaattgtattggctacattggtgttgttgaaggatgcatcgcttcgacccttcgatcgctctgttttggttgatatatttgcctacctatttatcatatatcttagttaatctagtttcagtatatcgatttggtcatatcaactaattcttgctttaggatttatgccggtatcggctaaatcgctttactagattagattagctaaggtatctaccacccctgaaaataagtcaagggcttcattgtctagatattgtgcttcttttcatacttagtgctgcatcagtacattcgacctactaagtcgtgtttagaaccatgatctctaggctgcttttgattgccaataagggattcatcggggtttcagccgatgagttatctagatgttgcatcggcttataaggattacatacaggttgggtttagcctattgcaacaaaggtttcacttccagctgatgtatgctttaaccatcggatcgcttattctattatatcattgttagccgactaatttctattggattatattgttgttttttacattatcattagctgattgcctttattgtaatttactcaagtgtcagaatatatattggatatattgctcaaaaccctatcactatcggctagcatcggcatcggcttgaattactccatcggtttgtcagccgatcggctctttgatctgctatttatatcgcttgtcatttgtcagatcaaactgactggcacgcccgtatctcatcaacctttggacctgcactggagctaagtagatctcccaggccgttgtgttcattgacttagtccgcgcttgtaaagttttggcaccatcggccgagcgcggatttttcgttaacaatgtcatttttctggaaaaatggaaataaagagaatgctactgcttctttaccttctcccccaatttcttttccttgcataaatatggagagggcatgactatttctttttctctctgttttttttatcatgctccatattttggaagaggatgttttttttattgctaagcctttccctgcttttctctttttcttttacaaatgatttttaggagaagaaggcataattggaattggagtatttatttggatggaaatgtgtggaaatagatgataccaacttccagtgtagaagcttagcttatttgtgcatcaatggtggatgagtacccttgatcatgaaagtatgagagacatctaacatgagtcacaataatttggcaacgcatgtatatgttttaacattgatatagttgtgtatgaccttggtacatagtgatgaagtcatttgaggagtaagaatccaaaattttagttttgaaaacaaaaatcccaagtgtcatgacaaagatcataaaactttccttcatcttaaccatctctcatgtaacaattacttagagcaattaggttccctaaaatggtagttgttcacaagtgacaactatagttgaatcacaggaaaatttcattagttgagagtttatccttttcaatttggccttgagttgaattttcatttaatcactgctcatgtactgaacaaaaaaggagagtatgaggaagtggacgtgcttacctgtacacctgacaaaattaagagagattggagccacgatgggttcagccgaaccaggggttcggccaaacccctctgacgcccattctctctgtaattttcagggaagttcagtgattgtcagaagtttagagatatgcattattttcagattttgcacgttaggagtccgaagtatcaccgccacacttatttttgaacctaaactttattgaatatcctagaaataaatggcttccattggggtaaacaccaatgagccaaaattattataataaagacatgcgcttacattgaacattaaagaaagcaaagattgaaaataaactaaagcgcctctaaactacttattaaatggggaaggcatctaattcgcataatacttgtcctccttccccatttcagtgaatgcgcttgttcttagtgcacattccacggctaaaggtgttgaaatcatgcctaagctcagcgagctcaacacctaatattgcggtcactcaactccttgttctccttacggagcttcttcacttgactcacgagtttagtgaccgaaggcttgtgcgattttcacttcatcttcttggtattgccccggcgcccgaatgataggaggaggagtcaaatgacgcctcaccttggcgggtgaggaaccaaccgactctgctgcctcgtccttttccatgggcgtcaaggggcggcacaagcccttgccgtacccaccgctaggggttctcactcccataatgcaaaacctctcccccttaggggttgatggagtggcggtgggtgtcttgtacttgtttagcacctcatctcctgccttggtgtacagagtgcccacatacttcttggcgggtagcagattggccttcaattgctcttcgaacaaccccctcgccgttattgggcctagcttgcccgtcgtactggtgaatcacccacaccttggtccttgtcatgtggcacggtgagagagatcgtgctgccgaacgcgtagccgaacggggccgggaaggattcggccaaaccagggagttcgccgaccggccccaaatcggccgaggagcttggcacgaagatgatgggttgcgcccacacagcgtttaccccctccattgtgtagtttttgacaggaactaattggttagccggagtgggttctccctctaggttaaacgtggaattggaggtggatccgatgtagggcatgagagattttccagccatgggggaacaatcactagtgtgaggggaattgagggaacttggaaaggagagaatgcaaaggaggagggaagaagagaggcttgagagtgctctgcgagttctagattgatctaccctgaaactcgcatcacaaacgaactaacacgagcgggggaggcatccattcaaaattggggccggcaggacgccaaattttgcacatctcttgactaggctaactcaagctagacatgatacaattttatagaatttaagcaaattttagatgagatcattatggttcgtagttgattaattcaataatatccacttctttatctaaaatttcattcggctcaaggaaaatttttaagcgctatctgtttaccttgaatatgttacctgagtcatcccggagtgtgattgctctgtgcggcgaggtatcgatgacatcatatggcccttcccatttgttgcgcaactttccatgtccaaatagcctttcccatttcctggcttgaatttcttgatgttttatccgcttgtcgtgccagcgttttgttctctccttataagtcttggaattgtgatataccttgtctctccattcttctagttcagctaactgcatttatctccattctccggctccctcaaaatccatattccagttttggattgccaagtacgctcaatgttcgagttctacagggagtcgacatgacttcccgtagattatctggtatgtggacaattccaatgggtgtcttatgggccgtccggtatgcctagagagcatcgggtagcttgtccttccatcctgtgcccaatttgttgatcattttctgtagaatattcttgatctgtttgtttgacgtttctgcttgtccacttgtctgaggatagtagggtgtagcgacgttgtgcttggtgcccatttcacgcaaaaggtatatgatggttttgtcaatgaaatgtgatcccccatcacttatgaccattcttggggcactaaagagaggaaagatgatttccaagaacatcttcttagcatgtttggcatccgtagccctacgcgacattgcttccacccatttagacacatagcctaccgctaccaggatatactcacaattatgggacttaggaaaggtcccataaagtcaataccccacacgtcgaatatctccacttgtaggttatacgtgagaggcattgcatcgtgagcagtgatccctccttacctttggcagctctggcatcgtttgacaaactccttggagtcttcatatattgttggccagaagaatccactctgccagatcttggcttgtgtgcggaatgcaccgtaagctgtccaccaantaagggcgaannngagtggcnnatctctnnnctataatnncttgagnncnccttagnncaatcccgttcccgaancagactctatataggtatggctcatcctagatgtgacgtcagctctcatatttcagctttctctgattttcttccagtgatacgtactttaataccatgtagtttactatatttgcgtaacatgggttggagtcgtgcaccgtcattagcatatcgtcccatagaaagtcatttatcgggggttcctgcatgttagtgatttgcatcctcgacaaatgatctactatagtattttctactctctttttatccttaatttctaagtcaaattcttggagcagaagaatctatcttaaaagacttggcttagcatctttcttagtgagcaggtattttaaggcagcatgatctgtgtaaacaattaccttagctcctatcaagtaagatctaaacttatcgatagcaaaaacaaccgtaagaagctctatttcagttgtggcataatttttttcgacggttaaaacagcgggagaggctcctatatatatatatgtacaagattgagatattacagggtgggaagaataaattacagtgctatctaatggtttgtatccatgcttgccaactgggattgtctgctgcctttactctgtgcatatgccgagtaaaatcatccttgaaatctttggtccattttctgaagcttattggagttccattaaagatgaggtcatttcttatagcccagatattccaacagctaatgcccaggatttccatgaaaaaagaatgagggaacagatttttagttgccatgatcatattcatgaattccatatttaagttccaagttatgccaacatggttccaacattattatgcaaacggatatgagaaaaaaagtggatataatcttctgtgtttgtcacattgcacaccagacatttaattcctccctgagtagagtagttctttctttgaagcagttctttagtgtttagtctatccattaagagtagccaaagaaaaacctttattttcattgtgcttttacttttccaaatgagagtaagagggatt

SEQ ID NO: 25462 - DNA, 368 bp, Oryza sativa
cgagctcgtagacactgcctctggagaaagtcaagtgacccaaatgcaacagtacaatctttggcagcatgggaactggcttgtaagcagaaaaacaagggtggattagaaattgtcaatctagaaatccaaaatattgctctcctcacaaaacatctagataaattctttaactgcaaagatctaccctaggtcaatctgatttggaacaaatactatgttgaatctgaaaaacctcctcatgcacataaagaaaaaggctccttttggtggaaagacatcttcaggctgatccctatctttagagccatcacatctgtaactattggaactggaaaatcactgcccttttggaaagataattggaa

SEQ ID NO: 25463 - DNA, 497 bp, Oryza sativa
gctatttcaaattttagacatttgtgatttttataccacccaccagcatggccatgccaaatgctattccacgggataaaggtggttacctgttaccacacgacttaaactcagacatgagcatccatgacaatttaaaaactctgcaattttgtttcagtgacaatgttagtttcagctgtaacttcagatcatgtgagatactcatagagaatatttatatgttacctagagaatgatcttttcttgtaaaaaaaataatgttaattcaggtcaaggaatcagagagataataaaatcaaaaactcaccaagcgaatgaccttttatgcttgattgtgactctctaatatttgatggagatttaaattgaaacttggtaaatccggaaacaatcaagcatcagcctaacagtagtatatggaagcatgggaaatctagcctaaatttgggcaattattcgaatagcaggaaccatagcatttttgttgaatgaag

SEQ ID NO: 25464 - DNA, 6839 bp, Oryza sativa
atactaatttctttattataacaaccaagatagatgaagaaaattctgattaaattgctatgtgccctcttgaacaagcttcagctgaagtattcaaaatgatagatgattgttcacctgccatccatgtcgattgaggggaaaagggaagtaagacagtgaaataagacagaaggaaaaatcctttgtttttcattcgagtgaattctgtacatttcctctcatttatgtacactactatacatccaaaaattgtttcaatgatcagcaaatcctctaaaaggcggacgccaatcacaggggatcagagttggtgtatgatctatctacaagctaagagcattcaaaagagaaactctgctctggatcaatctcctgaacaaagtctcaactccgctctcaagatcaacgatgtccaactccaacgcctgtaattgctcctcctggcatgtaacccttgtcttctggaatgccttggagacaagagaccacttgctttgacttggcatcgcaatctgctttgacaggaggtgcaaagttgattcaagcaccgagagagcgatctctctggcatcagccagcagcttgaccaccctgcaaccctcctggtcttctgaagcagacttcttgttgatcttcttgaactgtttctgcgccttcttggtcaggcgggtgtaagcctgaaccttggactgaactgctgcatcatcacccctcttgatggccaactgcatctcctgggtgctcgccttgagctcagagaagctctcttgcatggcgttgcagaggtcaagcaaggcgagagaccgctccagctcttgctccacagatctcctctgctgaagcctgaagctgggcaagcacatcatctcatccatgcagctgtacacatctgtaagtctcctgaaaccattgcacattgtttcaattgttgcagagggtgaggagacgatctcctcgaggctctgcagctgttcttcgacgtcggttttggcagagcgagggctggaaggcgcactcgcggatctgaggtggaatgccatggctgggatggaagctgatgacttgtttctctctggaattggaagagaagaggagataactcaagactgcttcgcaatgttgtcgacaccaaaccatggcttctctgtatatataaccaaggaaggagaagcaggtctcattgctggaccagcagacagaaagaatctcattgataattgacgatcacttgtgctgcaacagaactacagaagcaacaggtctctgtttctttaatctctatcattatatgctttgctcgatgcaagaggcagcatctctactgattgaatgaacttgtgagataatactagtagatgactagctgtcatgtctcacctgaaactggagacaaacactcatctgcacgagcgcgtgaaacttcagtttaatgccaggtccagatcgtgtgagatctgtgatgagcaagcaatgccaatgcaatgcagtgagaagagatgagctgtggttgctgttgcaaccgtgcaaagagtttgactttgcctcgtgtgcatatctatcttggaaacatatcctatacacacaggccctcacgtgtacacacgtgcacaccaactaaaaaatgtcaataaaaaatttagaaaaaatcatacacatactttcaattgtattacacctagggttaaaatcttaacgttaaattcattatattttagccgtaacaaaaaaacaaaaaatctgattgttttaaggttgcaattttgtcagaattttatcttttttgttattctctatgtagaatgaatttgaagatgtgactttgcacgtagatgtaatactattgaaagtacatgtattaattttttgtgataatttttagttgctgtacacggtgtgtacatgcgagggtctgtgtgcataggatacgctcccatctatctgtccgttggaagcagatatcgcagtgtatttggttggcttacgctttctgtattactacacgatgattccatccataattgccttcgtgcgcatggctggtttgtttcacctcaatctcgagatgatccgtgtgttgaacaataactaagcttatcgggctgtcatgtttgctaactttttttttattaatcgtccgcaaataatccacaagggcgtctaatatgcgataatgcgaagttgcaaaccaactcgcttgtcctcgcgttcgttcaggaacattagtacgctattttgatctactccctccttttccctaaatgttttttcccctaaatgtttgataccgttgacttttttaaacatgtttgaccgttcgtcttatttaaaaacttttgtgaaatgtgtaaaactatatgtatacataaaagtatatttaataataaatcaaatgataggaacaaaattattaattgtttcctgcatttgcttttaagacttgattaatgatgtacttaagtaaacccttaattctgaacatgaaaaaaagaagcgctttacaatgcaaaaagaaagaaaaatctatatttatagccgcgccgacttcaaatgtcttacttcctccgtttcacaatgtaagtcattctagcatttcctacattcatattgatactaatgaatctacacatatatctatctagattcattaacatcaatatgaatgtgagaaatgctagaataacttacattgtgaaacggagggagtattgtttgacttatgattataaaatttgaattttagaactaaattttgaatttgatttgtttgtttttttcatcgtagtttatttcacaacatttgtttttaaatcgctaaggacacgtatataacaatttccttaaaaataagcgattcggataagcatatgaataagagaaacaatggggctgcaaatgactccaccccttcaaccatatctatgggcatgttcagattgatgacatttccaaccatagcattatttggtaaaattgacaattatgtagctacgtttagtttgttaccaaatattgacaatgtgtatataattttggcaacattaataagccaattctaccaaaactttggcaatgttgacaatttgctaaaattttggtaaagtttatttcgacaccaatctaaacagaccctatataagagtatactacaagatataaatagttttctaactatgcagagttgttcaaatttttacagaaaaagaattgttgttggcaatgtagtttcatgggccaaactgaaggatagcgagaccatccggcccacaggaagcccatgaatccactcagtaccccactcgttccccaatccacgtgtcttcgtctcaccactcgccaccaccccccaccggagaagaagaagaggagcgaggagatgcgccgctcgccgccggctgccggtgaggccgcgaccacccttcccgccgctacccccgccctggaaggcagcccccgacaagatcgcggaggtctccatcagttctggcggaggtatcccactaaccctaactcaatagcacacggtatctgcggtatcttcgcaatgccttgcgttcccagccgaatccttcgcggccatcctgttgagacctgagtagacaagcgaatgttcagggccaatggataattccttgtgattctgcattcatcgaacattttttttttgttggcgtcatcaaataattccgcacgtatttcacagatcacatgctgtcttttcttttgcagactatgttcggagcaaagcacaactgcacaagggcaacagtactgacatggataatcgcatagaggttgaaatcagaagcatgcaaggattttcatgacactgagtttggccaaaacttttgttcactattatgtatggagttttctgtacatttctacttatatatatacaatgtgaaagatcagcagatcctttaaaaggcggatgccaatcgctgggtgtcgagtgaagattctggagtatctatgagctaagaatgttgaggagagaaactctgctctggaccaatttcctgaacagatgtcctgctccgctctcaagatctctgatgctgcactctaacacctgcaattgctcctcctcgcaaataactactttcttcttgttgaatgccttggaaacaagtgattgtttgggcatttcgatttgctttgacaggagatgcagtgtggactccagcatagaggttgatatatctctagcctccctcaatagcctggccatcctgcaatcctccttttcataagtaaccttctttgcagtcttgaaatgtttctttgccttcttcaacaagcggtagtatgattgggtcttggattgaacagctgcatcatctccttttctcagggccacttgcatatcttgaatgatggccttcaactctgtgaagtcctcatgcatcacgttgcatagatccaatagctcaagggagcattccatttctccatccaacaattttcttcgttgggaggagaaagcttggttgctaggaaggcacatgatctcctcaatagagctatagatgttggcaagcctcctcaaaccctcacacattgtatcaagggtcgtggagggtgaagagatgcatgcatctaggatgcacagctcctcttcaaccttagagtgaggcctagaaggcaaactaattgatctctggcggaaagccatttctgtcgctagaactctgtctccctattgagtctgagagatgagaaagagagggaagttttggtttgatgtttctagctttgtgctgaggcctatttatacagagatgtgcaacacacagcatcaattggatggtagacaaacagaatcctgccagttcacctcccgatgctatctatcatggtttgagatctggctgcagcatatagtcttgtatgctcaatattttaatgcactgcgtctatcttccaagtcagctatcacattgtcatgtcccaactattggcagcaaaagccagcaggtttgttcagtctaccggtggattttggcattattgcatgttatcaagggattattttaataaagtgttaccagagtattattattgccaagtgtgttatctattttttaatgcttttgttaatttcaacaagtgttctattgtgtacaatccatgccgcttacacgcttaaccttgtgtattggagctggcctgttttacctgcagcagcaagatccactttacatggatcagttgcttgctagtgaggcaacaaacggcatcagactggcatgacccacatggccatttttcatagccctatggcgcatcatatatcaatttgcctgtaagaaataaaagaaatgaaagtaatatcgctaacttgcccatatatttcataagtcatatgccatggcaattatattgacattgaattgcataacccatcatgtaactctgcaacacgcgaggatcaagtgcacgacaagaattggatcaaaactttgtctcttttcatgtattttctttgctgtacagtaagcctataacatatacaaatgggaaggatcagcaaatcctttaaaagacggatgccaatcgcagggtcttaagagtgtcagatcttgaggagtatctatgagctaagaatgttgaggagagtaaccctggtctggatcaatctcctgaacagaagtcctgctccagcctcaagatctccgatgcagcactctaatgcctgcaactgctcctcattgcaaatcaccaggtttttcttctggaatgccttggggatgagagatgattttggcattgtaatttgctttgacaagaggtacaatattgactcgaatagtgaggtagtgatctctctagcctcgctcatcagcttcactatcctgcagtcgttgtctgagacaaccttcttcacagtcttcttggaatgcttcttcgcgttcttcatcaagcggatgaatgactggatcttggcttgaacaactgcaccatctccttttctgagatgtacttgcagatcttggatgatgaccttcaactcggtgaagacctcactcatagagttgcagagatccagtagctgaagggagcattccatttctccatccaacaacctcctctgttgggatgagcaaatttggttgctaggcaggcacatgatctccacaatggagctgtagatgtccccaagccgcctcaaaccatcagagaccacctcgatggtcgtggagggtgatgagatgcatgcctctatgctgtgcaactcatcttcaactttggagagaggcctagaaggcaagctaattgatctttggtggaaagccatgtctgttgctagctctgcctctttgtgctgaatccaagagatgagaaggaaaggaaactgatggtatgatgtgtctagctttgtgctgaggcctatttattcaggggatgtgctagacacagcaccatttggttggtagacaaacagaatcattccagttcagctccctgatgctgtctatcatggtatgagatctggcagcagcaataaacagcatatggaatctctcgtgttctgttctcatttttaatgtactggcatctatcttccaagagagttatcacattgtcatgtctcaactatcagcagcaagaaccaacaggttagttagctctacctgtggtttttggcataattgcatgctctcaagggattattttaattgattgctacaacagtgttattgttattacatgtgttatctattttttatgctcttgttaacaactgattgttctattatggcaatcagaggctcttgcacgcttagtcccgtgtttggtagctggcgtgttttagctgctgcagctagatccat

SEQ ID NO: 25465 - DNA, 715 bp, Oryza sativa
gaagtgatgcttttgtgactaacaacaatggtaacatggctaaaattttggctgggcgaaggtatacttctcttctgctactggaagctccctgctgtcatcatgtacttcgttattagttctgaccatctatactgcttttgataggagatattttgggcataagagaacgatccggccaaatgctaaaaggctctattccttaatttcgaacagaagaaacatgtcatgggattcattctcctcaagagtgcgcatggttcagaaaggatttatgggagagcccaaggaactcaggccaggaaggggagaatttcatgagaacccttctacctgtatatgtgaaaaaaccgttagcaaaacagtagccaaatctaactcccaatctgagcaagtcttaagtaatgatactgagagaggaatagccattcaaactgagcaagtctcgagtaatgatactgagatgggaatagccactagtgagcccacagttcctgatcatactgatgaagaggcaggtgaatccgaggcagatgaagatgctcctggagagaaagaggagataattgatcctgaagcggatgatgatgtgcagttcagactagaggatccagagttagaagggattctttcagattagttgagttgtcgatgcttcaccaaccaatttttttggtgagcaattgaggaattttgcccctctaacgcctaaact

SEQ ID NO: 25466 - DNA, 4723 bp, Oryza sativa
ccccattccctggagagagatcggatctgttggtgggtcgtcatcaatgaaaaagaagagtgacaacacctccaaatctaactgaatggaactgccatattactcttgctattgatgaatttgcaggcgttcttcgggatatcgtatggttttgttgttactgaactaacttttctggagtctgtaacctccatggacgtaaataaccggccaaacaaacagaggttagttcaacagttctcttccctctccctgttttaactcattttcttactgccctgtttgatttctgcaattgcagataactgtgcttctcacttgtgatcttttcccctaggtgattcttgctcacttttgctcttgcctattgttgcatcaagccctccacgagcatctcatctttctactttcaaggatcagtttttttttttacctcccctctgcaattctctgaatctgacgacggagaacgcaattttcttgcaagcagcacatggcaggatagggaacccaaaacttttcatagctggagtacagttcttgattcactatgcaactatccctttctaggaattaggcaattaggtccccgtgaatatctcactagccttgatgcttggtacagtagagagtacagtaggaatcctagctgaagagatgtatcagctgagctcccatcacatgatcactgtgctgaactacctcccctgttccccatacaatctctgatgctttggatttcgctgctcgtgccggtgttcttccgttccaaggacaagaggccaaacgctttcccccaatgcctgccaatatctctatgcttgctccaatgaaagtcttctcttcctgtcgttttctcttttctgaacttgtgttttctcttcctctctgcctcacgggactactagatggtgacacttgggatgctgtggctatcggcatgttccacgtgtcaatgccacagagttcggacatacaccaactagttcatcatctagtagactagtactagtgtcagattctaatgttggcgtactaatctgtgttaaaactcaccttttctcattgatttgaatttttcataagtataggaatacataggacacgattttatgcttttgttttgagctgaaagcctctaaataataagccctttgcatcaaacacccctttttatttgaaggtttgcagcgaacagcttccactgaagaagttgccagatggtggcaaggcacatacttcactcaaaagctccaacaagctgttagttaattaggtcaaatcagttgctgaccccactaaatataagcaaagaaatcaattcttgaagcagtagttatctttgacaccttccttttgctgcaggtctcacctctcaacaagtcaagcctctgaagcttttgatcccttcacctcgcactcgcagcagcagcaggctgtactgaccaaccaccaagaagtatcggcgccattgctgtcctcctccttggcttgaactcaactcaactccagtgcaggcacatgcttgctttccaaaccaagggataaccactcatctaatcaagccaactccacaagcagctggccatccactgattgatcaatccatccatccatcagcttgctcatggggaaacttaggtactactgctgcttctgcattcttctttcttctgttgctactgctgcatctgcactgcatggccatgtccactccacacacttggccggcattgccagtcattgctatactatatatgctgctggtttcctggtttggtggtctcatgctcatgcatgcacacgtccatctgtgttgaattctgaagctgcaagaacctattgccgtgctgcatgggccatccaccggcgacctcaccggccggcgccaccgccggcgtcagcgttaaggtcagcgaccgatatgtaagtgtgctgctgctggtcagctctgcctgcgcatgttcgatcgattcattgttgacatgattgattgaatgattgattggttggcccgcgttgcaccattgcatgcgcatgcaggttgagattaaaaatggcatatttgagcttacgctgtccaaccccgacgggatcgtgaccggcgtccggtataatggtgtggacaacttgatggagattcttaacaaagaagacaacagagggtgcctactgacaattttgcttacgctttttatcctctctttgatatgtttaattagcaagtacaatagtttggtactacttggatcttgccacatcctacaagtgtacatttgttaattgttattcagctactttgccaatttaaaactaaagaagaaaccttttagtcctcattcaagtacaggctgcaactgaggttatggtcaatgtactcatatggtgttgcatgttgtcaggtactgggaccttgtttggagtaaactgggagaaagaactggcatatttgatgtgtaagggctctcaattcactcggatttcaggaatcgcctccatatgattacactttttgtgctagagagagcccaggtgtatctgacattgaacgttgttacgcagaataaaagggacagagttccgaatcatatatcaggatgaaaaccatgcagaggtctcgttcgttagaacatgggatccttctctggaaggcaaagctgttcccttgaacattgataagaggtgatccaatagcacaggcataacaatggaattgttctcagcaattcatttggaaaaaaggcaatcatgtttaacagagcaagtaatttttgaaatattttgacagcgcaagtatgtttgtacaggttcattgtactccggggctgctcaggattctatacctatggaatctatgagcatcaggaagggtggcctggttttagcctgggagagaccagggtggccttcaagattcggaaagacaagttgttgtagttcctgaatttaagttttcttttttttttttgcagtttgctgaattatgctacatcttacactgaatgttgatccattactttggtgcaaattcaggtttcattacatggcattagctgacgacaggcagagaataatgccgatgcctgaagaccgagtgccgccccggggacagcaattagcataccctgaagctgtccttcttgtggacccaataaatcctgacctaagaggagaggtaagttgacaaatataggattttttttatctatgataaacgtattatatcatgaagaatctaaacactgttactggtaaattgtcaaggttgatgataaataccaatactcctgtgaagaccagtataacaatgtccatggatggatatcattcgatcctccaattggcttctggcagatcactccgagtgacgagttccgaacaggaggtcccgtcaagcagaacttgacctctcatgttgggccaactatgctggctgtaagttcagacattgtattatattgaaataaaaagttcagattattaagttcagacattcttctgaaaccctttttttaaaatatgtttttcagatgtttcttagcggtcattatgctggggatgaccttacacccaagttcttgactggtgaatactggaaaaaggtccatgggcctgtcttcatgtaccttaactccagttgggatggaagtgacccaactctactctgggaggatgcaaaagttcaggtgaaaaattggatgcatatttcgtctctaatttgatatctttcttttattcacaaaagttcaggtgataacattcaggttgattcttattgacagtacaagtgttatgaacacggcacaagtaacttgtaatttaactctctctttctccttttgaaatcagatgatgattgagaaagagagctggccgtactgttttgcactgtcagatgattttcagaagactgagcaaagaggttgtatctctggtagattactcgtccgagacaggtagtaattaatgacatctttttccagttttatacaacagtagtaactaaaagaagtttgattcagtccagatgtaatttagttcgcgatacatctattactaatgaattcatcatgtgttatttaggtatttagatgatgcagatctttatgctacatcagcttatgtaggcttagctctaccaggagatgttggatcctggcaaagagagtgcaaggtgatgcatgctatatacacacttattcttttagaacaagcttgaatacatgttagactatgaagtatattatcaatcacatattccaacaccgtgacccggcaaaaaaaaatatatattccaacactgtagggataccaattctggtgtagggcagaagatgatggaagcttttgcataagaaacattgtagctggagactacaacctttatgcatgggttccaggatttataggggactacaaactggatgctagctaaccatatcttcaggtcagtatctacctgacatttattcctcttgccagcttccaaatgagatatcctgatatgttcagcactcctgttcaggggatgacatttatctgggtgaccttgtgtatgaaccaccaagagacggtcccacgatgtgggagatcggaatacctgatcgatccgcctctgaattctttgttccagaccctaatcccaactatgtgaataggttgtatattaaccatcctgacaggtgatgcagactggctaccaacagactcctcaaacatgtag

SEQ ID NO: 25467 - DNA, 3138 bp, Oryza sativa
ctcctcacttcacaactgggttgattgggaaagacaacacgattgcgaggcacgggatccatgggctgtactggctgttcaacatcgatgtgagtggagcttggcttgttcaagggatgaacaccatctacctgaagcagcccaggaaccagagtccatttcagggactgatgtatgactacctgagaatggaaggtccttctggcagctaaggccagtctttagctagtttaaccagcctcacctgtatggctagtatagctgtactatgcctaggtatgcagtacgattatgacccagatattcccatccactaatattctatttagtgtgctttaaagtttaatcttattttaccaaaaaaaatcctgggttttgtctaaccccggatttagcttatctgatttaggttagctggtaaagatgtaagctgccgaaatttcgcagagcatcagaattcagaaaacgattagatatactctaaatcggtgatatgtattggaaaaagaaataacatttccctgctgttttaactctagtgtaacaatttgaaataatctaaattggtgccatgctcttgtttctcagaattaaggtttgcagcaaacagctttcactggagaagttgccagatggtggcaagacacattcttcactcaaaagtcaaaagctccaacaagctgttagttaattaggtcaaatcggttgccaaccccactaactattagcaaagaaatcaattcttgaagcagtagctatctttggcaccttccttttgctgcaggtctcccctctcaacaagtcaagcccctgaagcttttgatcccttcacctcgtactcgcagcagcagcaggctgtactgactactgaccaaccaccagtttcggcgccattgctgtcctcctccttggcttgaactcaactcatcgatcaactccagtgcaggcacatgccaattgctttccaaaccaagggataaccagtcatctaagcaaagctgatgatggattgatcaatcagtggattgccagctgcttgcggagttggaggatgtggtggtgcttgattagggcatggaaaaccaagggataaccactcatctaatcaaagctgatggatggattgatcaatcagtgcattgtcagctgcttgtggagttttggaggatgtggtggtgcttgattagggggagtggattttgatctctcgagagggatgtcccctcgttgtttgtatgtcactcaaatggttatgaaaaagctctaaaaaaattgagaagatgtattaacatgtgatattactccatgaacatgctagttcaaattcaacttctacatctcgcaacgaaaaacaaatttgactgtgaatatacgttaactagctgtagtttaattatttttttttgttgcgagatgtagaagttgaatttgaacttgcatgtttgtggagtgatatatcacatgttgcattttttttaattttttttcataactatttgaatgatatgcaaacaacgaggggatatccccttgaatgatcaaaatagtttccccaggattagggcatggaaaaccaagggataaccactcatctaagcaaagctgatggatggattgatcaatcagtggattgccacttgccagctgcttgtggagttggaggatgtggtacggtggtcactcctacggaacacatttttgcatactggcaaaactgattttcgcatgcggttgctctagccgcatgtgtgaaaaggtttgcgaaaatcggtatttttgcatgtggccagcgcaatctcatgcgaaaatacgattttcgcacgggcacttaagccgaccacatgcaaaaaaaaataatcgccccgccgccgcctgagatcgtcgcagccgccgccaccgctcctgtcgtcgccgtcgccgtcaccagccgccggtagaaccgtcccgcccggatccgccgcctgagaccgccgccgccaccaccgccatcatctgtgccggatcctccggtcgagaccgccgtcgcgatctccgccacgctccagatccgccgcccaccgtcgtcatcgccgtcacatccaccgcccccaccgcacgaggtaggatcctgtagctggatctgccttcgtcgtccggatctgccgctcgccgtcattgtcgttgagggtgccgtcggatccgccacccgccatcgttgtcgtcatcggcactgttggatccgccccccacctccctccgtcgtcgccggtgccagatccatgtggggagggcctgctcccggtcgccgccgtcgttgccggtgctagatccacgcgagcccgctcctcctccggccatcaagcccgccgccgccacccaccccactccacaccgctctcggagtctcggttgctcttgccgtcgaggtgacaaggagagagagagagaggattgagaggagaggaggagaagataagtatcgacgtttgaggtctcgactacggtatttgcatggtgtggagatcgtcggtgtaccagggtatatgcgagactgaagtgaaagaaatggagacaaggatttttatacaggtaataaccctactcctattgaccaaagccggtgttgctctttattcatctggatcacacaagtacaatatttgggataacctatctagctgtcatcgacttggcggcatagataaccaacatgtagtcgacgacaagatagtcttcctcctcgagtacgaactcatcgagatcagagatggcgctagatcccttttgtcggcctccgcaggcaccatattgggtctgtctaggcttatctctgatgtcgatgtctgccggcgtgttggtttgtgtgtcgatctatcgtgtcctctctcccctagtgtcagggttatggataccacatacataatagtagtcgactaaatctcggcaggacccaccacataccatgtcttatacgggaacaatcttcggatataggaggagttctacataaggaaggatgaatagagttctacatgaaaatgacaaggactactcggattgtatccatattggtttccctagttctacttggacaaggggacacctatgggtataaatacaaggccccctaggaggaaaggggacacgaacaacatagac

SEQ ID NO: 25468 - DNA, 5854 bp, Oryza sativa
tataaaaatcatcgtctccatgtcttttacgtcaatctggcatatatcctagtactaacgatccccataccatgcaaataccggaatcgcggcatcaaacgtcgacacctagggtgtcttgtatttatacccatagatgtcccattgtccacgtaggaatagagagaccaatatggatacaatccgcgtaatccttatcgtttccatatagaactctactcgtccttccttatccggaactccttctatatatgaggcatgattctgtataggacttggtatatggtgggccccgccgagcttagtcgatttctattgggtatgtggtatccagaaccatgacaataaggttgggtgaaaaattttaaaccggtggacagagaaggagaaggctaattagacttcaagtccaatccttaagaggctcgcatgcaaaaatcgattttcgcatgcgggtctcttaagtggcctgcatgtaaaaatgaggaacttaagcatctgcaaaaatcaatttttgcatgcggctctttaaacttcgagtcaaattttatcatacattcgtactaaatgaactcatataaaaaagttgtcaaaaacaaagttgtataacttattgagatctaccaattttttttggttatttctccatcgagtttgattaaactatataaattttaaattttaaaatataagaaatttaaataattttttcggtagtaaatgatttcaaatggaaaaattgttaataacaaagttgtatatatatatatattgtactggttatatatatatatatatgtatacatacatacatacatggcaacatatcatatgcacacagaccctcacgtgtacacacgtgcacaccaactaaaaaatgtcactaaaaaatctagaaaaaattatacacatactttcaattgtagtacacctagggttaaaattttaacgtcaaattcattatattttagccgtaacaaaaaaaaaaacaaaaaatctgacagttttaaggttgtaattttgtcagaattttatcttttttgttattctctatgtagaatgaatttgaagatgcgactttgacgtagatgtaatactattgaaagtacatgtatgaattttcctagaattttttgtgataatttttacttggtgtacacggtgtgtacacgcgaaggcctgtgtgcataggatacgctccctacatacatacatacatacatacatacatacatacatacatacatacatacatacatacatacatacatatgtatatgtatatgtatatatatatatgtatacatatatatacatatacatatatatatacatgtatatatatatatatatacgtatatatatagatatacgtatatatatagatatacgtatatatatacgtatatatatacgtatatatacgtatatatatagatatacgtatatatatatacgtatatatacgtatatatatgtatacgtatatatacgtatatatatgtatacgtatatatatatatacgtatatgtatacgtatatatatatacgtatatatatatatatacgtatacatatacatatacgtatatatacgtatatgtatatattatacgtatacgtatatgtatacgtatacgtatatgtatatgtatacgtatacgtatatgtatatgtatacgtatacgtatatgtatatgtatacatacatatatacatatatgtatacgtatatgtatacatacatatatatatatgtatgtatacatatatatatatacatacatatatatatatatatgtatatatatatgtatatatatatatacatgtatatatatgtatacatatatatacatgtatatatatgtatacatatatatacgtatatgtatatatatatacatatatatatgtacatatatatatatgtatatatatgtatatatgtatatatatatatatgtatatatatatgtatacatatgtatatatatatatatatctgtgtgtaaactataagagaaatgtaaattttgtgaagaatattactatcactttgtcagatgaagaagtgaccaaaataaaagttgtatgtcttggtgagttctaaaacttttatgttcatgactttttcagctgaaattatttactacttcaaaatattatttgaagttttgaaattcaaatttttaattgataaaacaaagtcacaagagaaaatagccaaaataatagcagtaagaacacaataacatgatagaggatgattttaaaaacatttaggaaaaaaatcatccaatttggagttcatatgagtgagataaactagtttcaaattttattttcgcttacggctgcttaagacgactgtatggaaaaatcgattttctcataggggctcttaagtgatccacatgcaaaaatgagctcattttttacatgcggacatcttaagaggcttgcatgaataggaaaatcgatttttccagaagccgtatgcgaaaaagctgcttgatttttcatgcggtaagttatggtccgtttgcaaaaattatgagggtctcgtacacaaaaatcgtttatgtagcagtgggtgattgattagtactactgctgcatctgcactgcatggccatgcccacacacttggcctgcattgctagccattgctatactatgggcctgtttggggagctttagattctaagaagcagctatttggtagccagcttttgagaatctggaaaagctctaaaacctagcttctccagcttctgacttattagttcatttttcagaatatgtaactccatattctcagaagctgtggactgtttaggatagcttctagcaaaagcagctttttccaaaagctgccgctgagacaagcttcccaaaacagggcctatatatgctgctggtttcctggtttggtggtctcatgctcatgcatgcacacgtccatctgtgtgaattctgaagctgcaagaacctctcgccgtgctgcatgggccatccaccggcgacctcctcaccggccggcgccaccgccggcgtcagcgttatggtcagcgaccgatatgtaagtgtgctgctgctggtcagctctgcctgcatatgttcgatcgatcgattcattgctgacatgattgattgaatgattgcatgcgcatgcaggttgagattaaaaatggcatctttgaggttacactgtccaaccccgacgggatcgtgaccggcgtccggtataatggtgtggacaacttgatggagattcttaacaaagaagacaagagagggtacctacctgacaattttgcttacgctttttatcctctctttgatatgtttaactagcatagtggctcacgcagattgcgtggctagcatcgttacatttttttttctcatttaatagcttaaatattttcacattttattattaaaatatattaaaatgacaacgtaattttaaactcttggttgaactaacaaatgtgtgatatttttattgtatggtatacgtgatagttatttataaattatatttatatatggactcaagaataatcttttaatattccttagtttttaaatttcgaatttcctttgttcataaattctattcctatatggattctagactactcttccaatattcatttttctaaactctgaattttagttatttataaattgtatttctatgtggactttaaactcttctttcaatatttattttttttaattttgaattccaattattggtaaattgtattactatattgactctagacttctttttccaatagtttttattttttaaaattcagctatttctaaattgtattcatatatggacgctagacttttttttcccaatattccttatttgttaattttaaatttcagttatttataaattgtattcctatagacgctagtctcttctcccaatcttgtttattttaattttgattttttgtaattctaaattgtatttctatatggactctaaactctacttttatttttttttatttttaagttctaactttcatttagttctaaattcctatgtgtggaccgtagactcctcttccaatatttctacttttttaattctcaacctgttatttctaattgtatttctatatggattctaaattcatttttcaatatcttgttttttaattttttaatttaaattatttataaattgtatgcctatatagactctagactcttttttttaatatttcttattttttatttcaaatttcagttatttataaattgtattcatgtatggactctagactcttctcctaatcttgcttttttttaaaaaaaataatttgaattttagttaattctaaattgtatttctatatggactctaactctacttttagttttcctattttttatttccgaattttaattaattctaaattgtatacttgtatagactccagtcaactctttcaatattccttatttttaattctgaatttcatctatttttaaattgtattcctatatgaactctactttttttttctttttctccgattaatatgggaatttctaagccgtgagagtaaacgtggtggaccgtagactcttcttacaatatttctacttttctaattcccaatatgttatttctaattgtatttctatctggactctaaattcattttttaatattttgttttcttaattgtgaattcaaattatttataaattgtattcctatatagattctagactttctttctaaatatttcttgttttttattttgaatttcagttgtttataaattatatttatatatggactcttgactcttctcccaatcttgcttttttattttgaattttagttatttgtaaattttatttctactagaaaaaatgcccgtgcattgcaacgggtgaaatctattttaatcttattattgttatactgtttagttaaggtgagattcaccgtgggaatttgcttgaatttatatattttcaaaaatcatgagctgctattaggattcttgtgcacataatataattacctttaatttttaaattaaaaactggttcattataagattttataatcaacaaaaatttgttgaagaaaaaggtactatagttttgatttttcatcaaccgatgtgtatggtccgtaatagtggtcgataaaaaaaaatttgcgcgcaaatatgatttgacaggagggagggacagtagacttattctaggagaggcccataaaaagtagatttattccaagagaggcccattgacacagtgcaagtaatataggtgtaaaaaggagagagaggtgattatatggaagatacgtatactatatcaaccgcggttttgacccgacaattaaacggatcccccgaaatccttacgtatttttttaattaggtacagaggtatagattagaattagaattaaataacatgttattattaaaataaaatacaatatacattttttattaaattcttcatgaatgaaccacactatctagaattgttttgaatttttcaaagctcatttgctaattttaataatacaaatataattttaataattaatttaaagtaaaaacaaactaaaagccctctcctaagtctgggccaaatctggcccattcttcttctcctccctcttaggctgccatccctccctattgggccgtcatccctatctccacttgggcccagcagccacctctcttcctttcctccttcttgggccaccatcctcgggcccaacagccatgccaacccatgaaaagaagcggatgggaataaaaccgaaaaagacga

SEQ ID NO: 25469 - DNA, 702 bp, Oryza sativa
cattgcaaagcagtctggttctcttccatttctagagagaaacgagtcatcagcttccatcccaaccatggtattccacctcagatccgcgagcgtgccttccagccccttgctccaatgaaaccaacatcgaagaacagctggcgagcctcagggagatcatctgttcacccttctgcaaccatggaaacaatgtcgcaatggtttcaggaggcttacagaatgtgtacagctgcatggatgagatcatgtgcttgcccagcagccaagctaggcctttgcaagcatcagcagaggagagaagtggagaaagagctggagcggtctctcaccttgcttgacctctgcaacgccatgcaagagagcttctctgagctcaaggcaaccacccaggagatgcagttggccatcaagagaggagaagatgcagcagttcagaccaatgttcagtcttacacccgcctgaccaagaaggcacataaacagtgcaagaagatcaacaagaagcctgctagttcagctgatcaggagagctgcagggtggtcaagctgatggctgatgccagagagatcactttctcagtgcttgaatcaactttgcatctcctgtcaaagcagattgcggtgccgagttccagcaagtggtctcttaaggcattccagaagacaagggttacatgccaggaggagcaattacaggtg

SEQ ID NO: 25470 - DNA, 545 bp, Oryza sativa
aactgggtgaggaaatggtcacctttagactctgcagcagttcttcagcgttggtttcattggagcaagggctggatggcacactcgcagatctgaggtggaatgccatggctgcagtggaagcttatcctttttctcttctctgtggaagtgaagatgagaagaatgctgtgctgcaatggtgtcgacccggctatagctttcctctatatagacaaagaggcagaagcaatggcatccctcaccgtgtagacaacaatgaaatctcaataataatgaagtgctttgctgctgcaacagacgccacccatctcctcgacaggctgatgtttttttatgtttcccaaccaagtgtagaggcatctctagctcagcttacaatgctgtcatgtcctgattattggcggcaagttcacctgcacaagtgtatagtctaatgtaatattcagatccagatcatgagaaggatgagccttgctcacaggagcagcagttgacttctctctccaggctccaaaccgtgtttcttatatggtagaatctgc

SEQ ID NO: 25471 - DNA, 252 bp, Oryza sativa
gctgatgctgactgatgcgattgcagctagcctgcgtccgtgtttgtttgtctgtgtgtgtagtgtattgttagctattagctgcaagcattggtcacgagacaacactgatcagaaggggttagctagctagctatcagatcgagacacacatacagtagagaaacaatgcatgtgagaaatggtgaaggcctgaagggtggttttgacggctacctggtggcgcgacgtgaggtgaggtcctccaataat

SEQ ID NO: 25472 - DNA, 723 bp, Oryza sativa
tcagagatatgtcaggactgagtgcagggcaagaattagatcaaaattttgtctctttcatgtgtgttttcttttctgtacagtgagcctataacatatacaaatgggaaggatcagcaaatcctttaaaagacagatgccgatcgcagggtcttaagagtgtcagatcttgactcatctatgagctaagaatgttgaggagagtaaccctgctctggaccaatctcctgaacagaagtactgctccagcctcaagatctccgatgcagcactctaatgcctgcaactgctcctcattgcagatcaccgagttcttcttctggaacgccttggagatgagagacaattttggcaacacaatttgctttgacaagaggtccagtgttgattcaaatagagaggtagtgatctgtctagcgttgctcaacagcttgaccttcttggagtcctccatgtctgaggcaaccttcttcacagtcttcttggaatgcttctttgccttcttcaccagccggatgtatgacaggatcttggcttgaacaactgcatcatctccttttctgagagacacttgcagatcttggatgatggacttcaactcggtgaagacctcgttcatagcgttgcagagatctagtagctcaagggagcattccatctctctgtcaaacaacttactttgctgtgatgagcaaacttggttgctaagtaggcacatgatct

SEQ ID NO: 25473 - DNA, 527 bp, Oryza sativa
acagcgcaagtggggctacgaggaacagcaggatcggctccgccagctgcacggccggacgccggcacttgttgtggactccgccgccgatccgtctatgctgggccttactactgactccgtacatttcacggtaagataccacgttgtgccgctactagattagaatacataaaagggggggtggatggtacacaatctatgaagttatgtacgatttgttatatatccattggcgtaacaggctcacacaaattactagatccgcattggcactgataatgattctggacgtcctccactcgttctaaccttgagaaagcccggactcctctcacctgctgctttcttctcataaagaacaagtgctgaaattttgaaaacgaaatgtgtgacacctctaaaatctaaataattgatcgaaaaaagttttgaaaagctagagctagcaagctgttagccgatatatctttgatggtctatggctgcagaatttgtgggcttgtgctacgcatcccacctactca

SEQ ID NO: 25474 - DNA, 15263 bp, Oryza sativa
ttgagcgagatttttaaagatgtgactgaaatttagcaacccacaaatctcaaactattttgcatgtgctatattactacttcctccatccacaaaagttagatatttcacatttgagcttttccaaataagttgttcctatttgtagtttttatgcatccaagacttaaatgaagtgataaattaaatgtttgattagaattcaatgagtcatctaaatactcattggtggcatgtttacattcactccttgattttgtaatatgcaagatgatttaatctctccttggtcttggtgactcctagatgatttaatctctcctcggtcttggtgacaaaagtaatatgtataacttctgtggatggggggagtattataatggtcaattcaatttggaaagaagaagaatgtacacatgtgctactgtacgtgcagtgggcaattggctggcaaaattggagtactgcatccaatgattgcagagtctacgtatgtgttagccaccatagggagatgctgggtctgagggagacgttgtatcaaagaaagaagatgttgctgatcgagctgaagacagggcaggagaggagctaagacgcggcaggagggaaaaacacaataatttaaagtattatgggtcgacatgggtcgtgtaataatacacaattatggatagatcacgacctatctgatgagaaaaaaatatataaatagtaggtaatgtataagagcatccacaatgtgatatttggaggggttctatgggagagagagagagagaagaataagtctaacctacatattgtgaaactttttcctaccatttttaatatagaaccagtcaacaatcataatatctggctatagagaagagagaatatatgggcccgcctctcagaggcctttacatccaccatgaacctattgccatttatagcgcgtcctacctataaaacatttactagttctatacattgcaagaatttttgaagggtgctaccctcactgggtgtctatccataagatcttataatggattaaacatcggtcatgctctaaaacttaatataaggggaaaaaaaatgacagactcagccttgtatcttgaacctaacgacggccgtgctctaacttgatccggattgatttgcccatagctacaactgaaatacatcatgcctgtcgcaccattccaatgcgttcttgactacttatcaataatgtattaaagctacatcgcttcaaattaatcctctcgattttggctgcaaaaattaagtaccaaggattggaagttgtgttcatagagacatgaacttccgcgaaacgcccaggggtcttctgttgggctagatgacttgggtacgaagtctcaccccttctaatttttgatattagttccttccacaatatttgcgtcttttatgaacttccacgaaaaggtgacttgcctcgatccgattatgtcatgagctcggggagaagctagagaatagaggagatactagagaaaccaggctatatatggcaccaagcaagtaggtaaaatcacggagaacgagtagaaaagaggttgatctcgatctgctcctgcgcaagatggaggaagcggaacaagcgagagctaggctgaaattaaacaagtggagatgtgcatgcgctaggccggcagccattgactagaatttataattaggactaatccgttcaattctgaatcaaatcaaatcgtgagcacgcaacaagtcagtgtcaacacgtcaaactaggcaacgaccgtatacggccagaattgtcagatactacaaatcatgtccggctagtaactcgatttcagcctctctcacagtaactcgatttcgatggatatatataggttagcagattgctgtgagctaaaacaacctaacagcttaattagttaattagcagctgccactagtttatttttatttatttttaatggttcatcaaagtatatataaacattggttgatcgaatgtgatcgaatcaagcgtggacgcaagcctacctaacatttcacaaggtagccaacaaaaatattcctattccaattcttaattcatttcgaatggcaattgccaaccactaaagctgcatgcaggtccggtgcaaatgcactgcacttgtttgttctctccctctctctgtctcaatataatagatagagatcccagaccttctaccataaatagatatactatacatagacaaaacttacaaaaatcgttagtttccaaaaatcttaactgagaaacaacaaaacaaaagaaaggttttattttcaaaaaaaatgtagaaaagtaagctttttgaatcttcttttaccatgcttcaccaatccataaaaccgcaccgtggtgatcttaaggagcagcctgaactcgaacaacccttaattagcagagttccatccctattccctaataacattttcttttatttatgataaactaattaaatttgtcattacatatatattgtatttcagtgttcaaggactaggacctgctagcttcctctacaaaagtattgggaaaaatgtgagcctattcatattttccattcaaatagtgtaaatgattttttatttaatttatgcccaaatttagtaggcatctaaatttttctctctgttttatttatagctaggtttgtttccatatgtccgccttcttgttcatagccacagtagatagctagcattggaagaagatcatccattgctcattgcttcatctctctccttgcggctgatgatggatggcatactactagaaaaacgaatttctacaatgaaacacatagattttcacaggcagatcttattttcgactacgattgcccacctgtgtagttgtacgttgtgtggagaggagtccaatggccgaccgcctgggaatatcctattcccatttttgcaggcagatggcttaaaagggctgcctgcaataatacccttatttttgcaggtgggcctcttaagccatccggtgaaatttggttgtggcatttaaatagacgcaaaagaaaactgaaacaccagttttttctaagtccccaactccctcccttttcctctcttgagctcctctttcctcacccgaacggcagcaacggcggggctcggtagtgttggaagggaagggagcagcggcggtgctcccccggccgtggcacacggttctccgacgagggtggtggatcccgccatgaaggaggcggaggcggcggatctggcaacgactcgtcttggcctcctcctcatcatggtggcaagggcgcaccctcctcgcgctgtttgttgtcatcttcctcgtggtggtcttggtgacaatgttggcgctggaggtggtggtagaagcggcgtccatggaaagccggcttctcgatggcgacggcggcatcaatcctccctgcaatgatgaccaccaccaccacgtccaactgctgtttcgttttggctacctgcaaaaatcgttgttctagtagtggtagtactgatgagaagtagatagcatataagatatggaggaaattaacacattattattggtagtattgacattattggagtagtgatcaggatgatgcatgcatggaaaatcaaaacaagaataacactatagaattcccccccccatatcattagttttatctgtcgacgagtttcaaaataccatcacagatataccggcacaatttactctttatttgtctactatgtaaaactaataaaccagaatgaggattgagaaaacaagagatatatgattggttcatatggatggcaacatggcatgttgtgttttcttctgctatcaagtttatctagtagctagccgtcaacatcaaactcgtgtcgtctatcgtaacatttgatttatatatgtctaattgattcaataattaatatttgaggcatatgggaggtttttggatatcaggtgtagagattttgaattttcttggaacagcttgaatttgattattttaaggttttggatgcccttttatacccgatgctgaatcgtcgacctaatatcttgctcatgcacatgtgttatttttgaatttaattgagagggattatttacaggtagtatatatgctgtactttacagtcagcctcgtgacaagaattttgtttttcttcgtgctgttgacaatacacggctttgtcctttagtcgccattgtgtaattcctctctgtggatagttgctgtttcctatacatcgtaatccactaaattaaactttgctactttggaatttctggggagatgaaatgatcagctaattatatatcacatgtgagcacatctgcatatacacacaagtatgtatctgttcctgatttttctatatgtttgtttttgtcctgtacttttgatctcgaatacacatcacatgcaattatgcatgcctcgtagaggaattactattcaacagcgtagtattttattgtgttatatagggtctgttcagaacctagggttcctaacccctctccatcgtattccacgtgcatgcttttcaaattgccataaacagtgcgtttttttcaaaaagtttctatacgaaagttgtttaaaaaatcatattaatctattttttttataaaaatagctaatacttaattaatcacgcgctaatagactgttccgttttccgcatgggaaccgccagcagcgaacacagccatagcctgctgccaagcacttgacaagcaaagtacatgtgacaaagaatgtcatgaaactcttggagatatatatgcatgccaaaactaatcttttagcacaaagatattttttctcaatttgcatgaggagcatataatattaatatatgcttttcgtatttaatttttcacttagtttcgctatatgcatgcgccgaagaaaaaaaatctacacgcgtgccatatgttcatgtatgtacctctatgcacaaccgccgcctgatataattgtttttggactttaaattttagataacattttttttatttaactaagccaattacatatagtatatattatgtttagataaatggatatatatatctttatcccgtttacatatgtgatgagcaatgatcacatggaacttggtcgtggatatatgtacctagctagctgtagatgcatgctctgtgccgcaacattcagggcctgatgattgatgagccgctctacagcggattcagtgtttgttatcacgtcacacatgcccctgacagcagccactgcaagtataattaatcaggcaagcaaaacatccagccaaaaaggctccccactcacaacagctagcgcttcaaatttgattgatcaatcgtttttttaagccagtaattggagtagtccgcgccccgtacaattatgaggctagcagtcctagcacccgcataaaattataaaagaattacacataattttaaaatgtattaaaaaatatctcgttgtcttgggaaatcgtactattttagagttcattgtctcgtccttcccttgttataattttagaagtcctaataaacatcgtcaccttacttctacgccccgaccgctggctattgctaattctctttaccgctgggaactataatttgaactctttttaactctattttttcttttctttgattaatgtgagaatttatagtccccatcgttcacttaatgtcgctttttaatgatgttttaataatacaatagattgaaaagcgttttacccctccgaaagcgacacacacacacatatatagattgagcgagaaatctcaagatattaggccacgtttggagagattgagattctaggaagaaactaatgagtagccttggctagtgagaatacgaagcaaactgtgtttttaatcttttacttctatttagtagttaattttctgaattctataactacagagaatccctagtattggagtgagaatctaattaaactatttaagagagctcaagatttaaaagaaattgccgctactaaaagcttccctaaacgtacacggtcacgtgtacatgtacatctgattgggaattggagatatagatagatgatagatccatatataccagggaacatgagctagtataggatggagaggtcggggtggagtggaagggacgagagcatctgtctatgtcatggtgggcccatagagggcgccacgtgggccccacccttgtgccggcgccggaggagagctagctagctcgctcgctcataaccaaccacccaactcgagtcgatcgattactcgatccacaccatatcgatctccctcctctcctctcgctcgctcgctctctcgtcttcttcctctcttcttctccagccacaggcgccatatagtagcatatgctcctaagctagcttgttataccagttacgtcgtcgtcgtcgtcatcatgtgctatagctagctccaaacaaaacttggagaatttggagcgtacgtgtactagctagtatagattgcagcagctagctagcccagcagcaagaagacgaggagatagctgcagtctcgtttttggcttttcgaatttattataaccccggttcgtgtttgctagctctctatatatttctatctccatcgccttaattagagttttctcctcttccttttttcaacaaggagcctagcttgttttctttaacttgtttgttcggttctcgatctccatctcagatcgatgacatgtgatttattttttttggttttttctcctgcatgtgttgctgttcttcttctacctcggtctccatgccttatctcatgttattgaccagtctccttttttcaagctagctagtttctagctgccttgcttgtgagtatgtgcaacgtacgattgcatgtttttttttttggaactttggattaattagcttgtgaattaattcctctcttattaattccttgattaaattcccctctcgttttcgtttccttccccctttttgatttaatttgttgctttgttattagagaggatctgatcgatcagctgcaggtcagtcagtttgtctgtcctatggctgcacacagtacagatccatccaccatcttccatgctagctagcttcatccacgcatgtaattacctcttggatctctgcttaattttgtcttgattaattttcaggtcgtgcaaatcgaagaggattggaagtcagctggtagactagctagcgtccaagatacacatactactatcgaagagtgtgacttaattggattggattaattccatgcctatcttcttcttcagccacaatttaacagaacaagacaattagtctatcagtggtttgagctgattaactatcatcagagatagagatggcagccgcctcgtctgcacactacttcggtctcggcgagccgcagatgcagcagcagcagcagcagcctcccctgcaaaacaacgcggctgctccggtcgcggccacgccgccgcccaagaagaagaggaatcagcccgggaatccaagcaagtatctcatttaatataattcctctgaatgaatttcgcagatgatcaattaattcaatgatgaattgataatgtacgtagatcctgatgcggaggtggtggcgctgtcgccgcacacgctgctggcgacgaacaggtttcgtgtgcgaggtgtgcaacaaggggttccagagggagcagaacctgcagctgcaccggcgagggcacaacctgccatggaagctgaagcagaagaaccccaaggagacgcggcggcgggtgtacctgtgcccggagccgtcctgcgtccaccacgacccgtcgcgagccctcggcgacctcaccggcatcaagaagcactactcccgcaagcacggcgagaagaagtggaagtgcgacaagtgcaacaagcgctacgccgtccagtccgactggaaggctcactccaagacctgcggcacccgcgagtaccgctgcgactgcggcaccctcttctccaggtactctttatgtactactccctccgtctcaaaatataagtcgtcatcttcgtctttctattgcgaatcatactcccttccgtatgtcccagtagcaacttctggctatgcatctggtatatgtgcatgactgtgccagatgtataattaaaaagtttcatatttgagaacggagataatatctcttaaattctttgttttttttttgtttgtgatgtccctctgtggtctcaacagcaacttctggttatgcgtcttgtgtcagatgtatagctagaagttaccgtatatattttgagatggaggtgtagtatgtcttgaattattagatattccattagtttgcaagatgtggcaacctagagaattgtttggatttgggatgattccttttcatgtacttttatatattttgttcatcatatgattgagtcatgatgaacacactcatgaggaggaggtccgggcactgaaaggcacgagatgaatagctttggtagatactaggatagatggagatgatggtgatttgattgaagcagatggctctagctagctagctaggtcgccggccggcccgggtgagtactactacgtgttagggttagggttgtcaccactcgcgcatgctgcagtgaagaacagtaggtagtaacagtgtgactggccttgtacggttgtgtctctcgagtctttcttgtttggaaatttgattttgattccctttgcttactctcctcttacaacaaattaacttttcccattgatcattccatgagagagagtatataggattagtagattagctggtcacacgtgaactgctcttgtccggagggggacacaaaggcaggcaggcaggccagctgagagaggccactgcagatcatgccgccatggtcatcttcttcctcctcctcttgaaaaggttcagaaagaaaaacaaaagccagtcatctttttcgactcggaatccgcaccatcttgatacaagtatccttctctctctgtctctctctcatcgtccctacgtgttcacgtgatgacaagagcccttgctagctgcaactgtagtactagtactctctgtatactcgtactacagcaatgtaagcaaggaccatggccatggtcatggcttgttctcttgtgacggatgggatgcatcagtactactctctcttgcattgcattgcatgcgatcgatgcatggagccatgcatacagactacagagacgacagctctattcttttcatggcgactgtgctagctactagcacgagcagctgcgttagcttaggtggtgtttatatctagggacttaattttagtctctgtatttagacactaatttagagtattaaatatatactacctacaaaactaattacataaatgaaagctaatttgcaagacaaattttttaagcctaattaatccataattagataatgtttactgtagcatcacatagtctaatcatagattaattaggctcaatagattcatctcgcgaattagtccaagattatggatgagttttattaatagtctacgtttaatatttataattaattttcaaacatccgatgtgatagagacttaaagttttagtcctattggccttactattcagcctgaaccacttgttgttgcattcggatcgatcgacatttgatgatgccactcggcgacctgatcgatctgctcatacatgcatgtgtaattagtaaccatttcatgtgtatacacacacacacacacatatgcagatatgctcttgcatccccatctgaaaattggaaccttgcttgcaattgtgtatgaatgttttggagagagggtacagtacagttacaccatgcatcttaatttgggtattgttgcattgacattctttctttccctttgttttgccttcccatttctggctttttgatcatgggctacagtcgcagtttgcacaatctgccgcatatatttggatatattggtacaaagacaatcaagcatgcatgtactactagtgaaattaagccaatgttttttctgtccacaaataaattccatgttgacatgcatgcacattagtatggtttttaattagtaaatagatatataattttcaacaatttttttgttgctatatatgttagcaaaggatatttgatggtaccatatatatgtttatgtaattttgtgtataagttagatagtgcttaaattgggggaaaacttcgtgtgctattaaacagcagtatgatatatgtctcgaaagctatatgctcaatttagcattgcaatggatcttgatattctagtttgattaattgctcttttagacatttcttcatttattaatttggcgaactgtttttttctcataaccgatggtattattgaatttaaaaaaaaaaagataactggagtgacaagttgaacgtatatattgatctgtaaaacaaatcataatgttcacattttctgttttcacatcaacttaattaattaaaagataaatgttgtgctggctgcacaacgaaacaactatatacaagatgagtgaattaaatgacaagtgaataaaagaagaaagtgaatttgaggtgaacatgtgaatgcacatataccaacctgctacccttcaaattacttattgttttagcttgatctcctaagtcaaatatgtttatcttaatttggccattggtttctagaaaaactgtacttttcaaggtatattatgaagatatttttcaaggtaaatctgaaaacatgcataaatcacactgatgctaaactatacaactgtttaaaaattgatggtcaaatatatggatgtttgagaccgaggataaagatagaacggcaagtaattaatttaaaaccaatcaagtagtgtatttcttcccaacttcattgtgtatagcatcatgatcagtatcattattatctctagctaggagtaaattgtatactccctccgtccctaaatgtttgacgccgttgacttttttaaacatatttaacagttcgtcttattcaaaaaatttaagtaattattatttttttcctatcatttgattcattgttgaatatacttttatgtatatatatagttctacgtattttacaaaagtttttaaataagacgaacaatcaaatatgtttaaaaatattaacgacatcaaatatttaagaacagagggagtatatatcttgcttataaagattaataattaagtggcacatcatattgatcaccgtgaaaaaaaaaactttgtaccacatgcaggagggacagcttcatcacccaccgcgccttctgcgacgcgctggcgcaggagagcggcaggattatgccacccatgggcgccgccctgtacgccgccgccggcgccggcatggccatcggcggcctcaccggcatggccgcctcccaccagctccaaccgttccaggaccactcctccgccatcaccaccgccgccaacgccgccgcgcagttcgaccacctcatggccacgtcgtccgccgcggccggctcccctgcgttccgcgccgcgcagccgacgtcgtcgtcctcctcgccgttctacctcggcggcggcggcgacgacggacaggcccacacctcgctgctccacggcaagccggcgttccacggcctaatgcagctgccggagcagcaggggagcaatggcggcggcctccttaacctgagctacttctccggcgggaacggcggccaccaccaccaccaccaggagggacgactcgtcttcccggatcagttcaacggcgtcgccgccgggaacggcgcccgcgccggcagcggcgagcacggcaacagcggtaacaacgccgactcggggagcatcttctccgggaacatgatgggcggcggcggcggcttctcgtccttgtacagctcgtccgaccagaccgtcccgccgccgcagatgtcggcgacggcgcttctccagaaggccgcacagatgggcgcgacgacgagcagcggcggcgccggcagcgtgaactcgctactcagaggtctcggaagcggcggcggcggcggcgctctgaacggtaagcccgccggagcagccgggttcatcatgtccggggagagctcgtcgaggagcactgcttctcagacggcggagaacgagagccagctccgggagctgatgatgaacacgctctcggcgaccgggggcggcaccggcgccggaacggtgttcgtcggcggcggcttccccggcgtggacgacggcaagctgagcacgagggacttcctcggcgtgagcggcggcgcgccggggcttcaactgcggcacggcggcgccgccgggatgggcatggccggctcactggaccaagagatgaagtaattaattaattattatattaattaaccaccagattattagggttcatcgatgcatcatgcaagcatggaactagctaatcaatcgatcgatcgatgagatgatcaagttaatggtggattaatgtggtgttttgattatttaatttaggtggatcaactggtgataatgcatgttaattgtcaatgactgatcagtcatgcatgcatgcagtgtagcttcttctcgttctagagagatgatggatgaagctagccacgcaagccatcaaaaataacaccgaattaaggccgaaccaaatccaatttgatgttcaatttgtatgtgatgtggctacaaaatttaattgaatctggctgggatttaatttgtacatttactactccgtattttggtaagtggtgacaattgtcacactgaattagtgatcttgataacgcatatcaaattggtgccagatatatactgcaattttggctgggtctgaacataacatttgtgaaaatcttacaacaattaatggctcaaatgatagaaatataatgtggcacgtgaacacacacgcacactgcacacatatagtcacacacaagagtgtattgctatgtgatactatgtgcgtgaaaattttggttgtgtattcaagttatgcaaatgccgagaatgttttcaatatggttttatcactgatattaattgattgagttcaataaagtttttcttatcttaaaaaacatgcacgcaattttgtacagtttagctctgccctctctacagcgggctgctcctgttgattgtggaaggcccaattaagtagttgggccattggttggtttatagtgggacatgggctattatagaagcccattatgtaaaggactgcagcatagatgggccggtggacgtcgtactaatcaaatttatgctttccacacgtatctggttcaatagaatagggctagccattttctagtaaaaaaatagacaaatttcttatatgccactgattatacttaacttaatacttcctccatttcacaatgtaatactttctaaaattgctcacatacatatagatgttaataaatctagatatatgtgtgtatagattcattaacttctatataaatatgagaaatgctagaaagtcttgtaatctgcaacggagggagtagttttttcagcactaacttaatagttattgttacattttctctttaactagtcctcgttagttagttctattctttatgctgtacgaggactacataatttctacttttaaccacaatgcatatgtaattgtgttaaaacgtttattattttaattaaactagcaaaatatatgtgtgttgcgttaggaaacaataggcaaataaaagataaagaacaatagatcaatcacagaagacacgagatttaacgtgaaaaaccttcccaaagcaggagagaaaaaaccataggtgccagccagcaaattaatatcttcactgtatcggggtgaggttacaacgccgaacgacaacttacaagaagtatatatgaatgtgaaaccctaaaaggataacgatccgtactcaaaacatttctttttgtattatatgcactcgctcgtgttcatatgacttgaataatttatgtacaaaatgatatcttctcaataagtggaaatgctacgtgctacaacgcacaaaaaggtctactatcgccaggtcaatctttcggaactaatttagagaaagaaaaaaaaagcttagttataatatatatccaaaaaaaagcttagttataatatatatccacaggtagtgatgaaattggttcatatagtttcggactgtccagacacttgcgtggaaatagactgtgttgatttatggataacttcagatagtatcagagacgaatatggatatagtaaggctattatccgtcggaaacggaaaacggtcaagctatacggataattctgaaaaacaaaagcatagcaccaatttagattatttctaatcgttacactacagttaaaagaggaaatgatatttctttttccaatacatatcaccaatttagattatatcttatcgttttcaaaattctgatgctctgagaaatttcggcagcttacatttttaccagctaacctaaatcagataagctaaatccgggttagacaaaacccaggatttttttttggtaaaataagattaaactttaaaatcatactgcatacctaggcatagtacagctattactagcgatacatgtgaggctggttaactagctaaagactggccttagctgccagaaggaccttccattcttaggtagtcatacatcagtccctgaaatggactctggttcctgggctgcttcaggtagatggtgttcatcccttgaacaagccaagctccactcacatcgatgttgaacagccagtacagcgcatggatcccgtgcctcgcaatcgtgttgtctttcccaatcaatccagttgtgaagtgaggagcagttctgtcctgattgttgaaacgaacctgaaaatacaagcattttgtgtatttagtatcaacttcttgaatgatgataacaaataatgaaataggaatggacattggccaatctgagtatttttgtgtttttttttctgaaataacctgcaactcggcatttgcggatgatgcaagagccactctgaatttgtatgtgctgttaggactgacactgtcaagattgaactttatttgccatgtggttggctggtaggtgctctgatcagttcttctgcagtggacacagatgttagaagcacatcatgtaactctgcgcaatcagttg

SEQ ID NO: 25475 - DNA, 1652 bp, Oryza sativa
cggaaaaatccggaggatatttagggcacaaagaatattacaaaatattctcggccaatgatttttaaaggaaaattttaattctcccaataatttcacttgattgaattgatttaacttttatttaatttctaggaaatggattattaaatgatttttaatcccgaacgaaaatcggggcgttacagtgggggtaggagaaccgcgtccaatttattcgtattactaattcttttcatcttttatttccttttccacgagttgcggatagttgttggtatttcttaacgacattactagaaatataatttccagcaatggtgcagaaatactcctggtatatatggttacagagttcatccacaagcgcacggatataccattgtagcatttcacccgagagtattccaagggtatcgtatttgtttaatcccgtgggaagtatttacacccaaatttggcacctagggataaaatagggaaaattaccaaagtttggaagtctgccggttttcctctgattgggccggtctgactgtcgtatgttggccggtcagaccgccgaatgagggccgatcagaccggtggtgtgtggccggtctgaccggcagagtccgagtccggttctgttttcatcgggtctcgggtttccttgctcgggaaggcatgtttcgggtttcttttggattctatcccaagttggatgtggaggagggcctgtagagagcaagaccaacccttatataagggggtaaggccggttcattgtaaaattcaatctacaatcaatcaatcgaatcgttttccatattgcttttagttttctcttagtttgtccatctttgtcgatttgcgccgtaaatcgtccgccgccgctgcgagagtgtgacacctctttgtaggtttgtcctgaaaaccttccgttttgcccacgagacgggtagttatctagaatcggctccgctagccggtttagttatcaaaacccatcttggtttagcttttgctagattgaggtggttggcgactctaggatcactgcaaggcgtttaggtgctacgattgtgcttgtcaacttgtcacaaaaagttgccaacacgatttttggtgattccgcttgggaaatctgctcaaaggcatctcaacttcgacgtcgtcatgacaaagcttccatcaaccaaggcagaggtggaaccgggcaatgtgataccagtcgcattggaggagcttgacgagggagcacgcaaagctttgaatgaacatcttaaggcgtatactcaagatctattgacgaaggcgtgcgctaggacccgtcaaggtgtggttttcaagccgggatcattgcctaaacctacttttgacatggtaagtgctgaagagttatcacaatctatccaacaacaaattgcacattcaatagattcatctatggttactttaaataataaattagatgcatctattgaaactcgttgtgaagaattcatgaggactacattcggctctctcatggccgattttatgttcaaagataaagcctctaccagtgctagccaagcccctatagatcaaataagtagtaaaactgatggggcgaagacgcaacaaacccgcgaggggtagtcggtgcatacagccggtctgaccgggcc

SEQ ID NO: 25476 - DNA, 8120 bp, Oryza sativa
cctctggacgccggtcagaccgggtcttggaccaggcagaccgacgcaattattcctatacagggggtagatcctatttcaaataacgggtatttgtaccattttagaaccattggtccccctgtatcacacggtgttggttggttcccaggttcccccacaggttcccaatggctaataatgatcctagtaggggatatccccccgatactaggcatggccaatataattatattgcgccacaacctcaacctattaggccaccaaacccaccaccaaaccaacataggcctgataatatagaggaattgattagtggaatcattagggataaattcgggattgaagctaggaatcgtgctaaggtttaccaaaagccgtatcctgattactatgacgatgtaccatatcctcgtagttatagggttcccgaatttaccaaatttagtggtgaggatagtaggaccatatgggaacatgtaggataattcttagcgcaatgtggagaggctagtagttccgatacttttaaattgcgcttgttttctttatctttgtccggtattgcttttacatggtttacttctttaccggccaattctattcatacttgggctcaattagaacaaagattccatgattatttctatactggtgaaactgagcttaggttatctgatttaacatcggttaaataaaagtataatgaatctgtcatagattatgttaagaggttcagggatgttagaaaccgatgttatagcttgaatataactgatagggatttggctgatcttgcttttaatggtttaattgctcctattaaagaaagattagatggccaacaatttcttgatgttagtcaacttatgcaaatggttctggctcaggaaagccgggttaaggatagtaagaaatttgttagaccatatgagaagaagcctaatgttaatttgattgattaccccgaggctagtgatagtgatggtgagggtgatcatgatatgcatgttgttgagtggtcatggactaacaaaaataaggcttttgtttgttctaatttaatgccgactcctcgtaaagatcggcaaagtgaggttaagtatagttttgatgtggccaaatgtgataagattttttattatcttttgcaagaaaaaaaaattagattacctaaaggccatatcatatcatctcaagaagagttgaagcgtcgagcttattgtaaatggcatgattcttattctcattctactaatgattgcaatgtgtttcgacgacaggttcaatcggccatagatgaaggacgattgaagtttacccatggttccaagatgaagcttgatcatgatccttttccggtaaatacaattaatttcaatgataagaaggtgttgattcggccggagcaagccgaatctactgtcacgcccaaaaatttagcccaaatttccaaactattttgtgtattaaatccctgtacaggaccagccagggtacacaaaacgacaagtaatatacagctctaaatgtaaataaagcgtaaaataattatagaagaggaacttagtcctcacaccgaaacgaaagcagtagcagcggaaaaaggcgatcctaacggggcttcagcttcactctacaggcaaaactcaactggggtctgagccttggtcctctaactccgtcttcatcttagaagcactacacttctgaaaaggggaaacaatagcaaggctgagtacaaccaccgtactcagcaagccacaccaataatgcagacgtgcaaggggatacaaggacggtttgtggctatttgcataaaggcggttgtaaaacatttattgcgcaaaacagtaaaacaattggttaattaaggtaacattgaatctccacttatcggcttcaaagttctagaatcagccgatgggagtcaagtcgccacgatatcatgttcttggtggagtcggatcaatcaaaggaagcttatctagaagagtctgagatcaagaaggatgcgacatgacagtttatctattaattaggcatagtttgttagtttccttttatctttaagaaagtttgtttagtgtccgatagggactttaatcttttcctttttagtttctttcttgtccgacaaggactagtatctccctatgggtataaatatgtacacccggggtctatgtaatttatcaatctatcgatcaacaatactctcggcgcatcgccaccctctttatcgaggtttttacttatcttccggcgggatttgggcacctgacgcggggctgcatcggctttcgatctccggcgaaggggtaagtcctatgttccgtcgggccctgatgaatctgtcggctacgttggtgttgttcaaggctgcatcgcttcgatctcttggatcgctctggtttggttgacatatttgcctacctgatatctcaattctatctctagttgcattgtgtttagagatgcatcggtttagttggaactgtctcggttaggtctgatcttctatcttggccgatatatctctataatcgcaatgctgttataaatagatttgttatatccttcacattagacagatctatcggctcatcgagtattagattatcatatacaatctcatctcatgctgcatcggttaggttcgacctactagattgttgttgataatataagtcttgtgaagccgataggttcatactaatgttttatcggggtgctagccgataagttatctggatgttgcatcagctcataaggattacatatatatatataagttggatttagccgattgcaacaaaggtttcactgtttaatctaatatgtggattttatggcatcggacctccagccgatatacgctttaaccttcggatcagtgcttattctatcatatcgttgctagccgattggtttctactggactatattattgttatattatattatcatcagccgattgcctctatatcattatctacattggacatatagccgattgcttaaaccctatcgctatcggctggtatcggcatcggctattatcggctatcggctggaactactccatcggcttgtcagccgatcggctgttttgatctactatttgcatatcttgtcagtggcaggatcaaactgactggcacgcacgcatctcatcatatttggacctgcactggagctaagcagatctcccaggccggtgtgttcgattttttcgtcaacagctattcgaatagttttactttggccagaagtgcacaactgtacccacaagacacaatccaccggcatgtcaccgtgcccggccggacacgtcaccatgtcgagtgattgtgacaagacccttcatataaccccctctgaccaaacacaccacacctcaggtttcacccccgcccccagcaggcagcgggcagtcccctctcgtgcctaggtgaatccggaagcgacaaaggccgtcgcagggcccatcccgctccatcacgcccacccttgcctggatgcgtcagctagagaaaagctatactttaagtcaggcagttacccattcccaattgtggcaagcgctgtaagtcttccagtgcatcccgcgaaccggtccttaattgccatgggtgcgactagcaaaaccatgcacccacgacccaccattcagtcgcattttagttggataattacgaccaatggaacatggtctgatgtctcgagcacgcagctcgccatgatactaaaaagttctaatactgcaattatctcatcaactgagctagtagtaattaagcatggctaagcataaatgattctagctaggtcaacataagtaacacaagctagtcgatttatcacccaaggttgacaaaggacagatatgaagtaaacatggcacacgcaagcagataggtaaaccatgatcccatttaattagcaaaacatgcatatttatttgcaaacgggaaaacatttgtaaagtaggatcaaaatgctcaaggggaatgtgtgacttgccttgcttcttcacttttatcttctgaactcttttcctcgcgaccgcggattttcgaaacgacggattatacacgctagcacggaaattgaggaaaaaccctaataaaaaccaagtaaatagtacatagaaagcaaacaaacatgtagatctcaattttagatgaattttacaagttgaatggcccaatttggagttcgaatgaattagatatggattttagaagttttgagccatttaaatgaatttctagaatttattgatttattgcgcaattattaattattttctcaaaggaaatggactctgctgacgcagcaaggggtgaggcgtggaccgcgtccacaaaggggcgggccccacacgtcagcggcacggcctaccaggtccacgcgggcacacacccgacggcccatatcgaccgagaccgatcggacggtcgggtggcgcggctggcgcacgagcgtggcaaagggccggctcggctgagcgacggcgcggcaaccggcggcgacggccggcgacgcaaggagcagcggtgcacagcacgggaggcggccagcgaaggggaaaggaggaagaagggtgggggagttctcaccgagcgccacacggcggaaggaggcggccggcggcgggatggcaacgggaggtagcgacggtggagctcggggtagagggagacgacgatgctccggcgacgagcggagctcgggaagaggcggacgagcggcagctgcaccataggatgggaggggaggtgttagggaggacggggcgacgacatggccggccggagaggaaaagaagggaggaagggctcaccaacgcacgggatagcggacgtcctgtgagttttcagcgatgggaagaggtggccgaggttctcctcgtccttgcggagccgagggaggcgacggcgtgggtcggcgacgaccggagcagagggacaacacggctggagtcggccaatggtggcggtggctcgggtcgacggtggaggggcggttgcggtggtgatttggggaaacgaagctgaggccggtgtgcagcacctcgcggcgaagccgtcggtggcagtggcgcagcgcggcgacgactagggcggtggtggcgagcggctggaggcggtgaaagaggtggcggctttgggtgcacggtgggaacggtgtttcggggtggaagggggaaaaaggagtggcggccgggggttccacgcggtgcggcgaacgcggtggaggcggaggcgcggcgtgaggtggccaggagcggccacatggggcggccggagcacggcgacgagcggcggagctcggactcgcgtcgcgagcgcgatttagggcacggggaagctcgggagttgggggaaacgagagaggggaggctggggagtgtttttataggggaggggaggtcggaccgagccaaggagaggcggagacagggcggcaaccgccggtggcgtgggcggcatcgtggggtgtgggcggcggttttggaggggagaggtggggatgagaaggacgtggggccacggggtcccacggccggcgggctcgcgcgcggggtggaggaggagggcggaaatggcggcgtcatggggtggctcgggcggccatgggggcggttggagccggaggaaggggatgtcaggtggggcctcgggtcccacctgtcggagatagagagggaggggaaaacgggagagggaggacaaacggacttgcgaaggggagcgagctgggccgacggcccgagagggggaagaaggggaaggggagaggggcaagcgggccgaggaggggaaaggagggattgggccgggtcagcccaaaaggaagaagagggaattaaatttgtttttcttttttatttaattgttaattgaactttgtattattataattacttcttgagctctgaaaattcatggaaaaatccggagggtatactagggcacaaagaatattacaaaatattctcagctaatgattttttaaagaaaatttttaattccctcactatttcacttgattaaattgctttaacttttatttaatttctagaaaatgcattattaattgatttttaatcccgaaagaaaatcggtgcgttacatctactaaggggaaatgagtggtcattggggagactaggccaaagatgatggtgccaaagaatccggaggttggcgtgtggaaggagaataggaatgaagcttcgagttctaaagctcctaagaagactaaggtgaccttcgatatgcttttggacaagtatgagaagcaaggtggtgagaaagctggcaataaagggaaaagaccaagatcacctcctagggagtgatttggtcattcaccaagacggtcggaatcaccaacatatcatcgtcctcaagacatgtcatgggggccttatccaatgccgtcgccgggttatccttttccttactacatgccatggggggcaacaccgccaatgttcaatcatatgcctccaatgcaatacaaccaaggatggggaggaccaaggaggccggctcgtgagcgcttgtcttcaccaaacaatagccggttttatgctaagaaccgggccaatgaagaaaagagggaaggaaagcactgcacttgtttgttctctccctctctctgtctcaatataatagatagagaacccagaccttctaccataaatagatatactatacatagacaaaacttacaaaaatcgttagttttcaaatatcttaactaagaaacaacaaaacaaaacaaaggtattttttttcaaaaaaaatgtagaaaagtaagctttttgaatcttcttttaccatgcttcgccaatccataaaaccgcaccgagatgatcttaaggagcagcctgaactcgaacaacccttaattagcagagttccatccctaataacattttcttttatttatgataaactaattaaatttgtcattacataatgtattttagtgttcaaggactaggacctgctagcttcctctacaaaagtattgggaaaaatgtgatcctattcatattttccattcaaagagtgtaaatgatttttttatttaatttatgcccaaatttagtaggcatctttttctccctgttttttttatagctaggtttgtttccatatgtctgccttcttgttcatagccacagtagatagctagcattgcaagaagatcagccattgctcattgcttcatctctctctccttgcggctgatgatgggtggcatactactagaaaaacgattttctacaatgaacacatatattttcacaggaagatcttattttcgactatgattgcctggctgtgtagttgttgtgtggagaggagtccaatggccgaccgcctgggaatatcctattcccatttttgcaagcagatggcttaaaagggccgcctgcaataatacccttatttttgcaggcgggcctcttaagccatatggtgaaatttggttgtggcatttaaatagacgcaaaaggaaactgaaacaccagttttttctaagtccctaactccctcccttttcctctctcaagctcctctttcctcacccgaacggcagcaacggcggggctcggtagtgttggcggggaagggagcagcggtggtgctcccccggccgtggcgcacggttctccgacgagggtggtggatctagcaatgagggcggcggaggcggcggatctggcgatggttcgtcttggcctcctcctcgtcatggtggcaagggcgcaccctcctcgcgctgtttgtggtcgtcttcctcgtggtggtcttggtgacaatgttggcactggaggtggtggtagaagcggcgtccatggaaagccggcttccggatcggcttctcggtggcaatggcggcatcaatcctccctgcaatgatgaccaccaccaccacgtccaactgctgtttcgttttggctacatgcaaaaatcgttgttctagtagtggcagtactgatgagaagtagagagtatagaagatatggaggaaattatacattggcagtttgacattattggagtagtgatcgggatgatgcatgcatggaaaat

SEQ ID NO: 25477 - DNA, 8144 bp, Oryza sativa
tccccctccccccccccccccgccccgtatcattagttttatccgtcaacgagtttgaaaataccatcacagatataccgggacaatttactctttatttgtctactatgtaaaactaataaatcaaaatgaggattgagaaaacaagagagatcatatgattggttcaaatggatggcaacatggcatgttgtgttttcttctgctatcaagtttatctagtagctagccgtcaatatcaaactcgtgtcgtctatggtaacatttgaggcatatgggaggtttttggatatcaggtgttgagattttgatttttctgggaacagcttgaatttgattattttaaggttttggatgcccttttatatccgatgccgaattcgtggatgaacagtagcatcaaccgctgcctcatcggagccaataaagcctcacggtacgacggcgagtcggccggcggcgacgttgaggagggagaagcactaagcctcactcatatatgacaacgacgagttggccggcggacggcggcggaggagcagctaagcttcggtgccttctgcactggttttctctggtcacgacatacgtggttggaccgcaataactgactgactgattacacgtacgtcacacagcaatatggcaacttttcaactcacccaaagaaaaaccggagcaaagcagctgctggtgatagtaccaattactaccaagcacgttatgcagaaaacagtagtattcggtaaccgtatataataaaatgaatgtatacagtggtccataagaattgagaaatatgctctgccatatgaaattaacaatcgtaattagccttatataacctcatatcaaagatgtatcatctcatttatagtgaatgaacatcagtggtttataaactaagaactacgatataaattttcttgaaaatcggcaaaatacaaagtggattctgatcctcgtctcacaattctccacaataatcatacagaactattggaagccggatgtatagcaactctgcgcctagtcaatcttcacagatgagtaaatcaatctcgtgaaccacaagcaggcacagaaaccaattgtgccagtgagcacgaagaaagagaatgaggccagaagcatgtagccgaagaacagaatgcctgacaccagtttagtaatctgcagcttggtgaagaagtagaacccagcatacaggaagagatagatggcagatgatcctgaagtaagataggacctccaccaccacatgtaatcctcactgcagagctggaagtagcacagcacgattgcaatctccgcacaagtgatgatgaggataatgaacacgaggaaaaggaagccgaagatgtagtagaactggtgaagccagattgaagtgaggatgaaaaatagctcaatgaaaactgctccgaatggaagaatcccgccaataagaatggtgaaggcagggttcatgtaccaagcctgctctgggacctgtctcgggattttgttggtcttcactggagcctcaatggcaggtttcttgaaaccaagatagctcccaacaaagacaagtggaaccgagataccgaaccaaagaagcaccaaggcaaacattgtggagaaagggacagcacctgatgatttctccccccatataagagcattcaagacgaagaaaataccaaaagcaattcccggaaacaggaaagcagtcttcaaggtgatgctcttccattctgatcctttaaacatcttatagagtcgggaagaagcatatccagcaaacagccccatcaagacccaaatgagcagcatcgcagtcatcaatcctccacggtttgatggagaaaggaaacccaagacagcaaacatcatggtaaccagcagcataccaaagaactggacaccagtgccaacatagacacagagtaagtcagagttagttggtgggcggaacacatctccatgaacaagcttccaaccagtttcctcctgggcttcttcttcagtctcaagttgattgtacctggagatatctctatatagagtgcggagcatgatcatggccaccattccagataagaaaagcacgatcatgagagagttcacaatagagaaccagtgaatttgatcatctgtcataagcagataggtgtcccagcgagaagcccacttgatatcactttcctacaagacccagccaagaaaaccaaaagagattgtttaaataaagataacactcgaagaacagctgtgaaggaacagagtcacagtacaaaagaaaagaagagatgtcatgaaaatatcacctcaaagccaacatcatatgtgaatatgatatccttcccagcttcaacctcttgaggagtatctgagtttattactattttgttggcatggggatcacatgtgctcaaacgagtgtttgcatcattccatttctcttcgaattggtgtttaacactgagtcagggaatttagtaaatgcacatgagggactaataaaaaatttgcccaatatgtcaaagacgttgtatgaaacaaacatgaaaaggttaagtgaacgaacctaaatggtttgacctcgaacccaacaattctagagagatctgaattttcatccttgtgatacttcactaaaaatgccaggtggttatgaataaagtacttctcatccttgctctgcaaaatatatttttgtaagatcattactcaccttccaaacaaaaaatggtaagctgagcacagatacttactccagcatattggcccttaacaccaacatgatatccaccctgaaaaacaagagcatccctatctgtccttgcaataggcacaactagcgggaggttgtcaagaatcctgtaaggtaatttaaccatgttactccagaacccatcatataaaataaatttcaatcaaactacacaatccacacaggcatacatgttcacccggtactcatcctctatcttttcctttagctcctttgcttgtttatcgctaatggttgctttgcagacaatctggcacatcttgggctctctcatctcaaactatagtccaaagaagtaaaatagatgataattaggtacattaatacgtgagtgcactcagataatctgtaaaccagagtccagtactaaccacgtaaggagaattctcaatgcgatcaccacgtagaacttctccaagattttctgcactgtcaactatcgtatctggcttgcagaaaggaagggagtaatatgaataggggagttgtgtctttgtggatgacagcttgttcaccttcacttgaagtggatctttctgcaggcattgtagtatatatgtccattagagcacatctaaaacatatgacttcagtacggcaggtaaatgtaaaggtatgttttttaagattactagatattttttttcttcacagactaaaaaataatttcttttggtcaacttcatgatgttttcttctctacgtaacagaatagaataaacatgtaataacctagaaaaggcctagtagcacagtcattcttaaaactaatgactaaaagatagtgggcaaaaaattagagtaaaagagtgacttgcaaggacatgcatgccattcataagtgacgaaattgaggacaaacatacaactggcaacagtttacgagagaagataaacagggtacagtatagagaggctgagaagatcttgaaaattggagcacgtttactcaatgcgcaagcttgaaaaaattgcactgttcaaataaagctatagtcaacaatataatttgttctgaaaatgttcagagggataatacgaagtgcatatgctaggatcaatgcagaggttttttccactgctttgcttcgctttcagttaaaaacatgttttgcctcagcgctgaggcttgtgaaataatggatctaatctaaggatgctaatgtccatccagaattccagatgcatgcaactacaaccgtggaggcatcctataaccaaatgtcggtacgcctttagcactgattagccacacccagacatcaaacagcactgaaatatacagttcattttcagcattggcaataagcagcacacagattcatcattcatcaaaaccaaaccccaccaacatccacagaaacgcctacgaaacagcatcccccgaagagcgaagagggctagaatcacgaggagccggatctgcaccgcgggatcgccgagatccagcaagcgcaggagcgggagccattaccaggaggaggaggaggaggaggagggggaggaggaacggaccttctggaagtcgttgggcgcgacgccggggaggtagaaggccgcggtggggggcgcggcggcgatgaggaggaggaggagcgcgagcgccgccgcggcggcgggccatcggagcatcgccggcgggcgcatctggtgcggggattcccccggatctggggcgagcgagcgagcgagcaactggtacctcagcctcgtgtccttttcctttgcttgtgtttttttggggctactgctactcacgttcaccggtcgactgggggcaaattggtcctataccattttcaggcccttttttattttccaatttttttaaaaaaaattttagaaacgttgttcaaacgcaagaggcacgtaacatacgcatccaaataggatctagaactagattatgcctgtgttcggtacccctcttcctcttttttttacgcgcacgcttttcaaactgctaaacggtgtgtttttttgcaaaaaaatttatatgcgaaagttgcttaaaaaatcaaattaatccattttgaaaaaaagtttagttaataattaactaagcacgtgctaatgaaccgctctattttccgtacacactattcatgttgggaaccaggcgtgccgaacatagcctattatagggagactcatctcattcttcctccttcggcccccacacccaacccccacaatttctcatatccctttttttctcccttttatgtcttcttctatcaatggttatccagtggggtagagggactcgagcgactcagcacccacgttggatcaaatgtaaaagtaagataatgtggctttatgaaaaaacacaagaaggaagataatttagaccatacatctaagaactacaaagaattaagatgatatggctttatgggagaagaaaagaagagagataatttgaaccatagattaatcatctgaggactaaaaacaatttatatgatatgacttaatgagagaaaagaaaaataacatggaattagtgaggatgaaatatatagatttatatgatattataaaaagatgatggagatatatattgaaatattatgtgaaatatgtgggatgatttaacatgcttacattttaaatctctaaaatttaataaactattaaattatagataatataatatgcttgcatgatgtttaaatgtaataattgttaatgggtaatgatatagcatctgtaacgccccgcttttcgcgagacgttaaaaactaaatcaataaaatcctaattgcgaaaatttcgttctttgagtgagagtctaagtcgtgccatggatcttagtttaaattccttgttccctcctgtcaaaatcaaaaatcgcctcctcgaaattccccttccgattcaacttcctatatcaattccgaaattcaaatctttcctttgaatccatgccaaatacttttccccgtttccaagaaaatatcaaatccttaccttgaatccctccctgtctattgatagatctatctacttatctaacctatcaatccatctatctatctatcgacgtttgatgtcacgactacggtatttgcatagtatggggattgttggtactaggatatatacgatattgaggtaaaagagatggggacaaggatttttatacaggttcaggctcctgaattgtcaggtaataaccctactcctgttggccgaacccggtcgttgctcttattcaccataatcacaccagtacaatatttggggtagcctatctaactgttgtcgacttggcggtctgaagtgctgactcgtagtcgacaacagggtagccttcctcctcgaatccgcatccggcaagttcaaagacagcgctatgtctctcctatcagtatccgtagacaccgcaggcgactagccatgcttatctctaaagtcgatatccagcgtattgtcttggcgtatgttggcttgtatgttgatcttgtgtcttgatctactgttccgtcccccctctcctcctaggggtcttgtatttatacccataggtgttccctttttccaagtagaactagggaaatcaatatggatacaatccgagtaatccttgtcgtttccatgtagaactctatttatctttccttatccggaactccttctatacccgaaggttgttttcgtataaaacatggtatgtggtgggtcctaccgagatttagtcaactactattaggtatgtggtatccataaccctgacagtagcccccgacttcaatgcaaatgaacgagttcatattcttaatccgaagacctcggaataactgttgtcaagctcacgtgatcgttcttggtgagttcagagataacattagacttcccttatcagcctcgtgtgggcaccgtatagggtttgtctgagtaaatctcagacgtcaaccaagaaggtacagagcatacgactaagtctcccgtcttgctgtaatcgagaatttggattgaagtcaagaaattttatctcggcgggtataccatcttttcattccgtattccttgtcgagatccaccaaccgttctcgaatggtcgagaaggcgcagagtctgcgacgaagccttgtcaacatttgtcgtactcgccttagtgaatcttggtgtagaaccatagagacatggagtcttcgacaatgtcgaatagaattttcctgaaatcaatactcataaaagaatattaataaaaatagccccccgagcgaatgctcaaagggtgacatgttataatatgtatgaaaaactaaaaattaattaaatttacagaccaatgttttgtgtacaagcgtcttctcttttatcgacttcaatcagtcagtttgttgagtcatacactctccctagcccccagccttgtcatcggagataagttctcggaggagaatgctcttggacccttgacctgccttggttgaaaaagcgcttaccctagcccccagtcgtgaagttggaaaacccaatttccgattacacggcttggttaatacgcacggtgagaactcttacatgaccagatcttacatggtcgttcatctctgcattacctgacaaggccttatccgctctaggcgtgcccagccgaagttcccttaggttcctcggaggccttgccagggcggcataaagggacagtaggattggtttcaactctaagtgtcgtcgtggtaagggatctctgggtaaaacacttggcgatattgtgtacctgatatcaactttgttggagtagaggtaatgggaggaccgctacactgctggtcaaaaatgagttgtagccccaactcgaccacttgaagtaaaggtagtgggagaatcgctacaccactggtcgaggaccatgtagtagtcgtaactcaaccactagaagtggatgtagtgtgagaaattgctacacctctagtggagaacaaggtgtagccttaactcgaccacgagaagtaaagctagtgggagtatcgctacaccgctggtcgagaaccaggtgtagccttaactcgaccacgagaagaaaagctagtgggagtatcgctacaccgctggtcgaaaaccaggtgtagccttaactcgaccactagaagtagaggtgcgagagatcgctaaagcctactggtccgagaaccaggagtagcttcatctctcggctgattgatgttgaggtacgagagatcgctacggcctactggtccgaaaaccaggagtagccttatctcttgaccgattgaagtcgtggtgcgaggaccactacgctgctggtcgaagaccagtgtagccgtacctcgaccatctgaagtcgtggtatgaggaccgttacgctattgtcgtagtcgtacctcgacca

SEQ ID NO: 25478 - DNA, 419 bp, Oryza sativa
ttgagtgagaaaatcgagtgagagataagaaaaaaaactttcgagtgagatatagcaaaatcgaaaaaaaaacttaaattcaggaactagaacaacttgtctttccgaagcttgaaggccaccctggtctctaccatgctaaaaccaggccacccttcctgatgctcatagattccgtaagtatagaatcctgagcagccccggagtacgatgaacctatacaaacatacttgcgctgtcaaaatatatcaattacttgctctgttaaacatgattgccttttccaaatgaattgctgagaacaactccattgtatgcctgtgctattggatcacctcttatcaatgttcaagggaacagctttgccttctagagaaggatcccatgttctgacgaacgagacctctgcctggttttca

SEQ ID NO: 25479 - DNA, 745 bp, Oryza sativa
actggttgttgtagaaataatagtacagaaagtttgaaatttccttctgaagctgcaccctttcctataaaataatgagatggttgtgcttttctcatccacaggaagtttatagtacagtccatcttgctgtcatgactaatagcacactagcagataattagcataattgtccaataaaccaactatctaacagttaatataacacatcgaacccataccactttcccagcattctccattaaacaaatggtagctcatgcatttatgtgaatgcgcagcactagagtaagctgacatgctgattcttgatcccatgaactgaaacatcacaatgtgatcggcctagttaggagcacctaatgcataacagaaaattgcacagcatgtggatcatcttgagattgcaacagccagatgttaaatgcactagaagaaacatgccagcgatgatacacgggtgatcagcacaaggtgaagtcaactagttcttccttacaccaagaatcatcaatcagctccttatctcatcatttcactgcatactcacagatctcaatacatcaatctggatttgacattaaactactcactcgtgcagaagagcttgtcattgacaatgcagacatgacaggctgatcatgaactcaaatattaagagtgcccgaagggacataaaaaaacatctctttgtcatggagatgggtagctttgtaccagctgcatagctttcattatggatgag

SEQ ID NO: 25480 - DNA, 1490 bp, Oryza sativa
taattggtagagaagagagatgatgtatttattaatggcccactttaaggaaccatgggttgtggagtgtagtttctattatgatgtcttattgacatgacaccatagacactacttatggacactatgggttgggactgcccttatattttagaatggagggagtagtaactaaactcaagaatcaactttagtttgcatatactctactagggaaccggttttctgtaacaggtcaagtagttaaattagaaccatttacatttataatggcctcatctataatgggatgttaatttgaccgtcaccgatggtgctggaagagacaacccattaaatatgcaaagtcatgtgtaatggttcgttattaccattgagttccaagctctatccgccatcagagttggggcgaggaagatagtctcgatatagaatgagatcaacggtgatggtgactagaggagaaggtggtgtccgttggtggagggctagaggatccctccatcgagtcttgggtgacctccacggtggtgctgccagggtttacaaaaccgcgcggttaccacacgcggtaacctttttagtttttgaaaccacggtatgtctcgcggttatgcggttaccgcaggggtgcggtaactgcaccaaaaacggtaaggccgtaaggggaaccctgggtactgctagacgtgggcatcactcgagatccgtcggaggtagccacttgaaggcaatgcaactatgcggggaccgctggtaatggtgaacagcttcccaccaatatgctctcggtagaggccaccaaggtggagatcctatacgtgtgctgggcgaggagaactaggtctcgcatgagtgccgatggtagggatgctctggtgcggagggctctgtgtggagaggttgtggcatcaatgatgggagactggatgggggctgccatgcgtggtcttgcatgaatgtcctatgtgagcccaccgtgttatggttgtctctgcccaagctttgtcaccgttggtggccgtcactgccgttgcctaggtcaatgtcgtcatggggtcggggcacagagaaaatgcaggcgccttgggtcctagatgtgttctggaggttttggaccagattgacacactgtaacaaatatcgagatctagatgtacatttcgaaattacatgaacctagatgacatatagaatgataaatttaggaaccgcccgtgtattttaatcttcgttgaatattgcatgcatgcaatcgtaaatcgtagcaatccctcgcgccgcaacttccattggtgtacgagagataattctactcgctggttctcgaaccagtaaatcgtagcaatccctcgcaccgcaacttccattggtgttcgagagataattatactcgctggttctcgtgccagaaaattgtagcaacctctcgcaccacaacttccattggtgttcgagagataattctactcactggttctcgaaccaat

SEQ ID NO: 25481 - DNA, 8449 bp, Oryza sativa
atataccttagtcaatctcatgtttttaaggctttcagcaataatgtttggtgggcacttgaaaatgtcttatccatccatccctttaagaaaaccatagaaactgtgcaatcatacttgcatgatgtgtgaaaccctctgtttcccgggggagggggggggttaaaaaggatttcctgaaactgtgcaagaactgcacataaacatggcatagcttgatcaacttgatgaggactgtgtcaaagctgctaaaaaatgaatggtgaaagagatatatatcaataaatatgtagctagtggtgaaaagcaatgcaggcccgttttctgccggggagagagaaagagagagagagagagtgattgtcaggtagcttgttgattgagctgcatctgaattccggcatatacgcatgcatgaaacgcagcagagatgttcttcttgctgtctcgcttggacttaaccgcttgggctcacctgctcctgcatcatctgcatctgcatacgcaattatgcatgcatatatatgtttgcttagctaccatgcatgcatgcagtttgtttcagactctttcagttattaatcctgcagatgttcagagaaatgccatcagcggctccttggcccacatccttttcaacgtttaactggggttttgcctcgtagactgtgctatataatctttgtctatgcgatgtaaatactgttagctactccctccgccccaaaatataacaatttagaaccggatggcatatatcctagtccaacgaatctggataagaggctatctagatagattgatatattttgggatggagtagtactcactatagctagcttcaggttttacattaccttgctttgaaaacagccactgcatgcatatggacgggagcgtatcctatgcacacaggccctcgcgtgtacacaccgtgtacaccaactaaaaattatcacaaaaaattttaggaaaattcatacatgtactttcaatagtattacatctacgtgcaaagtcgcatcttcaaattcattctacatagagaataacaaaaaagataaaattttgataaaattgcaaccttaaaactgtcagattttttgtttttttttgttatggctaaaatataataaatttgacattaagattttaaccctaggtgtaatacaattgaaagtatgtgtatgattttttctagattttttggtgacattttttagttggtgtgcacgtgtgtacacgtgagggcctgtgtgcataggatatgttgcccatatggacattcatctaatgaagttcagaactttgtgaattgatgagtgatgacaacttttcaactattcggactagcttgatacgaaagttatatactcctatataacagctcttaaaagttttataaacatgtactcctactactatacaggtgatccatgcatgtttttttttttcggggaaaaaaggatcttcattactcagtcacggagtcctcgcgaacaagccgtgaaataaggtgatccatgcatgttgtattgggatttgggaatactcgtgaactaaattcataacagtaggactaattaactcagttatatattatgggtcatttaggtttgtcctaagacaaaatctttaaatttaaccaaaactataaaaaaaatgtagcatattttctaacataaaacaaatatactactccctccgtttcagattagaagactttctaacgatgcccatatccatatatatgttaatgaatctagacacacacacacacacacacacacacatatatatatatatatatatatatatatatatatatatataccgtcaggttataagactttctagtattatccacatttatataaatgttaatgaatatatatattacatggtaaatttaaggactaactaatatgtgtgttatatgtgttattatatattttatgaatttagtctaactaaaaaaactaatttagaataaatttaaaacgtcttataatacaaaactgactgtacttgtctaacaatgggggtcattttgtttgatgaaatatcctctgcatttctcagccttatatacctctacaatgagctagtggccaactcttgcgtactgggccaaatgctaaaggaaaaagtatagtttgactccctcaactatcgcccgagtatgattcatgtcccctagccacaaaaccgggtatatggactcctccaactattaaaaccggtgtacacaatatcactcggtggtttgggaagtggttttggctgacatggcgcctacgtgacggttttgaccaagtctttgttctacgtggtgcttacgtggcattagaataaaaacaaaaataaaaaaaatatgtgggatctatatgtcattcgcacaaaaaaagtattttgggacccacatgccatcctccttctccttcccttcttcctccccctctctctcccttatctctctctcccccttgggcctttctcttggccggagtgcgggggagacggcaatggggagcggcggaggcggttgggagcggggacggatcaaggaccgtcagtacctgctcgtcccggagggcaccgaccacccaccgcatgccgcgctgtcctccccctccccatcgccccgcacgtcttccaccgtatccgcgtcgccgcgtgcgcgctgcgcgtcctccgcaacctccagcccgcggggccaccatctggagcaagcttggcgatggcgaggggccgcgggtgttgctctactacacgtcgcttcgcgtcgtctgcgggacctacgaggactgtcgtgccgtgcgcgccatcctgtgggggctccgcgctgccgtcgacgagcgagacctccccatggacccgaccttcctcccggagcttgccgcgctcctcccccaacgccgccacatgaccctcccctaagtgttcgtcaatggccgccacctcgccgctcccgaccgccgccgccgccgctccccgctgccaccgctcccctccgcctcgtccccatcggccaccgctaccgccgccgctcctgagtcctgagagagagagagagagagagagagagataagggagggagagagagggggagaaagaaggggagggaggatgacatgtgggttccactttttgtgtgaatgacatatgggtcccacattttttttttgttttttataatctatagtggcacgtaagcgccacgtaggacaaagacccggtcaaaaccaccgagggatattgtttgcaccggttttgatagttggaggagtcgatatacccggttttgtggttggaggtcatgaatcatacttggacgatagttgagggactcaaagtatactttctccaatgctaaatgatggaggaaatgggccaagttctgtgaggcccatgcttgtagtcttgtttagccagaggataagggcttgaaaggccaaaaactaagaagggcctttttgtatgtatctgctgtgaaattggacctgaatccacgtctaatttcgacctatacactcttgcgtggaccagtgtttttagtttaattttccaacatggcacccataatttaataaaccaaattgactacgaataatctgcccgtttaaatgtttccttaattccctcaaaaacaaataaagaaaattcaaaggaatattacactactactccagttgaaaatttctttttagagtgggagcaagagtccttcgaacgtttgattgaaaaataggaggaggccaatgtaaaagtttcatttatagcaggggccattatactatttgagtaatactctactatagtgacttatgtactttaatgcaatcctctcacttgctataaaattatatatcgcactaatttctaaagcttaacatacagagatgtcatatcattacttactaacaattattacatttaaacatcatgttatattatctataatttaataatttattaaattttagagatttaaaatataagcatgttaaatcatcccacataattcacataatatttcaatatatctctccatcatttttttaatatcctataaatctatatagttcatcctcactttattccatgttaattttcttttctctcattaagtcatatcatataaattggttttagtcctcaaatgatgaacctatggttcaaattatctctcttctttttttctctctcactaagccatatcatcttagttctttgtagttcttagatgtatggtctaaattatcttccttcttgtgttttcttcataaagccacatcatcttaattttatatttgatccaacgtaggtgctgagtgactgagtccttctaataagagatggaagggagaagaagagggatatgaggaatagtgtgggttgggtgcagtgcgagtgcgggggctgaaggaggaagaaggagatgagtctccctataatctagttcgagatccctatttggagatagggtgtacgtgcgtatgcgtttgaacaacgtttctaaaaattttgaaaaattttggaaaatgaaaagggccagaaaatggtataggaccaatttgccaaaaacgctaatacacgactagtcgcgcgcgtcccttcccgcgtgacgagccacgtggcgcgcgcggaggagttaggttgcgttggttttttttctggttttcttttttttcgttcgtttcgttggttttttttccggttttctttattcgttagtttcttccgttcttctgtttttttgtccggttttctcgtttttctacgttggtttcttccgtctttgttcggttttttctctcccttttcggtttttcagtagcaagtttgtatacacacgtgtacaaagtttgtatacatacatgtatatattttgcacgtatatacagtttgtatatgcacgtgtacaaagtttgtatacgcatatacaaactttatatacgcacgtgtacaaagtttgtatatgtacgtgtataaagtttatatacatgtttatatttttacatatatatatataaagtttgtatactcccgtatacagagtttatatacgtcgtgtataaagtttatatatatgcacgtatacaaagtttgtatacgcatgtatacaaagtttatatacgtataaatgtacatatatggcaacgtatcctatgcacacgggcatatagctgcactcatgcacacgctcgttccgagcccttcgatcaagatcctgcggctaactctccaagcgttgcatttttacaatttaccgcccgcctcctccactaagttttgcaaaacacccctccacaattctcatcttccctcgagcagtccatattaacaaaaaaaaaaaggttaattggatccatgccattacaactttgcgaaattaaaaaaataccactactattcaccatatcagctatatgcaactgaaaatttctaaaattgaaaacatgccactgccgtccctttttccatctcctatctcacgctgtctcgtttcccccgtcagatgtggcgtcatctcacaccatctccctcttctttcttcctgcgagctcggcggccacggcgagcgctcgcgggttgaggaggtcggcgtcggcagcgcgcgggacttgctccaatccccaccgcctctactgacatcgtcgtcctcgtcttcctcctccaccagacgccgcgcaatgccgccggtcgccgccgccgggctggcccccgctgccgcgcgcagctgctcgaagaagaccacctgcatgacgacgcggagcgggaggcgattgttctgcgccgcgtggatgcacgcctccttggacagcttcttcacgtccatcaagcttgagatcttccgatcctcttctccgccttcggcacgttcggatgcaactgacaagtgacagcagattgcaatatgttcatgtcaaaaataatagtttagatatcatatacaaaatatattagtagtttatacttaacatggaggatgaaaatatacatcaacatgtacaataaagcagattcaagaaccaaaaaagatgaaaaatgatcactgttttgcatcatggtcattgtcaagcaaatataccttgagaaagacatcaatgtcggtgtacagtccatcatgggttgctcttgctgcatcacgcaaggaggtcggagaggaagacagcgacgcccgcgggggagtagaggagggagcggaggaggtcgcggaggtgcgggagcgtgcggcggacgacgatgaggatgcgggcgctgcgcgtggacaccacgctcgccggcttcgacggcctccgcatccgccgggccaaccatttgttcctcttcttcggcgaggaggtcgacgccagcggccgccaccttcccccgggctcgctcctcgtgctccaccgcggcaggagagcgtcggggagtggaagtcgcgggccgacggccaacgctggccgtaagccacgttcgagctcgccggagatgacgatgacgacgaggacggcgacgaggaggagttcctccccctggagatccgcgacgatgacgaagacgacgacttcatggttgccgacatctccccgcccccgtcgcgccacagctgctacatgcccggccggcgcagcgtggcgccgccgccgtcacacatggcgacgccgccgtgctcgacgatgcgccgggcgagctcagtctcgggagctgccgccgccgccgtcgtcctccacgccgtccgcggcgggagtgctcgggagctgccgctggcgtcgccgccgctgtccttttgcagttggagggagagagaaagggagattgaaacgattaaacgtgggaaggagacggcgtgagagtggggagtggaatctaatccctcgagggatatccctcgtatatctttttttcttttaaattcgatgtaaatagttgtaaaaaattctgaaaaaaattgacaatgtagagtataatgatacctactagttcatcaaaatttaagtttaaatttgatctgcacatcgagaaacaaaaaaaagacaaatttagatataaacagtacgctactatttatacgctgaatttatcttttttatatctcgacgtgtgagttgagtttggacttaagattttgtggagttgtatatatgtgttgtatgaatgttgtcaattttttccagattttttcataaccgtttagataggttttaagcaaacgagggaacatccccttgagggattagaatagtttcccatgagagaggggatggaaaaagggacggcaatggtatggttccaattttagaaatttttagtggcatgcagccgatataacaaatagtagttgtattttttaaatttcgcaaagttacagtcgcatggatccaattaaaaactcaccctatctggatctagcactagcacgccgcatgcgcaacatcggcgagggtttgtgttcggaggcagcggcgacaatgcttcaacggagacaacgacatcaatcaacgaagcgctggcagagacggcgatctcgagcggcggcagaggctgctgctgctttcaccacagcagaggttctgttcaagtttagggggaaaaactaggagctgtcactcatgaacacgatggattgatggctgaatatcttctatgtaatcccatgattcttccaaaacattactagttttgctttggacgcagatttgaaacagtcaggtggtgatgaactcttaaatctcatgtgaataagaagagcagaaattcggactaaaacaacaaatttctccgaagaaaaaagtggtaaatagttaaatgccccccaatttgccacttttacggccgcgcgcggtcagtcgctaatcaactcttcccctaatttatgagatattgaattatatgtaaaataatttatgagatactgaactatatacaatatagttaattgacaaatttaaaaatgacaaatagttaaatgccccctaatttgcccccacccgcacacggccggtgagcgtgagtagcagtagcccaaaaaaacacaagcaagggaaaaggacacgaggccgagggagggagtttggcagttgctcgctcgccaaactgccagatccggatcccgcaccagatgcgcccgacggcgatgctccgatggcccgccgccgcggcggcgctcgcgctcgtcttcctcctcctcatcgccgccgcgccccccgccgcggccttctacctccccggcgtcgcgcccaacgacttccagaaggtccgttcctcctccccctcctcctcctggtaatggctcccgctcctgcgcttgctggatctcggcgatcccctggtgcagatccggctccttgagtcctcgtgctctagccttttcggggttgtccgtacgcgccaaatcgttttggctttttttttctttttttgaaaaccgaagccagcaaagctggtgttataattttg

SEQ ID NO: 25482 - DNA, 6963 bp, Oryza sativa
gccgccccactcggccacggttccccctccacgagtgtatataaacaattcctggagcatcctctctcgttttcccatttcgcccgaacccgccacactccccctcgctctccccacgccgttccccatcgccgccgcccgccggcgctctccagccgcgcgcctcagtcgctgccgccgtctccgtgctgcgccgttgccaccgccggctttgccgccgcccgggaaagctcgtccactgctccatttcccctcttcacctccgaagcgccgcagccacgcgaaccacctctctccgccgccgctgccgactccagccgcgtcacgccgccgcttcggtcgacgccgacccgcgccattgcctccctcagctccgcaaggacgaggaggacctcggccgccgcccctcttcgccagaaatccgccgtagctcctccttcctcagtcgccggtgagcgcctcctcatattgtcgtggtcggccatcgttaccggtcaccacgcaccagtcctcccctctctaacccctcctttatcttcctcagatcgaggccgagcccgtccgccccttcccgagcgacgcccgtcgccggagctccgtcgcatcgtcttcctgaggagccccaccgccgccggtccttgccgtcggctgccccttcgccgtcgtgcccctcgttgagcactcccttccctctcccttttcctccccttcgtcggccacctccaaggcgtcctcgcgatgcgctgccgccgccggtggccgtccgaccgggtcactgccgccgccctccgcgcccgcgccgttgccggtggtgccgggcagctggttgccgcctcccccttgccgcaccgcgccgccgctctctcgcgtgcgccgccatcgcccgcgtgagtcgttgccggccgtcgccgcaagtggccgcgccgccgcgagccgtcgctcggccgggccggcctgagccgtgcccgtgccctgccgcgccaccccgtggtcgcccgatcagctcgggctgatctgggccgtcggttcccgtggaccggcggtggaacatcccatggtcctggtccacggtggaccgattcccttgacacgctgacgtgtggggcccgcttgtcggcgccggcctctttgatgacgtcagcgcttaagccttttcctttgtaaaaataattaataattgcgcaataaatcattgataattatagaaaatcatttaatggctcaacaacttctaaaattcatatctaattcattcgaactccgaattgagccgttcaacttgcaaaattcatctaaaattaagctctacatgtttgtttactttttatgtactgtttgcttggtttttattagagttttttctcgttttgtgtgccagcgtgtagaatccgtcgtttcggaagattgcgatcgcaaggggaacgagttcagaagatcaaagtgaagaagcaaagcaagtcacatattccccttgagcatgttgatcccaatttataaatgttttaccgtttgcaaataaatatgcatgttttgctaattacatgggatccgggtgttacctatctactcgcttgtgccatgtttacttgatatctgtcatttgtcaaccatgagtaataaatctcctagcttgtgttacttatgtgaccgagctagaactatatgcttagccatgcttaattaccactagctcagttgatgggataattacagtattagacctttttagtatcagaatgagctgcatgctcgagacatctggccaagcttcatggtcatatttatccaactaaaaaagcgactgaatggtgggctgtgggtgtatggttttgctagtcgcacccatggcgattaaggaccggttcgcgggatgccctggaagaacttatcatacttaccacaagccagcgtgggcaacggctgggcttgtagtgtagctttcctctagctaacgcatccaggtaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagtgggggttatgcgaagggtcctgtcacggcctctttctggtatgtcatggtggcatgtcggcacacggaaacgtgtcgtgggactgtgtcttgtgggtacagttgtacacctctggccagagtaaaactattcgaatagccgtgcccgcggttatgggcggtcgaccaaattcaccgtcattagtcccaccttaataaatcgactcaatgcactgtagttcaggtgggttggttgggcctgttcaacgtggtgtagcgttgataagtggagatttaatgttactttaattacttaattgttttacggttttgctcaataaaatgttttacaactacctttatgcaaatagcctcaagccgtccttgtatccccttgcacgtctgcatcattggtgtggcttgctgagtacagtggttgtactcagccttgctatttccccccctttttcagaagtgtagtgcttctgaactaaagacgaagttagaagaccaaggctcagaccccatttcttttccgctgctgctgctttcttttcggtgtgaggactaagtgcctcttctgtaagtatttacgctttatttatgtttggaactgtatattacttgtcgttttgtgtaccctggctggtcctggacagggatttaatacacaaaatagtctggaaatttggggctaaatttctgggcgtgacacccaccacttccaatttcacttgctaattaagataaatataaccgtacaaattttaagtatctacggctaattattctttcaatggtaaacgatgtatttgtcgataacgagacacccatagtgacttcgctaataccaaaatataccgatctagttttttagatgtgcttatagggataagcaagagtggatccaatgtgggtgttgggtcactcgagcccctgtaccacactgaatcaccattgatagaagaagagatggaaggagaagaagagggatatgaggaatagtggggtttgggtgtgggggccgaaggaggaagaaggagatgagtctcacctatatatggctgagttctttacctcacttttccaacttatttctcttgtttttcgcgcgcacgcttttcaaactattaaacagtgtattttttgtaaaaattttccatacgaaaattgctttttaaaatcatattaatccttttttgaaaaaaataactaatagttaattaatcatgcgctaatgccatgtcgttttgcgtgccgcacccctcctcccgaacacagctaatctagttctagatccctatttgaagatagggtgcatgtatgtctgcgtttgaacaacttttctaaaaattttaaaaaaacttggaaaacgaaaaaaaggcctgaaaatggtataggagccatgtttagttaaaaacaaaaattttcacactgtcacatcgaatgtttggacatatgaataaagtattaaatgtagaaaaaaaactaattacacagtttgcgtgtaaattgcgagacgaatcttttaagcctaattgctccacgatttgataatgtggtgctacattaaacatttgctaatgatggattaattaggcttaataaattcgtctcgcagtttacaagcgaaatctataatttgttttgttattagtctacgtttaatacttcaaatgtgtgtccttatatccgaggggcgggcccacctcaattcaaagggtattcaaatgaatacccaagatttttagacaaaaaaaatacatatgtgagatatatatttcgtatgtatatagagaaataaagaaaatatacgttattgatcgaaagaagtccaacaagaaagcctagcaggctggatccctcaaaatcgaacccaattatgcatggttgtctaatttgtgcattaaccatgttgtaatggcatgacgccaatcgatatatacttggttggtagattgtactgtatatgttttctcacaaagtatatcataataaattaagaaaattgctaaaagccttgtcgcaagttctaattcaataagcagtactaaaatactatactattgatcattcatacctaatattgtgctcgtgttgtaaaaattatttttttatcccctttacatttctaataactaatctcaaaatcctgggccgcccttagacgtgacaaccacacacacacacaaattttcgcccaacaaacaaggcccccaacttgccccccaacacgaccggtgagcgtgagtagcagtagcagctcgaaaaaaggacacgagggagggagagggagtttgccagatccggatcccgcaccagatgcgcccgccggcgatgctccgatggcccgccgccgcggcggcgctcgcgctcgtcttcctcctcctcatcgccgccgcgccccccgccgcggccttctacctccccggcgtcgcgcccaacgacttccagaaggtccgttcctcctccccctcctcctcctggtaatggctcccgctcctgcgcttgctggatctcggcgatcccctggtgcagatccggctccttgagtcctcgtgctctagccttttcggggttgtccgtacgcgccaaatcgttttggcttttttttttctttttttgaaaaccgaagccagcaaagctggtgttataattttggcgtgatcgtcgtcctgttcttccacacacacacacacacgtaggggatgctgtttcgtacgcgtttctgtggatgttggtggggtttggttgatgagtgatgaatctgtgtgccgcttgtcgccaatgttgagaataaactgtatattttcagtgctgtttgatgtaggggtgtggctgatcagtgctaaaggcgtaccgacatttggttagggatgcctctgtcatgtggttctagttgcatgcctctggaattctggatggacattagcatccttagattagatccattgtttcgcaagcctcagtgctgaggcagaacatgtttctaaccgaaagcgaagcaaagcagtttatctctttgagtggaaaaaacttctgcaatgatcctagcatatgcatttcgtattatccctctgaacattttcagaacaaattatattgttgactatagctgtattctgtaattttttcaagcttgcgcattgagtaaacacgctccaattttcaacatcttctcagcctctctataccgtaccctgtttatcttctctcgtcaattgttgccagttgtgcgtgtatcctcaattttgtcacttacgaatggcatgcatgtccttgcaacacctgcttaatcacccttttacccttaattttttttgctctctatcgttcagtcattagttttaagaatgactgtgctactaggcattttctaggttattacatgtttattctgttctgctacgtagagaagaaaacatcatgaaggtgactgaaagaaaatatttttgagtctgtgaagaaaaaaaatatctagtaatcttaaaaaacatacatttacatttacctgccgtactgacaatatcttaaaaatatctagtcatatgttttggatgtgctctaatggacatatatactacaatgcctgcagaaagatccacttcaagtgaaggtgaacaagctgtcatccacaaagacacaactcccctattcatattactcccttcctttctgcaagccagatacgatagttgacagtgcagaaaatcttggagaagttctacgtggtgatcgcattgagaattctccttatgtggtcagtactggtctctggtttacagattatctgagcgcactcgcatgttaatgtacctaattatcttctattttacttctttggactatagtttgagatgagagagcccaagatgtgtcagatcgtctgcaaagcaaccattagcgataaacaagcaaaggagctaaaggaaaagatagaggatgagtaccgggtgaacatgtatgcctgtatggattgtttagtttgattgaaatttattttatatgatgggttctggagtaacatggttaaattaccttacaggattcttgacaacctcccgctagttgtgcctattgcaaggccagatagggatgatgttgtttttcagggtggatatcatgttggtgttaagggccaatatgctggtgtaagtctctgtgctcagcttaccttttcttttgtttggaagactagtaatgatcttacaaaaatatattttgcagagcaaggatgagaagtactttatccataaccacctgatatttttagtgaagtatcacaaggatgaaaattcagatctctctagaattgttgggttcgaggtcaaaccatttaggttcattcccttaacctttttatgtttgtttcgtacaacgtctttgacatattgggcaaatttatgtttaatccctcatatgtgtttactaaattccctgactcagtgttaaacaccaattcgaagagaaatggaatgatgcaaatactcgtttgagcacatgtcatccccatgccaacaaaatagtaataaactcagatactcctcaagaggttgaagctggaaaggatatcatattcacatatgatgttggctttgaggtgatgatattttcatggcatctcttctttccttttgtactatgactcttttccttcacagctatgcttccaatgttatatttatttaaacaatatcttttggttttcttcgctgggtcttgtaggaaagtgatatcaagtgggcttctcgctgggacacctatctgcttatgacagatgatcaaattcactggttctctattgtgaactctctcatgatcgtgcttttcttatctggaatggtggccatgattatgctccgcactctatatagagatatctcc

SEQ ID NO: 25483 - DNA, 3340 bp, Oryza sativa
gccgctcttttctagtggatccccctcactggcacgattggtttctgtgcctgcttgtggttcacgagattgatttactcatctgtgaagattgactaggcgcagagttgctatacatccggcttccaaaagttctgtatgattattgtggagaattgtgagacgaggatcagaatccactctgtattttaccgattttcgagaaaatttatatcgtagttcttagcttataaaccacttgtgttcattcactataaatgagatgatacatctttgatatgaagttatataaggctagttacgattgttagtttcgtatggcagagcatattattctcaattcttatggatctctgtataaattcattttattatatacgggaccgaatactactgttttctgatcattttttacccttccaagatagtatcaccagcagctgctttgctccggtttttctttgggtgagttgaaaagttgccatattgctgtgtgacgtacgtgtaatcagtcagtcagttattgcggtccacccaggggtcaacggtcaaccacgtatgtcgtggccagagaaaaccaatgcagaaggccgtctcctccgtcgccgtcgctgtcgccgccgtccgccggccaactcgtcgttgtcatctcccagcacttccggtatcatatatgagtgaggcttagtgcttctccctcctcaacgtcaccgccggccgactcgccgtcgtacgtgaggctttatggtgcgtggtggcggcggtggccgcgctgctcgccgcgccaccggtcgcagctgtgttcatccacgaattctacaaggtactgaatctgatacgctctacatggtatctgtctcctttggaattgatctgctgaacattaattggtctaatcttctgaattgtttgctttgtttcttgtgttcattttcacagggagatgaggttttggtgaagatgaacgagctgatgtccatcgagactcagatcacctactcgtactactcacttcccttctgtagacctgacaatctaactgaaagtgctccgactctttggcaacttctccatggtgatcgccaacagaggtccccttaccaggttagtcacacactgccacctgccagggttttatcttgggttctatcattttttttttgtctgtgaagatcttggattatcatttttggactgcgaattgatgatccaactttgcgttttcactgtagtttgaaatgagagtgcccaagaagtgccaaattgtctgcagagtgcttgttggagaaaaagaagcgaaggagctgacggagaagatggaagatgagtaccgtgtgaacatgtaaggattgtagaggttagatttacattttctaaaaacaccgcaaagtttgtgagagatttaatgaagttgaattacagggctcttgacaacctcccattaagtattccaatcagaaggatagataaagatgattttttctatcagcatgggtaccatattggtgtaattggccaattctttggagtgggttcatcttctcaaaactctttttttagatgaaagatcattatattgatcttctcaaactctttatttcgctaaaatctttagttaaaaagaccctcatgcataagcatttttccgcaggaggagcataagaggtacttcatccacaatcacttatcatttttggtgaggtacaagagggatatcgacacaagtgcttctacaatagtggcgtttgaggtcaaaccattcaggttttgccaactttgcttcccacattttattcagcatgaatgagtaccatctttaccgttcttctggttaatttccttttgtcccagtgttaagcaccaatatgaagcgcaatggaacggtgcaaactctcgtctgagcacatgtgatgctaatgccaacaggttcatcttatcctctgattctccaccggagattgaagtcggtgaagaaatcatattcacctatgatgttaactttgaggtggctttcatccttcccttttatcatcctttcacctgtaaattgtatcttctccctaaaacagacattaatcagatattaaacctttctctaatgatttatcacatgcttgtgctactgctgttacaggaaagtgatatcaagtgggcttctcgctgggatgcctacctgtcaatgacagatgatcaggctcgctggttttccattgttaactctcctgttaccctgattggtctttctgttgcaatggccatgactatgcttcgaagtctgcatagagatatctttagatacagccaacttgaaacccagaatgaggctcaagtggaaaccgggtggaagcttgttcatggagatgtgttccggcctccatccaaccctgtcttgctctgtgcctatgcagggagtggtgttcaactctttggtactcatcaccgtagccttcgctgcgctgggcttcttttctccatcaaattctgcaggcctgagaaatgttgtgttgctcacctgggtcctgatggggatgcttgctggctacacctcttctcgcctctataagatgttcaagagcggttcagagtggaagcatatcaccatggcaacagctatccagttcccgggtttcgcttttgttatcttcgcaatcttgaatactcttctacaagatgagaattcatcagccacagttcctccaaccacaatgtgtgccttggtcctcctctggtccggtatcacgccgcctctcgtgtttcttggaggatatcttgggtacaagagacctgccattgagcctccggtggagatcaacaaaactccacgaaagattcccaagcaagcatggtacatcagccctgtgttctccatcctcattggtagtatctttccatttacaattgttttcattgagctcttctttggcctcatcttcatctggtatcaccaattctaccgtggatttgggttcctcctcatcacgcttgttctactcctcgtcgcctgcgctgaaatctccgttgcgttttgctactatcaactgcgaagcggcaactacaagtggtggtggagatcattccttacaccaggatgttctgcagtctatctcttcttatatgcgacattcttcttcttcgcgaagctgagcattgttaagccagtgtcagtcatgttctactttggatacatgcttgtcgtctcatatgccttcttcctgcttacaggcacaattggtttcttctcttgtttcttcttcacgaggtttatttactcacagagggcatttggatgaacttgagattagaattttggaattggaattagaattctgctgtgattgta

SEQ ID NO: 25484 - DNA, 9922 bp, Oryza sativa
caaggttttccatctcttccgtattgcaccaagctcttttctttctttttctccaccaccataatagcaccccgaaaatgcaagcatatcaggttcaaatctggcaacccaagagaaagactgtttagggaaaaggaaaaaaaaggaaaccactacaaactaaatagacaacatacttatattactcatacaagaaaatcagaaaccagtacaacttcagaccaagatggtggtctattctgaagcaaaggtcacagccaatccactaaactgaacttctcctgacaagagcatgctatatgatggccttctctctttactagcatgaccaacaagtgattgactgatattatcgataagatctgagaccaatcttctcaatacatagatggagcacaggaggaccctcttttgacatgccattcggaactccatatatatgttctactagtatgagtatgtgcccgcacaaaggctactttggacagtattggttgacaacttttagatatcacccttcactattttgtgcatgcatcctattttgtgcatcctccctctcaaatccaggctatgctcaactggggtattcatgataaaagaaacatgctaaggagcccaacatttgctaatccaagctagagatgaaaattgccccccttatgacctaaaatgggtttcaagtaatcccctgagaaaaagaaactatgttcttcacaaatacagcactaagaatataagactctctagttttgtattaaaggaaaaccaaaatatgagagctcaagcaccagaacttgagatgcgtgtaccttaaatgaagagcaataaaatgtttgcttctctctctcattctttgtattaatttttcacccatttcttctattaggccagtaaatctcaacccatgatagtttactctgcatctcagcttctgcagatctgtgtccaacctgtttgctagtctataatcaaatttcgtcagccgaacaacctgcactacgtgaaagtaatgatataaggtatcctggtattggtattatgagtgtctctgaacagaagaagtaaatttatttgaagtcacacaaggtggtcaatggtcagtcagtggaacgaaagtacagtcaattgacctaccaagaatatgaaatttctattcctgatctcaaaaattcatatcatcaagacggtgaattagcacataatttaaaagtatcttgggattatatgctgctagcaatgacttacatgtttcttaagaagtgcaggcaacacacggttcacataacatctctgagtacattttcggggcacacgcattctatgaggagtccgcagtttgcctcctatctctggaagctctttcacaatctttacatcctttgatagattcgagatgaaccagtcgacgtcaaaaatttcagagaaattgctgcagagaaacagtacacatacaaatgtaagtgttcatagaaacatgggcagccttagaatattagggtaggaagcgctcaatactcaaattaaccttgcatctttccagaaagatgtttgatccaatttgggaacaacaagtgtggcatttaagatacgtgcagcaacaacagcatcaattatctgaaaagcagaagatggtcatagttatgcatatggaacaacagaatacacataactaccacggagttacatggaacatggtgtcataatggatcacataaaatctatgtgtacaagttgattcttcatgtacatttgcaaactgatttcttttattctttttcctatccatccacacgcatcacagtatttgatacggaacagtgtggcacatatattacccctgttctctgttgattgaggcctccacttgtaacgatcatcaaataacggtctggttgcgtgataacacttgaacctgcacaatttaaaacattgactatttcaggtaatccatacaacaaagaatagtaccactgccactaaaacctcctatatgtagaatgcctcagaaacatgcacactacaaatctaaaacactactcagttcgagcaaattttaaccgtcagtggaaaaataatgcgcaccaaggaacctgctgcttgagttgctgcacccatagaatctgctcgcaaacttagaaccccaaaggccatctgcctctttctgcagtatgagaaattgcaatgaagttttcatgctactttagacaaaaatggagcaaaatgagtacatatttcatgggtctatatttcaaaatagggagtgtcttgactcttgagcgcattaaataaaatcagtttaactcaaatctcagaggatcacatctagaaaacccatgagaacaagttgtgtttcaaaggaaataaataaacccatgataacaagttagaaaatactctagaacatcctaatctaactccgtaaatataatagaaaagagctcaatttaatagcttgccatcatctaatttgcttcaaaaatggcacagggaatggaacctgaatcattatctaccaattaaaacaaccatttcccagaaacaattagttaggcactagaactggaataagtgcactgtatctactaatttctgaacagcacaaccacgcaacctctgacaattaatcgaggaattagttcgcttaatctaaccaaagaagcttacgcttatcggaacgcgcgaaatctcgctgtgctcggacaccaccgtgcttccgccgccggagctgttcagctgcactcggaatgcacagagcaagacaaattagatcgggataagcgtggggagcaggtaggaaggggtactagtgcaacaccaccaggggggcatgaggggagcggcggcgagaggaagcgagggccgggtgatcgatgagcggcggcggggagacgtagagcagcgcgacggcggcgaggaggaagagcaggagcgccgccgccggcagcagggccgggcgcgggcacttgttgtggcctccgccgccgcgccgtcgaggctgggccatcctccggagcccggagatctcaggctaggctagggaggtagtgccgcgacggcagcggcggcggtggtggtggggtggtcgccgagacggcggcgacatgggagacttgtggaatttcgatgagtgggtttgaactttcgagaaggtgatactgttccagtgtacggcagtgcagtattaaattaaactggatttccgtattgcaaattttgtactaattttcaaattcttttccttttttcatagcacatataactgtaacgattaaacgatgcaatttgaatacaagatatttcatctaaaaaaggatacaggtatttattgtcgatttctgtaggaattgagacttttgtgtacatttgtaaaggagatgtattcacattagctagtacaaattggtcgaaatttttctgtaatcctccggttaaaacttgccctttaatggagtaattgaagcacgaatttctctaccatcattgatgacacatggaggaaacgtgaatgtctgcgtgtgttcgggttggattgggatttggtgacattctcccgtgacaccgagggattcggtgacattctcccgtgacattctcatttgatgtcaccgaatcccaatccgttcaggattttggcgacagatgggaccagactaaaaaaaacaagcaaaatgttgatttgttttttttcattaaaaaaggttgatcattttctaaaacaaatttatcccttcgtttcaaaatgattttttagtacgtgtttgaccattcgtcttattaaaaaaattaagtaattatttattattttcatatcatttgatttattgttaaatatactttcatatatacatatagttttacatatttcacaaatttttttaataagacgaacggtcaaacatgtgctaaaaaaatcaacggagtcaaatattttgaaacggagggggtatcagcgaacacatatgatttaaaaagaaactgtcgacaaaatcttcgcgaaaaagaaatgctgaaagcatgtgagcctgccgtcctgaacgcatgacaagttcgtaggtggctcatgcccaaaacaatttgaagttaatttgctcattccctgaatgattttgtaacatacagacgaaatattaatctttgctaaagtaagggaaccactcatacagtgaaaaatcgaatgaaaaacagaagctcagatcttgtcaatctcaacagttctacaaaattcagatcggttgtacttcaccacataacgcaacaattgacaccaacctttctcagatatatgacattcaagaatcactcgaggagcagtatttggcaattgtaccaggctgaattttgcaattacagctggcctgaatcacaagagtggcagatcatatgagacactggatttctgccaagatggttactgaaacattattggcttgctattgttctggggtcacaagctgtcgaatcaggccatcgcatcaactccatgtaccagagtacagtatataggatggcaaggagaaaatctacaacaccaataatatgcacaacaaacaagtctgcttgagcagaaaagggaaggtctgttagaacaagagaaggtactattggtaatcgcatcaacaacataccgagcaaagaagtggagttatgtgcccttacaacggagagaacatgcagcttcattttctctgcaagtagggcttgactgattctaaaacaacctgaccattagaggaaattatcacagatcattagagtcaagattcagatatcagataaactggctttaaaaaatcacaagacaaatatttcaaataagcatacaaatgctgcaggtacttacccttccgtcataagataaagaagcaaataatgacggatcatgggagctccatgcaatacctacaattttttaatacgctgtgtgattccttgtcaaaattataacgtagaattataaacacaggtaggaattcctgagggtaccgtatatgctatcttcataatcagtgtatgaatttagtaatggttcttcttctcttgtgggtgaaccaggaggactgataagcaagaatgtgggcatcaagattataacaaacaaagtaaccaaacaagaaaatacacaaggaatagaaacctttcaggtcctgagtcatcagtgccaactttagcaaaccacaaattgacagttgaatctgttccagcactctacaggagttacaatgtagtcagtacacaataaaacagtacatcacaatatgcaaaccacttgaagaaatagagagagagggagagaccagaatcaactggtcatgctcaggattgtgccgaacagcccatgtcctgcaaaattcacaagggtcgactaactaaacattgaatcgaaaggattctaatctgagtaaaacaggatatagaaatataccaatgcgaatgcccagggagattcttcagaggatacttaagcattctgagatcccacaaacggataccaaattcatcttctgctgttgtctacaatgcataaaggatcttttattggaaccataaataaattaaactgaataaaaataaacagtacctatcactataaccgttaattgcacaattgtctgattcaacaacctctgaaatagggttcaatgattcagctagataacacaatcaaatccgagtgtttagtttcattgaacaataaaagaagtaacggctagcaagtagcggcacagctgataccacacagtacctactaatgtaagaaaaataatctctgcaggatccttaatcaaaacaaagacgaaacgaagttgacaggtaacaaagaaaacggaagtaatacaacagtgtttttctcttcagtactaattcataaccatgacttaagcaaacgaactatggcttgatctgaaacacttgaaatgaagtacggcaagtatcaccactcacaattaagtgctgtttcttggggttataatccacatcccgaaaatgcgcatgctcaattgcatttgatttcctgaaaagaacaagttcacagataaagatataagtggaacatttcagcatctaaaccacagacactagatcaacaaatctaatatgtcaagattgtgaaggtattaacttcatagaacggagatcccagcagtgaagtgaggaatcagtaattgcagcaattgaattgtgatcgtgtggatcccaagatccaccacgtaaattgggaagcatgtcagcagaccccttttgcatcacctgtaacttaggaattcaagttaggacaagattaagttcagaacttctgctaacagagatacagaactgtaagtttccataaagttgacactgaagtgcgaagataatgcttagaaacaatgtaatatcacgtaattatgtcgatgtactattggtaaaacagaaggatgctgggcacaccttggctgacttatttgatgcatctatattccagaggaaaatatttctgtcatcaatactaattaacttgtcgtgcttccctagtggccaccagagaacactgcaaagataagccagcttacagatacagtctgagcatggtatccaccagaaataacaatgtattaaaggagcttatacattgttataagactgtgaagaaaggtcataacttatctaaaactttagatcaaaaaatggtattggtaaataaaaatattaaaatttcatctattgtgtgctccctatagagaacctcggacgagccaaaattaattcttatgttgctttggccttcgaattgtagctatgtgttgtaaacaagtaaggtatgctaggaaaacttgaaatatccgctgaaccctatatggtgtataaccttctcatgacaatgtgcttcataaagtagcattggtaaaatcacagtcatcgtttttgtgagtcgactaatccccaaaataagagaccctttttgggctttgcaaatcatcagcatacagttgcattcttcaactagactctggttactacttaccagtatgtataaaatcaacaagcggcaaaatactctacagcaataagactaaacggcaccagaacaagcgagcacagaacatcaacagaaacaagagcgcgcaccatcttattttgcccgtgtgctcatcaagcgtgaaaagctgctcaagtggcggcgaattcgactgcccgtgcagctccgggatcttccaaacagatgcaccatagccctcgccttccatccatatcataacataaagaaatttttagaaatttacaactagatgaaatgcccaatgcaccggcagaaagagagtaacaaagaggggaattctttctttaccagacgtgtagactgtggagaagaccctatgatcgaaggggcaagacttaaggtcccagatctcgtttggatggtagaacagcccgtcgcacaccagctcgctctccgccggtgaaaaccggatcaggtgcacctacttggcagcaacaacgagttagagatccaatcacaacgttctcttctacaattgctcgaattgctgcaacacacagggcagagccagagtcgatggaagaagacgagttggggcggagagccctccccccctcctccaggagacgcacctcgttctcctccttgagactgagggttccggcgaggaaggtggtcgacccggcggccgcgcgcacgtcggcgatgcaccgcgcctgcaagagtggggtgcaagggtgaggggcgcccccctacgggagactgttctagaaggttcgagaaggcttgcctggtacttgaggccgccgtagacgatgccgctagatccgccctgcattctcgctccgtccgtcgccggcgagcaccacggtggtcgacgggcacggagatcgcggaatgcacggagacgagcgagactacggcgacctggcgccttctacacttcttatcgagaaaaagaatacgtttcgtacacatggaaacgaacttcttgagaccgtgtccgatatggtcaatggtttacgttttctacgtatgcgaagcggaaaagatttggttagacgtgagcgttgggaaaggtaggtaggccgttcaaataggattcggctccccaatacggcccggcccatctacgatcgcctagtgtgggcccgcaaggaagttacagtccgttccggacttgcggcccatgcaatatgggccgcacataggccggaaaccccttacagcctgagtagctgggacgcctagcacaagcccacaaacccaacagccatcgaccatcaaagatatatcggccaacagcttgctagctctagcttttcaaaacttttttccatcaattatttcgattttcgaggtgtcacacatttccttctcaaaatttcagcacttgttctttatgagaagaaagcagcaggtgagaggagtccgggctttctcaaggttagaacgagtggacgacgtccagaatcattatcagtgccaatgcggatctagaaatttgtgtgagcctgttacgccaacggatatataacaaatcacacataacttcatagattgtgtaccatacaacaacttttttatctattctaatttagaggaaaacatggttgtgtttttgcaggctatgggacttagtaatttattatcccgaaaagagaaaaattataatggtgctagaaaatttactttgctttcaggttgcagatgtctaatagcttacactcaagtaatgggtacaacaatctagctagtaaataattctggtgcttcaggttataccctagatgattatgtctaacagattattaaaacgtacttatactactgcatgcagcatgctagttattgtatgctgtggctaagtatgttctctaatacttatacacgttattaagtgtcccaaccaaatagtgtgcttatactgcttcatgccgtggctaagcaccataaattagcactaatcaaatgatgcttgcggcgccgaagcccgggcaagtgcccagggtcgccgggccctagctccgccgctgatcattattgacagagagtattattgcaaagtctaaaaacagagtaccaccactactctatatcaagcaccgtcactttagagtaagcaagataatagcctgcttatgtaagaagagaaggactagagagagagaagcgagcgactattctattgccaattcaagcgcgcgcgcctatgcacggttactgacatggacccgctacaaatgagaacattgttgatgacaaccatgaaaaacagaacaaacaatgtacaacattgggtaactcttggcgtgatgcatacactctcatgtttgttgtcccaaaggaggcaatattgttgtttgtgcaatgatgtcaccactatctcagtatctctacatcacatgggtcaataaaagctgacctgatgcgttttatctagcctttaagtgtctttgagtgctgtagaaaccgatgattatttaagtgacctactcactctcccttcacccatttcttctctaactcattaattttgtcatcgcaaatgtaatatagccacctgtatattacttggatactaaggcacccgcaatgattatctataagctctctacaagagatccatgtcagcatatttttctacttggaagatattaaatgaagagagagagagcgaagctatctactaacatagagatagtctatagagaaaaacgaggcaatgcatgagagagctatagatacccatgtagacatactattgaggtggtttactattaatctagtatattgctgagatgtacatgttttatagagaacactttactttaccatcgcgggtgctctaatgactccgtctaactgtaaactgtttgtccacgtattccgtataaaaacggttaaaaaaaaggaagcagagggttggtttggtttgtg

SEQ ID NO: 25485 - DNA, 3588 bp, Oryza sativa
ccaaaccagcccagagtcgggggttgctagttggcgcgcgcaccagctgctcccggcctaaggcccatcagcccttttttttcgcgatttgttttttctttttcttttgcgattgttttcggtttttttcgttttctttcttattactttttttaatctttagcacacttatttttttataaaatgttttgagttgaaagtttttaaatcttaacttgaaaatttttaaatttgatttgaaagtattcaaatctcgagttgaaagtttttgaatctgagttgtaagttttcaaatttgagttgaaagttttcgaatcggagtcaaaagttttcgaattttgagttgaaagtttttaaatctgagtcgaaagttttcatattttttcaaatcttaacttaaaaattttcaaatctgtaattgaaagtttttaaatctcgagttgaaagttttcgaatctgagttaaaagtttttgaatctcaagttaaaattttttaaatctgagttgaaagttttcaaatatgagttgaaagttttcaagtcgaagttgaaagatttcaagttgaagttgaaagttttcaagttagagttaaaagtattcaaatctgggttgaaagtttacacatatatggaaaaattcggaaaaaaaaaataaccgtgtcttgccgtctattgggccgtgtgggccggcgcgtgcgcgccaattagcattcctgcacagagtccacgtctgcggtgaagaaaaaaaaaagagagacagaggaaacaggagggtgacgtggacagaacggatgacgggatggcggtagacgtggcgcgacggccatcggctactccgcatcccctctccgccactcctcgcccgcctctccccccaaccaaaaacccaaccccgacgacccacgccgccacttctccacgctctctctctcgcgcgcgcaaatggcgtcgtcgaccagcctcgccgcgctgccctcgcagctcgcctcccccgcccgccgcgccgccctctcccggtccgctaccgcgcggccgcgccaccaccaccaccccctcctccgcgcaccgcccaaaggtacaatacctatcccgtttccgccttcccctcgcctgcagttgcggatgatcgtgtgaggtaaacgaagtttggggggttctccaggctgcaggctggtggtgacctgcaacgcgcagacggcggtcccgaccagcattgcgcagggcacgcccgtcaggccgaccagcatcctggtggtcggcgccaccgggacgctgggacggcaggtggtcaggcgggcgctggacgagggctacgacgtgcgctgcctcgtcaggccccgcccggcgccggccgatttcctccgcgactggggcgccactgtggtcaatgtaggtttccactgttttccttgctgctatatcaacctcactgttcaatgtttatccgcctcatgcccatttctgtttgctgatttaggccgatctcagcaagccagagaccattcccgcgacgcttgttggtattcataccgtcatcgattgtgctacagggcgtcccgaagagcccattcggacggtatgttgttagcatttctttaagcataatgtgatacttctgtattcctgtcctgaagttgattcttgctgaagtgtatttgcactattgttgagtcgtgactaaagctaatcacattgcttttaatatatcacgtaattgtgatgtagtccttatactgtgagtcctgtgacatatatgctgtagagtcgttgagtgaatttggtttccgttttgctaatagttgttctatttaggtagattgggaaggaaaggttgctctaatacaatgtgctaaggccatgggaattcaaaagtatgtgttctactctattcataactgtgacaagcacccggaggttcccttgatggaaatcaagcattgtacagagaagtttattcaggatgccggtctggattatctcatcatccgtttgtgtggtttcatgcaggtaaatgtgttccttctgtggggttctatatatttggccaggaaattgatttgttttcgaatataaacaagggtagttaattgtttcctgaaacgaattctgtcaaatgttggtctgagtagggcctaattgggcaatatgctgtgcccatactagaagagaagtcagtatggggaactgatgctcctacccggattgcttacatggatacccaggtttatctttctccttctccattgaaagatgaatatgtgacctatttgtaacattatctcttcaaagtcccttcctttgatacaacatccctcgtgtgattgtaggacgttgctcgactgacgtttattgccatgcggaatgagaaggctagcaagaagctcttaacttttgccggaccacgtgcctggacaactcaagaggtagtatactgtacactgttctaatgacgtcaattctttttttaaggatgtaaatacatatttggtttccatgaataaattgcacagcatgtttattcttgactggaaatatactccctctgtcagaaatatatgtcgttttgcaaaatgtgcagctgaacttccttatctttgtccaccaacatatcaaatggtattaggcttgtcatatgtacatatttggcttccatgaaagcctgtcatgaaaatttttgctggaattttctgtggcgcatctgttttagttttccagtgtgtgtgtgtgtttatgtggtatattttggggataggaagggcttttaacccctaaccctccccttgtagtactatattatttattcttaatgaaatagcacagagctcttctgcgtgttcaatggaaaaaattgcaatatactaatttatgttcacaagcatattcatataaatgtaaaggtcaaagttgcatgtggagactatattgttgtccaaaatgtcatgaattcttcaagagatgggagtactaatcttgtatttcctgctcttaatttcgttttcaatgtcagaatgtaccaaatgatggcttctgagagttggaatactatcatttactcaactattgtattgtttttttactcaggtgattacactgtgtgagcggttggctggccaagatgccaacgttactactgtccctgttgcagtgttgagatttactcgtcagttgacacggttcttccagtggacaaatgatgtggctgacagactggcattctcagaggttacactctagacttatctaaatagtgcacttgatttttcagtaattataaaattgtcaaggcttatgaaaattaataactagtatttaattgttataattcaggtcctctccagtgacacaattttctcagttccaatgaatgatacataccagcttcttggggtagattcaaaggatattctcaccttagagaagtatttgcaagattacttcactaacattttaaaaaaattgaaggatctcaaggcacagtccaagcaaactgacatattcttttgacaagaaggatatctacaatcctatggatatattttctgatgcagatctgtgcttcaaaacacagatgagtgaatacaaattttcg

SEQ ID NO: 25486 - DNA, 25954 bp, Oryza sativa
gcttgaatggatctgatttgggggaagaaattggcgctagggttccggggagagagagacgagccggccggctggaggtggagacgcgcctgacaggcgggtcccacgtggggcgcgcgtgagggcgccgccgcgcgggggagcgcggcttgggccgggaggcggcccaggtgggatggggcggggagacttgggccggggcaggccgggaggagaagaggggcagtggccggcctggaaggagggaaaaggaggaaggaagaagagggagaggagtaggactttcggccgcgggccgaggggagagaggaagactttgggcccaaaggaaaggaagactaatttttagtttttctttttaataaactgtgacaattgtttttttttgcttaataaatattttcggtgctttgaaaattcatgtaaaatttgagggatccttttaaaccaaggagaatttaagaaaaatacgctggggcacattcaattttttttcttgtatgcattttaatgtttgccaattttttttttcaaattttaattaattatattattccttttggagaatgatttttaattcgggatgaatttatcaggacgtgacaaatcctcccccattacaagaatctcacccccgagattcgagaaggctacaataagataggtagggcggtcttctcttctttgtccggcttcttctgttgtatcttctttagcaaacttgtccagcaaaactacccaactctgaactgcttggtttggtctctcggtgcagacgaaatattctcttcgcctgatcttgaacctggttgcacctttagctgatctagactgggttgcggtacttgtagatgaggcaacctaatagttgtggcatagaagggtgctacctaaggtgatgtttgaatctcccgaagatgaagataaaaatgaagattaagtgtaacgaggtgataataacgtgtgattaattaagttttaattattacaaacttgaaaaataaattaatcttatattttagaacaactttcatatagaaagttttcgcacgaaacgtactgtttagcagtttaaaaagcgtgccactttaatctaaaattttatccacccatttcagtacattcgaacgggccccttaacacacttaaaaaactatttttttgaatactttctatctaaagtttatttaaaataaataaataaatctatttttttaagtttgcaatagtatagtgcatcgtcgagtccttaaacttgtacgatcgtgctatttaagtccctaaatactacaatatatattcaagtttgaacttatcaaagtatgccattctggttccaaaccaccatggcctctccgagatccaacctagcgacgacgtgacatcatcactactctacactcaagtagagcctcgatgtccacatgaagaagaggagaaaaggaaatgaaaaggaaaaaggataataacaaaatttctgaacagaccctacttgttagtcatcgtaacatcggtgaatatgccatgtcagcattcgtctaacgtgccatgataacgccatttaggatctcgaatagaccatgacaattttgagaccggaataacgtactttggcaagttctagacataaacatatatcttgagagtttaaacatctagattatacggttgtataaatttagggaccaatccaatactttactctctaattaattatgcgcaacctaggcatatattaacctctctaaaccgcgtaggatcgctgaaaatttagagcatcacatcagccattgttttgcaaaaaaaaatcctgtatctcaagttaattatgtatcgatcctcgctacccttcaccgatcctgggataggatcgatctgaccgtacaggtgtcctgttctacctagccatatattaaaacaaggagagcggttgagaacaagcacttccgaacgcagccttaaaatgattttcacttcaaaatgtaaatctttttttctgttacagttatgcaccacccggaattgtgaacgcgttgttgaacaactctggccatcacgtgccttgggcagaacaagtacgctcctgatgaagacccggagccccctctctcactctgatgaagacgaaggtccaaggccgcggataaagacaagaccggaagccgcggcaacccaccctctgcaaaatccccaaaatacccctacaaaaccccacaccgaaagcagcaaaacccacctgcccactgctcctccactcccaccaccaccgccaccgccggcgagatggccggagcgagacccttcttctcgccgcacgaagccttcgcccgagcctcgacggcctcctcacccgcggccgccgcgaccgtcgccgtcgcggcacctgctccggacccaagccccgccaccggccacgccgatgctgccgaggtcgccgtcttccgcctgctcctcccccaggccttctccgatgccgacgccatgcgcctctacgccgccatcgccccgctccgccgcctcttccccacgctgcaggtccgcgtcgagaccctcggagtcggagcctcgtccgatgatgccgacggcgacggcgacggcggaggtggtggtggtggtggtcgcgtcgccgtcgtcctcggccccgcctccccggcgcgccgcgtcgaggcctcctcgtcctccggggagcccctcgagctctcccccgcgcaggaggccctcgtcgccttgctcgacagcggctgggtcgtccacctcaacggcgaggcgtggggagcggagcggatgacgtgcctcgtcctggtcgaggccgggcgcctcgaggcggcctccgggaaggggatcctgtggacgatcgccaacgagtccggcgccgaggtgcgcgtcacgccgtggggtggtgagggcggggcggcgtacgcggcgcagccgcccgaggaggtcgtcgaggtataccactctcactgcgcgtaatgccccctgttgcttcgattgttatcatacactgttgcaaaattgaacctacgttggtttctgcggcaattgggcaagtagagattaaacaatgtgtgggcgtgcttgtttacgtcaagggcttagggggaatttggaagatagcgagtgcagcatgttctacaggtgccatttcagggtgaaaacgcaaaaggatgacacttttttaggggaggatgagcagctgcatactgtggagcctgaacaatcatgtggagacatgcatgatgatttatttgtgtaatgtttagggcactctcatgaatgcattctaagcaagagcttggcacacttagcaatgcttggcatgtgatgtgcatgttccttatgtgatatccccatctgtgaaaaagtatgttcgagtatttccctagtgcactgtttactgtcttgaactcaatccttttttgagttcttgtttcatgcgtatgctttggatttattgtgatataggacggtgaagtttgacaagagtccatttctgtttttgtttcaacagctgtatggaatatatgaaataattaacttattaaaggattgtgtgtggataggttatctacacaactgataaaccatatgcttcacaaacacgctcatccatgtctcatggtctcatctgtgaaccacttcagcagtgactttatctaagtggcttctgattccttatttgtgatctgactggtgaagtagagtataaaattattgatgtgcgttatcagtaagtccaaaatgaataataaggacctttttttattttatcatgttctaattaatatttactgaactgctgttaatggaagtcatgtaaatcattcgactaatttttttgatgagtgaactgcgtactggagacggttaagaagtaacaaacaaaaatgttgctagggattaactgtcttttccctgttctatgtattttaaaaaataggttatttttacctcctttgtgtactgacaaaattttatgttgtttatgttaatctacagttataattcattgcttcttgatgtaacttcagataacaggagatggaaccactgtaaggagagctcttgtttctgtgtctagctgtcttcaaggtgatgggccacttggcagctcaacttctgctcattcagtgaacccaattctcacacaaacatttccaaaagtgcctgagcctgaaatgggatctttgtattcagatatgtcaactgagcgtgcaaacaccagcattcctcatattgattgtccacagggtgctacaggaattgaacaaactgaatgtgtcatgcaattttcatttagactactctgccctgtaactcttgctggaggtttgataggaaagaatggcatggttatcaaagcaattgaagttaactctggtgcttctgttgatgtcggtggacctgttcatcggtgcatggaacgtgcgataacagtatcagccttggaggtttgaacatttccccataaatgtttttatgcaccatgtttcattgcgtgatgtacatagcataattttgcagcttttatgatggatgtttaatgtagaaactcttttgattttatattaattcttgtgagctttgttgtgcatttgattcattataactatggtttcttttcactcatgtagaaaccaggacagaaattctccatggtggagaatgcggtacttcgtatatttgacagaatgcaggtggtggaaagcaatatgcattcgagacccaataatccattgcattgctctgccagggttctaattctgaaaggccaatttggttatttagttggtccaggtggttcactaatcaagcatatgaataacacaacaagaacaaaaatgaaaattttagaagagactgctgttccagcttgtgcctcacaatacgaactagttctgcaggcaagcacttttctggtataatacaaaacagtttttgttgtacttgtttctgctttcatgctaagtagagatgtgagaagacggtgacagtatttagggttaacctgatgcatctaatcttaaccatctgatcctcttaatttttgttcaaagagtactcaatgcatagaggcatagactcagtagttcgcttcaatttttcacttctacttctcttaattcatgatcggttgatttctgatccttacactcttactatgttttgacagctcaatacttatttagtttggtattttcttttctctacagatcactggagagccaatgaatgttagagacgctttatctcttgtttgtgagaaactacgtaatcattgcttctcttctgagaaaacaacctacggcaatggtcatgttccctcatcggctattgatgaattaactacaagcagccaggttaatatctcttcaactggtcaatattcagctggcaatttgtcaagggttgatcacaggctttctcagaatgaaattgactcggtacaaaactctatcagcgccttcgacttgggatgtttgggctccccacaaattcaggttatgtattacataccttttccttgttatacatgctaaagtttctcttccttcctggatttgtgtacgatacatgcatattatgttctaaatgtttaaagagcaaaactaaatcagatgttgtacaagaaagttacatattactaacctatcaaaaactaatttgatattatgcatttggtaaagttgcaaggatcattgtagtggtctggaatgcctgtgtgaagtgtttctacttctgttgaattcttatattatcaaatttacataatttctatcttttgctgctgtgactgtgagcaacataagttgcagtaaagagatccctggctgtgttcttttggctgtgttgggaacaaatctcctgtgcacggaaaacaaagtgatccattagcgtgtgattaattaattatctattattttttttgaaaatggatcaatatgattttttaaagcaactaccgtacagaaaagttttgcaaaaaaacacaccatttagcagtttgaaaagcgcgtgcgcggaaaacgagagaggtgagttgggaaagttggggaaagaactcagccaaaactggatatttaagatatctgtcatttttttactgcaagtgcaaaccaagtcctagcctaggtgctaatcaaacttatcctctgctaatgttttgctcattataaaactgtcatatatttgagtcattcttttatagaggacgagtgtttggaaattttagtttcactcagagctcactgctaaatagatcgcatagagcactcatgcaaatatttgcaaagtgactagtaccttttattgctgaataggacacaatgaaatatttttgtccaattatgtatcctcctgtcactttgcagcctattataaattttgatgcacggtttttctgtggaagtactaaacaaatatttggatgcagaaacctaccattgggtgtggcactgagatcaacaacccaattaatgaggtggagaaaccagctaatggaaatggcactggaattaacaatttgaatactgggatgcagaatgaaaatggaattgacgtttcaaatcatggagctacatctctggaggaaaaaaaacttttgaggtaatagtcatatttgtttgtaacccatttctacccttgtccctttagaagtggtcattgcgtaagattattttataacagatcctgtctatggcacttcaatttttttcttgtatgtcaaatcacaaaaaccaatatcgtcttgggttcttattccattttagcataattgtcagctatttagtatcatagatctttctatttagagcccaagacgctactagcaccctgccatttacgtgagggatgcactttactgcttagaatgttgtatgtacagtcacaggaatgcatttagggttgctggatgcatgtactacttcatgggtaatgtgtttacagtctcaagcgcaggcctggattatcagcaaactcactgtttatccagaaattaatgcttagagcagcaccaaactgttgtattcaaatttggtcttatattaatagtttgtactattttattatgtcttgttcttcaagtcctgtacaggaaacatcccatggcaaacttcaaacagaatatctattttggtccaatggaaaacaatgaatagcaacaagtattgctgtgcacgattaatcttctgtgctctagcacccttgtagttgtgattgaactttagcaattcaatgtattatatatgcgtcacacaagtggttccaccagttatgtgcctaatactatatatttttataatattttgttcttgatgaagtaatgaatttgcaattggtactgtacatgttttgaatatagcatgcatgtcttagttaataactagaagggatcaacaaagggcaaataacatcagctgtataaacttccattcctatatgtcacattcctttggttattttacataatggtttgtgcatttattgatgctatgctttagtgacctgtaaatggcactaactacaattacaatgatttctgcttctggccacagaggaatcaagactgccaccataactaggatcacatatgaggttgctgtttgcggagataatggaaacgacttcactatgattagagaggtattaacggagaattatgtgatcgtgtatgcttattttgattgcctttgagaatttacttcaaataaatgctggtgtttctgagttttatttttttaaaaaaaattgattaaatgcttcctggattgggaaaaagaaactggttaagtcattacgttttgaactcagaactgaccttgctgatcatgtgtgttttcaaaatgctgtactggtctggtttagtaaagacacctagttcttcattctagaccatttaaatggtgtgcagctttaggtgttccttgatttggaaaatctgaagaaatttacatttccagcctctacatctatgatgcattgatgcatatgatgtacgtagccattaagtttgagattaaacaagggacagaacctcccaagagattaaataagcaaaacacgagattaaatttacactgttagggcctgtttgatatggatgaaaggcgctctaccatgatgattaaatattgtatattataaacctaacaaatactagcttaaaacaagtggtgtaaacaatgctgatgtagaaagtttttggagatatcatacttttggaagcataccacgaataattgcaaccattaatctaagcatgaagcctgttactagcttgttgtccaaagagggtgaataagcccctagaggatgacgatagactgttgtccaaagagggtgaataagcccctagaggatgacgatagactctaagagtgtggctgcgataagcataatatttttgttctctttgatactgcctcgaacaccatacacagagctagctgatattactaggaaagtatttacttcaattatcctttgtgtttttgccagttctatttttctgtgtttctatcccaactctttcattatatgtccgcgcaatcttttttctttttggaccagtaagttcaaaatttattgattgccttcgaagttacattgctgattttctactctgattggtattgaactttatggagctaatctaccattttttattttgtgaatactcagatgtctggtgcagacgttactgcccactacccgcttccagagacgagtgacggtatgatcgtgatatctggaacgccagatgaggcgcaatcggctctggccatgttccttgaccttgtcaaagaggggcagtgatcatcatcagatcttcatgcattagccctgattctgctaacatagatcactgttgggatggatctgctaacattttgctgacaccacgagatgttcttgaggttaactgacaacattttatgtgtaactatgtccagtaacgacaccacgagactagggttcatcacgggacaccacgaggcagacgcattcctctgtttgctgaatgtagcagcagagcaggcgcgtgatttatttatgtttctttttctttttacttaatccttttgtgctcttgctgctgggggaggccttaattgagatggatatctgcctatttttttgcatgccatttttcccttgttgacggtgttgagttttgtcgcgcccgtccaggctggggtattacagttggtaacttgatggtgagttatgtagtagcacacgggggtattacaaccttttgcctggatctttcggaagatcggagtaagggtaatatttggaggttggagcaatgagcaatccatcgatacatcgcaggctaaggggttcgggtcgattacctgcttagagaatcaaattacccctagctaagcggcatgaaaattattcagcctcttgtgctcgagcgtttgtcctgcaaacggtgagtgaaagatatcacgaaatctttcataattatatcatcgagtatttaattatggtgatatgtgatggtatcaccaaggtatcagggcacctcatgacatcccatggaatcatgaattcatgataacacaaaaaaaatatgatgggagaattctcctttgccactcattgcaattgtactctcttcctcatccaaatctttccttccgtttctttacctttattttgttagtgtgctcttttgttttgccatggctgttaggtcaatagtaattcgatctttaacttaattcttaaaagaccattatgtcctcctagtccttgtagatgttcagtagcacttgaattttagcaaacaccaagaaaaggccaagaaatccaaatatcggccactacaaaaagattattagaaaatatataaaaatgggcattacgacgtaattatttttatcctaaaatatagcaacctagtcctgtattgaacacaacctagttgacgagttgttctgtgtctgcctaccaccacgccatcatcgccatgggaacactggctgctgcccaaacgcccctctgcatgagggtgcccatgcacaccccctcactaccacataaactaccacataaacagatattattgtcggctcatcactgttggttttatgataagtggatgccagatcaaaagattaatttttggaaatgaactggaagtgatgctagtatccctaccaattcaactttcaatgtcagttcatcacattaatcggtagtgataagtgaccgttacatctaaattaaagggttaggattcactgctctaatttatataaattggacaaattgccagtctcactgttccatcctcctctctcccctctcatcactcctctcaccctcatatcccctcccgtcactcctctcccccctgatttggtcggcggcacccgccaactcccatcgtgccacccactgccatcccctctatcagagaaatgagaactagggttcccacttcctcggctgctcgaggtactgcggagtagttaacgttaaaatttggtacggttctttagtgaattcagttaaggaaagaagtccttaatcaagattgaagtagatggaaattaatcgagatcaagctgaattcaaagatgactcgtgaagaccacgacaagtcagtttcatatttagtatatctcttaataggcaggttaaattattttccttttcttgctaggagtcatatctcgtgtccgatcataacttgtatcaacccgagggtatactatgtacaaccagggtctttgtaaactatctccatagatcaatacaattacttttggcgcattgccaccttttactctcaacgagttcttagtttcgagttggactacatctgtttcgatctcctgcgatgaagtaagtttcgtcaaattcgcttgtatcggcatgtttagaactttttcggttaagtccgatattctattcaggttgacgcaagcgttgcctatatcatatattgattctatctttaattgtaccattgtttagagtcgtatcggcttagatagaactttctcagttaggttcgatattctgattaagttggtatttctctaaatcgtactactattttaaatacacttattatatcctttacatttgtgtggatctatcggctaaatagttttttcttattatcttcaatcttatactgtgtcagttagatccgatctattagattgctattaaaagtttatttctagtaagccgatatatttttatgcaatgttcaatgagttatcttgttactttctctaagtgttctattgtcttatactcaaatttgtatagtcactagttaaacatctctatatcaactttaatcttattctgtctcggttaggtccaatctatcaagattgtctttgataaagaataaattactaataattatgcattttttaattcaagccgatgataacatgaatctccatcgagcctatagccgattgatcaaaaccttgttgagctggccttgctacatcacattagcctattggccgatcggctcttggttcttatactgtcaatccatctatcttgttagttgcaggatcaaactaactagtatgtcttaaacccaattgattgaacctacactataaacccaattgattgaacctacactgaagctaaaaacatctctcgggctttcatgtgtggcgacgtaattgcatgtcaacaggagttcaccaacagccactacagacttttgtgggggcccaggaaaactgcgtcgagacaagcaaggtgactgaggacgtttcagctcgggcccgagtcgccatctgctcggggccatgacggctgcttcaactgctgcaagtgggccacattcctctttactgttgcatcaagattacatcttggcaacggattatggcctttggccgttgcagtattaccccgtctatacacccaaccagatatgtgtggtcatttaaattgggaacttagccctataaataatctaatctgaaattcactcttatgaagatttgcactcaggattttgagatactactaaggtcactgcaatcactagactacatgccctttcgcaaaattgtgatttacgcctggggtagtcatgcatgatcatttgatttatcagctctcttttttttacatggcccttttcccttgctgataatgtttattgagttgtcttgtgttgccatacagggggttttcccaaatttacatggatattattctttgagaaggtcagtttggtttcacttacataatagagagtccagctcagagtttggacgaatacatccaaaagatcactaacagagggtattttcaggaagtttaattagttgaggggatgcggttacttctcacacgcattgtccgctctcaacattgtgaaatgcatttcgaagctaacccacatgaaggatgaaaatgctttctattgtgtgggctatctaccaacacatcacatatatttaggaaaaattctatatacacccctaaatattagattgaagtccgtacacaggggcgaagctacattgatgagggggttcctaggcacctggttcagaaaaacttttaacctgtaattagcccacactcaccataagtgcacccacctcggaacaatagtgtgtaccctttcacaaaataatcagccaagcaagacaacaagcaagtagccaacacaagcgtatatgctcacagacgtagccataacaaatgtcgccgccaccgcatgtgttgatcaaatcacaggggggccatgcgtgatgcccagcagccaacctcatcaagcctataccttaattacctcatcaaatcttttttgtcactgaacatactaaccaatattatcatttgggttttccgttttggtaagcactttcatcgctagaattttatttcctacatcactcttcttgcttatgtgaaactatcgatgctaaaaaataatactgtgctggtattgttatagtgttgtatgttgtatatataataaaaacatacaccctccgtcccatacaaagcactggtttagttccaaaatttttcttgaaacttccaactttttcatcacatcaaaacttttctatacacacaaacttccaacttttccttcgcatcgttccaatttcaaccaaacttttaattttagcgtgaactaaacacacctaaaacaaagttctagccagtaagctagacataccctatatctaaattcgtagtcagaagttgatttttttaaagaataaagcaagtataccactaaaaatagtggtgcacccccctccattttgcgctggcttcaccactgtccgtacagtaccctaaactttaaaaccagagatttaaccccccaccccccaccccccccccccaaaaaaacattgcaatgccatttatattaccccattagatactttcggatgatggttttgtgcaattgaaagcttaaaagagcagttttaaatagctagtttatcgtattttacgtatcattgatcaccggtcatcaatttatattctcccatgatgtcatattaatattatatcgacatcgtttgtaaatgagagctaaaaatattaggtaaaaaaaaggtttaggtggagattttattatatatgtcaatacatatgtcatatcgataaactcatccgacgtatatgcaaattagataaaaaccactttttcctaagaatcgttaagccaaataagaaatgaagatagacatatcattcataatattcataatattgttgtttggtaccatggcatattccaggcgcacaaggtacgtaccaaagtttatggcaaatccttaaattagtccatcataataaaaattcctaacccgctatagaattcctaacaacaaagaaagcaagaagtccaacccctgacaaagagtacatcagtgcaaatttgcttgtgctgcgttctgaaacctaaagatcatcccattaacatggaatcgtcgcgccgtgtttggggtactgtacaagtaaagtctagctgatgcgctaggacaaatttgatttgctgttcaaaataaagaaaaaacgagttaattttagctttgccaaacactagttagatcgccgtcgagcccactcaatggccaataggatccgcattttggggagaccctcattcacatcctccttgtctatcacctgattctaaaatgaacttgtcacatcatttcgcttattcgcgagtaagcgaaacggtatatttgtaaacgaaaagtaatttatgaataaaacttttatatacgtgttcttagtgatctagcaacaaaggctgaaaaataaacttcgatgaaaaaacctcaaaatcacctccaaatttaaggttaaaaatttaatttttagctgataagcataatgatgagcgaaaagatgaggtccgattcttttagtgaaccagtttgctgacaatatgattgaatacaagataccaaatgaattttccaataaaagataacacagtagtgtatttgtttttcttgttacccggccgtgacatcagtatcgccactacgaggtaaaagcttaataaggtcatgttgacttcgaattaaatttagaaatatactgttcattcattttatttttagaaatattcggaatttaaaactttttaaaaaatataccgtcgatctcgcacaaccattacgcgaaagtgacgtggacgtgatatcatgggcggtatcacgctgggaaagagcgagaccgcgcggtctcgcgaaatggaagagcgagaccgttcggtctcgcttaaccaatcaacgataccggatttcaaaatggttgattagtgattaattaccataattaatgattaattaattattaattaatcgctaattattattagttaaataattaattaggtcgttagtcactaacctaatgcagtttaggacggtgtcgctctctgcttgagcgagaccgctcgtccttcccgcgctctcgccccgtcgccgcgcgagaccgtgcggtctcacgccctagcagcgcgagtccgcggggtcttacgctttctccgcgcgataccgtcctcaacgtcacctctgcgtcattttcgctcaacggtagagcgagatcgatggtatatttctacaataaaatttacatcccgaatatttttgaaaataaattgaataaataatatattttcaaatttaattatgttgacttcaaacttacctgggtatagacttcaaacttgtcctcttttaaggctgccttagttctggaaaaaaaaagaggctgccttctaattttgtgaagaacctgacgattctcaaattgatgaactcggcacaatgttttgaaaagttgaagcaaaaacagtcaaagtggaacaagccaaaccttcagataattctgtatcgaacagtttcgtaattttgaaaaaaaaaactaaaaatgaaaaagaagagaatatgtattttcgttgagttagattataatgaattgagatgcatatgtggttaaacctcacacgcttaaatgcatttcgaaactgacgcagctgaagaataaaaatgcatgctacctgccaacactccacatgcattatatatgtttactttttggatggttgcaaacatataaacttgttggtggcatgaaacagcaaagacaagaaaattaattctctgatgcgaggaaggttaggagtgcgtatcagatttaacaatagacatatatggttgattcagttcttacatacctaagattggtaacattcagagggtatagatagcagattgacattttctttagtgaagatttgttttgcaatgtgagttgaatggtaactgcacagaaaattatcacctaatcttagtaaatttggctaacaccccaaatagttacactataaaccaataaaaattacatccaattataacatgtaattttagtgacaacgggtttaatttgctcacactctcaatggaaattccatgagagcacacaaatcaagaagagaaaaagactggtgtctgcacatagtactgcagtttttattaagaagcaatcaattttccaccatgatgtgtatagcatgcatcttaaccgaataacttttttttaatttgaggcagttgaatagcaaactaaaaagcattcatttatgattaaagaaagcatatgataatatttatttatttattaattgaaataaatcttgtatgagagtacaaataaggtagacaaccctaccatttgagcaaagtgtagcaaataaacctaatagggagtgaggataaaaaagacatccatctacaaattaggtgttcactaactttaatttgttattggaaatacaatggtaataagaacaatagatacaagggtaaattgaatctataccattgcaaatttaccatattagataaatgctattaccattcgcgatatcggttgcgtgccactaaaattttgtaaaattttaatcataccactaccatccaattttgtatcatcgccatctatttctatccgttctctcctttctctatcgacattacggcgcacgttgtgcgccctatcgatgagcagatagcacaacgataaaaaaaagctctcagacaaaccaaatgatccgaggcaagttctatcgagattagataaatcgatgtaacgaagcaatgggagatagacataacctgcgattttctatcatagaatgataaaaacaaaagataatgagagggaaactcataaacaaattatcttatatttcactgaacaacattacacagggcacactggcaagatgaccagtaattatcaacagccaaatatacagagattgaaccgtcacactggatggcctcttttatttattcatcacttcatcccagataggcacgttggtgcttgctacagtcaataatctcttaacattagcagttgcaccggttgcacttgtagcaggagacatgggcaacatcataggagccagcagccacctccaacgctgcttcgccgtgcctgcaaaattaagcagacaaattcaggcctagaaaaaatgttatctgattcataagtttcttcagctcagtttctttttaagatgaaatatatgcgaattatcccttttcaggtgcaacaaaggaacatgttagctgaggtggttgtggtgttcttctccaccagatcagtgtactgtgtacatcttcctgaaccaataaaaaaagcatggcataaataaatgtaaagtaaccgatagtactgaataaaatgtcttttcatcttcatgcagctttatctgaagaaactttgaagcaaagggaattaacacacaacatatagtatatctttgaagcaatggaaataacattattttttatcatggaaaatatgaaatcacacatctctgaaagcttgtgtcagtttattttgacaaatcaatatctaaaaggcttacccgcagccattgccacagttgaacaaaaagatggatcagcagactactcactgaggtgattacagcaaagttataggcacacatatactacctgtgtagaagctggatcttcttgttctacctgcatagaatgaagcacatgcaagcacaggcgaggcaaatccactgcaggagagtgcaccccacattgtaaggcgagtgcttacccaatgtacatgcaacaataaaactaacggaaaattgcaacgtcgtaatcatagtttggttataaaaattaggcctttagctaaaatgctgaatgaatagcagaacacaaaacagcaaggttttgagaaatctaatgatatatatttattttgaacaaaggttttccttccctatgcatcactcttttccttcctgaaattaaactacattgctactatccactattcatcagctagcacaaaatcactacaatgtcacaggttgataagaactaatatttaggttctttatagtcgagcactcaggcaatggaagacaacttctattaaatgagtagcaagccagaacaaaagcttcaggaatattatcaataattcttatagcttatgaaatttggatccatattatgagaattttttaaaaaaagaggttatgtgtacacatagatcacagactacaggcttatattcatctactctgcaaaagaacagagttatcacaaaaagcaaagctctaaccaaaaactgcaaaactaacatagttataagccgacaaaataagctatgtttgtctttgctttatgcggatgtatctggcttctctatactggttttcttgcattatggagcattcagtgcggcaacaattcttgctccatctctgatatgacgccaccaccgctacagagcatgacaaagtgagcatagaggaggggaggaggagccaatgaatggcccaactgattctgacaatccagtataatatgagtaaggtagcaccattatactttgtcctaaactcctactaatttgagaagaggacctagcatgtgctaaattgcatcaaaccataaatccataaatttaaatggttgttatatgcctagtttacattattttagtccattgactgacaaacagacaactaaatctcacgtccaaaaagaacaacgcgtgtataataaaatgacagaaatgctaaccttgttcctactctaaaaacctacaatctttattagctcaagccatagacttaagtttcctcgctcttataaggcatatatccagatgttcagtattaataagctatcaaaaatctcccttcaaaaaaaaaagctatcaaaaatatacaccaattagccaagatcttgtgttgctcagatgaatctgatcccaagatcatgtggctcatccccagagagcatattgatgtgtactctcatccatagaatcctgagatcatactgatgcgtactttgatgtgatgcgaatttgcaacatacaaagaaaaacaaagacaaagcaactactctgccttgttccagcactgcaaccctggattgggcaccgaactgtcaaactcgaactccacgccactgcatcggttgtctttgctgctcaacttgctgcttacaatctgttctccctcctcccctcgtggctaggagaggagagaaacactaatctggccaagaaaaacatcatcctttatagttgggaactcgaagagccaaattcgaacaaattctctgtcgatagccaatgattcacatcggaaggggcagaacagattaaagggtcagacttgtgcaccaaattcaaccaatgggagcagctggaatagagaaccaacaccaaatccagccccgcaagaggaaagcatcacctggtagggaggaggagaaagatgcaccgccacttgaatggaatagcagtagtataccaggatgccacggtgcgccgacgctacgctgggctgccgcgcctgcacgcgttgcatccacgctgccattcgcccttgctctcgcacccagctgctgcgccgccgccaagcacccgcgtcctgctgcaagcctcaactcatctccaaccctagcctccgaatggatagtgatgctgctagccaccgctagatctgaaggtggctcgttctctgtcggggcagcgacgtactgggagaggggcaaggagatggaagaaggaaggtgagggcatgtgggagaggtcgtcgccggcggggaggcaaggtggcggccgtcgtgatggcaaaggagagagagcgagagcggggaatcgtgacggctagggttccgggaggtgagagttagggatacttttttgcaaaaagacaccctgcttttcatttttcagagcgcacttctattttctgaattttctctcctttgcataagatattgttggttatggagggcctttacgtgagaatacaaaactaaggaacccaagatgagggacctacaacaaattaagaataaaattaagggtgtttttgcaaaatagccagcttacgaaagtcccacgctccaagcgcgcgaggcgacgtggatagcgtgggaggcgagcacgcagcctcaaatcgctgtgggagcagcaactcagggcaggttttaatataaccgatgctgtcgcgcgcgcgctctctctctcttgtcctctgcttccaatccagcgccggcgagatgggccagtaggtagcgacacggacggccacctctcacattggccatgtacatgtattgcctgttataattgatcgaaggcgagtagtactctattgaaaatttggtcataattcggcgtattttaattcaaaaaaacaagataataaacatgatatttacaatgggatttgatctagtgatagtggtgaatgtaatcaacatgagcatgcttaacgtagaataagcatcaacaatcacataataacgcaatgttgacattgcgatgaacattaatagtaaaatttctaattgaaataatgtaagaaggttataccccaggaatggtcctccgctggagtttgagacagtattgcctccgttggtgttgacggaagcctccttctccttgtctctagtgttgccgttgtctccagtgtttgacatgttggtgaagacgaagtagacgttgacgaacagtgagtagtcgtgccttgcgctccccaaaaacctgatcgtccgcccgtccgtgcaaacgtcgcagcagtgcgtggtttcggaggcctactctcccaacgcgtgtacacacactcatcgggatgggattactgtagcagcaacagccttggaaatggatgaaagtgtgtctatcttctccttagggagatcaaatccattctcattttatatgaggaatggaagatgaagagtaagagtcatggaataagaagaggaatagagtaactaattctcatcaattagccatgaaccatcctccactgtacaaccatcaaccaaccatcaattaggagtaattgctgtaggttatcaatggaataggaagaggaatagagcaactaattatcatcaactagccatgaaccatcctccactatacaaccatcaaccatccatcaattaggagtaattgatataagttaccaattccctaatcaaattgattaattctcaaaactcctcatcccattgatatcccataagagaatgaatacacatgaattcctagtataatgagccttgaaatttatttgacttaattgatttaaatggatcaattacccaattaaatctaacactctcaccttcaatctttcatcaacaatcgatccggcgggcaaggcaggcaggacagggaatggctaactcgatcgatcagatcagtactgattgaaagcagcaaacgcaaacgtgtcatccctgcagttttccgctagccgctcgatgtcgtcagtggagccgcaggggagcgcccaaagcccgcccatggcgccggcgtaggcgtgccccatctcggagaggaccaccaccgccatcttccggaggactgaccatggagctccgcagcacgaacggcaccgaacacctgcagggcgagcttctccgctagcaagaggtgttgaataaaccccggcgtgttctagttaggatagttagttgagtttccttgttttcagctgagcccgagttttgggcgcgtcttgtacagaggctcgacgtgtgcacgttcacgcgggagtctggtagtcgtgagcgagtctcgcggcacgctcgagctgtgggatggcgcagttcgtgaagagcgtggcgtgcggtgcgcgcgtcatggccggcatggccatatgttttttttctcctataaatagcaagagctacagaaaacgcggtgattttttttggccgcaccaattccctgtccacgttcgtgtgtgttctgtgttgtgttgcagctcccggcgttgtcttcctcaactccggcgaccgctccgactccggcgagggtcggaacaagaggcgagtcgaacgggttcatggacaccaagaatccgctgccgcgcatttgcaccgtcgtcccagggcccggccccgagtctggcacaactggcaccgatgtcttcttctccgacttgcttctcgatcgccgtcatggcctgcttcagcttccctacgtacccttgtcgttgtctacctcaagcttccatagaaactccactgtcaccatccccttcaaccgcgtcgaggcactactgcagaagcatcttctttggtgagctcgagtgggagccagggtttgaaatttcagttcgaaatttccgaaatttcggtaatttcgcccgtcaccggcatactcaaatctcgcccgaaatttttggctttttacaatttttttgtgaatttggttaaattttattcaaattcattcaaattaagtcaaattttcaaataatttcagccagaaatttccgaaattaccaaaatttcagaaatttcgcccccccccctctcccacctgcataaaatctaatttcgaaattgaaaaccctagtgggagcagcgcttccctcgctaacgccctccttgccatccactgcatttggctcaacaaggtggagagagatgagaggaggggaggatgaaggaagaaaatagaactgacatgttggtcccatatctagggttattttggtatatatgataacagaaaatgatttgatcataactactattgatataaccgttactcacatcattgttcaactagaagacatcaaagatcaaacagcagaaactgtggaatccaattcggtgacctgcaacaatattgacttcaaatggccgccaaatgtgcatacgatctccattttttgcccatgagtacttgatggaaaactttctgagtcctcttttcaacggatccagcttcatcttcaaattccatctcagtcggccacaatcacataaataagatgttgcgttagctataatatgcctatgggcttgtaactttatctgggaccccggcccaagtggggcccatgtgggatgcgccccaactaagtggaacacgaccctagtgacccctatattgttctcccacctccttaaatagctaggtaccccttcagggtttctctgattttgtttagattaaagtttagccattactatttgcttgcagcgcgcatgtcggctagaccgcccatctgtttgtcttcgaaaccccaacttatcatttgtatttaattcctgttcgcaattcagattgtttttatcttattcttgtctgtttctttgatttgcttacaggaacaaggttgatctacaccagctagttcaacaacccacggagaggtgtatcaatcgctaaggcgcaacacaacaacgtcttgtactgttgtagtgggattgtcaatgtttctttgaaatcgtagttatcccaactcaccgaaagatcgggccaatcaaagccgtgagcgtatcgactggagctaagagtttatcagaaaacatgatggcaatggcatgatttcaatttgtacatattcaaatggcatggatacgaatatacgaataataatagcatttatctaaaatgatacattcgtagtggatgaatctaattaaccctaaatataaaaatataaaaggtttctgttgaattggtacaacataaatccaattaagaaagagacaaatattttcatttagataaatttaactgaaagttctttctttttctttaaagaattccatcttccttaaaatatcataaagtcttgaagcatccacctccttgttgtatgcacgggaaaatgtgtagtgcaaatcttggattgaaaaatagacatacgaggttcgttcacgtcattaaatgtaaaaattttactaataggtttactcataagtaaattttttactcatggtgacgtggacgaatctcagacgtttatttttcaatctaacggtagttttcaagtttgcactgcatatatatatatatatatatatatatatatatatatatatatatatatatatatatagttttcaccgtatggttttcctgaatgcactgctgaccgagcatcatctgaaggcacttcccttgctcctctttacatccttattattttcaaaaattgctatacggcaataatgttctgttgacgttatgtcgaagagtagaggcagagctagctgatattattacgtatgtactgtattacttaaaaatttaattatcattttgtgttattaccaattgtatttttctgtgtttctatccagctactgcactataggttcgcagttttttttgttctttaaccgagtaagttcatggtttcttgattctgttttcgaagcgacgatgatgatttttctggtctatatttggtttgattaccaaaacattaatcacaggtcatagccgctggtgtcgtgttaacaaaataaccgtgatctacttaagagttttttcccgcgcagataatcattaagccaaatagaacatgaaggtaaacatatcatattgttgtttggtaccatttacatgttccaggcgcacaaggtaccaaagattatggcaatttcttgaattagttcatcataatcaaattcctaatccatgctatccagtccctaacaacaaagaaagcaagaagtcaaaccacctgacaaagagtacatcagtgcaaatttgcttgtgctgccttctgaaacctaaagatcatcccattaacacggaatcgtcgctgccgtgtttggggtactgtacaactaaagtctagctacaagcgctggggcaagctttgatatgctgttcacaacaatgttctgttccccgtgaaaaggcaaaaacgatttaattttagctttgccaaacatcagtcagatagccatcgagcccattcaatggccacttgggtccacatcttggagagaccctcatcacatcctcattatctgtcacctgattctgaaacaaaaatttaaggatcatcaattatctcaatctcaacattattaagctggtatcagcagcatgaatatgactttaatggattctcatgcctgtttgtttggctattccgttctgactgttctctggaacatccttcacggcagaagattctggaagatcagaagatggctttgttccttctgctgaggttgaagcatccaccgccttgtctgtcccaggtatgcactgctgctcgagcatcatctgaaggcacttcccttgctcctcaattctcagctgcaaacttctttggatctgcagagcaaataagcattgaaccaaaagggttaatttcagaaagttcaacaccctgcagtcaacagcttggggaaatgagaagttcactttgatgttggtctagcttccttcataatccatgttaatcaactaggtaaggaatttggttacttcacttttaacgcatctcatagacaaaaacatctaaagcagacttagcagattttcaatgccctggcccctgttatggcagacctagctaatccatgaaactagtttttctaggaatgtctagtaaaaaggagcagagacaatgttcaacaacaggtttagccgactgttgatatgaaaggataagaaaaacagatgaaaacaatacaaatatggcaaaaaagtactagaaattaacagctaagttcatattttcctaatgagctgtgatgccctctattgcaagaacctacatgtacggaaaaaaaactaaaccctgaacaaaataataactgcatccatatgctaattttaacggttggtcttggtttgaaatacttttggattttttttcctaaggcatcctttttcacctaatactccaatcaatttgcttaccacatatgatgttaatggtcggttatataattcacaatagaaagaactccataaagcgctaattcgttctttgctttatatgcatggagctcaaacaagtcagcttacactagtactatatgatagcttgaagcttgcctactttattctgaacttcataccaaagcccttcccc

SEQ ID NO: 25487 - DNA, 1949 bp, Oryza sativa
  unsure (1)..(1949): unsure at all n locations
cacttcaatatagaacacagtgctgtaacgagtattgttgtcctattacaaaaaaacagtttgctgatcaacaaaatatcttaagcatttgatcaacaaattattccttttgttataccaagaaagccccttttaatggagaatctttcactgaaccagttttgctaatatatgattgaatacaggattccaaatgaataaaagagaacacagcagtgagatcgcaaggtagaagcataatgaagtcatgaagatttcaaacttaccctcctttcagatctattgatggtatgtcctcttttgaggctgccttcttttctgaagaacctgaaaaatctcaaattgatgaacatggcaataaaataaataatacatggcaacaaaataaataaataaaagaatgcagcaaaacacagaaaaagtggaacgtggcagaccttcagacaattctggtctgtatcgagctgttctgtatttctgcaaaataaattaactcaaaatgaaaagataagaataattttttttcacaaaaatatcatgcaatagggacaactaacagacctgaaggtgacttttaacatgataaatggtcaaattgtctgcttcattagctttaacacacccttgggagtagcttctgcaacaattcacaataaatgtcaatatgcataattagttcaatcataggagatgtaacatttcttaaagcaatacacactttcactgccaccaagtagattgacagatctacaaagcgctcatgaagttcangagtccatctcattcgtgtcttggagttggaggtattggaggcaccagagggcgagggtatagcaactgcagaaggttctcctgattgagatgaaactgattgttgggcagctgattggtgaactgcgacagatgattgcgcagctggtcccacctatatngaagataaatagagcaccactcaattacatgtggatgcgtctaaaagactaggaactaaagatttgcagtagtcatcaacaatgaatagcatagggcacttagggataactacatgtgacacatcccacagtcttaattcaagctcaactggaaactggcagcacccacccaaacaagcctaagcttatcctgatgatatcaaccagaaagaaatttagatatcatctcagggttaaaaaaaaaattcttggttaagctcaaaacttcacaagtatgtcaatattatacccttttctttgtttaaaaaagagagagagagagagagagagttccctggcaaccaagccgtcaagcaacttggtcgtataaattttagtttaaacaacactatgctattttagctgatctgaagtttggttatgatatgttattaaacctgttgagcttctcttgagcaaacatggagcctatttgagcttctgtcaagaaaatccctataattcatacttatacataataagagcagaaacctacatgcagttcaaaccaagtcaagcctgcccaagctcattcaagatgactctccacaattctacatacagtaaagtcatcatgttttttgcttggttatatggagccaggaaaactacaaggttgcagcaactgcatccttttatcttgagcataatcgcattttttaactatctaggtgtcaaatgcatcatggctaagcatgcccaattgaaaacatccaatctatagtaaacatttgttaaacaaagcaaagtgtagacgttttgcttgcatgtcacatataagaataattgcatttgtcaacgcaaacatgtaaatcttattggggtcgctagactgccataatgctaaagataatttattaagtggcagttttgagctggagatacgaagaacgaaatatactaatctgataaacacatcgtacataatatgcatcaaacacggtaatgtcacggacaattggatgttgcagaaacaaa

SEQ ID NO: 25488 - DNA, 16217 bp, Oryza sativa
  unsure (1)..(16217): unsure at all n locations
nnnnnnnnnnnnnnnnnnnnnnnnnnnnnnnnnnnnnnnnnnnnncaccatccaaatgttgtggccttctatggtgttgtgaaagatggccctggtggtaccttggcaaccgtaactgagttcatggttaatggttctcttcggcatgtcttgcagcgcaaggacaagtaactgcttcctgtgcttttttttaaaagaaaattaatttgctcgttttgggtgagtaacagtgtgctttgttttcttactgagcaggtaccttgatcgtcgtaagcggcttatcatagcaatggatgcagcatttgggctggagtatttgcactcgaaaaatatcgtgcactttgatctgaagtgtgataacttgctggtgaatcttaaagatcaatctcgtcctatatgtaaagtgagccacacttcatttctagtgttatagcactgttttataccatttattaaatagttgctttgctttttgatcactcagtggatttatcatctcgatttctgttcactgttcaggttggttgattttggcctatccaaaataaaaaggaacaccctggtttcaggtggtgtgagggggactctcccatggcatggcacccgaattactcaatggtagcagcaataaggtgtctgaaaaggtaaaaacatttttcttggttttcttttttcttcaattctttctagccatgttcttaatgttccttatgggtaatgaatcctctatcatcaatatgtgctagcacttaaaacaattccaggttgcagatttatatgcaattaattcaactatagcaatatttttagagttatgtttagggtactcagtcatatatttgtctacaggttgatgtattttcctttggcattgttatgtgggaaatacttactggagaagaaccctatgccaatatgcattatggcgcaattattggtatgcaattcatccctcattttctaggaattgtttgttctaatatgagaatatttcatgtgtttttctttccttactgagaaaactaaatattcgcctcctcctgtgaatcattgaacctaccccatgcttgtgcaaatttatattttttccttgaggtttgattcacctatgctactatctattcatagctgttcacggctccattctgacatatctacaagcttatggctcctgtcaccttatgtacaacaaagaagacaattttcccccatcttttgcaaactgtattagcttttctagtgtgggctaaatagtacacaaactatttaagtattaaaaaaacttcttccttttctgggcaataaagttaatcagaaaatagtgtatgatactagtattctataaaacaatcaattttgcatgcttcctttgctaattaggcagtcctgaaccctgctgtcttaaattccaagtcacaccagtattgtgctctggtactcaacaattcaacatgactaaataagtcttttgcggagcattgtacttccttgaattcagtcctttttgatgaccctagaactccccgttcttgaaatgttctcttcgtccagcaacttataatacgacatcttgaaactccggttgcagggggaattgtaaacaacacattgaggccacctgtgccagcgtcatgtgatccagagtggagaaggcttatggagcagtgctgggccccagatccatcacaacgcccagcattcacagagatagctggacgactccgtgccatgtcagttgcggcaaatcaggcaaaggcggcatccaaataaacggcgcaggtgggaatacttatgggttccagtttgtatattattatttttggttgagaatgtaatacatacatgtatttggttggaaagtaatacatacatgtgtgccctatagagagtggtttgaaagttaattgcttctcatgggcaaggctgcatccagttatataccgttttatttggggggttttatgatgtacaaagccttatttggatttggagaaacgttatcattgaaagctcctcgctcatatactgaaagctgtgctatagtgtactcaaatgtgaataagaaaaactatacaggacatttaaattctgttagcctcttccttttttatgaagatatatgcgagtttttgtgttctcattatcctttttaggtggttaactaagcgctcacatcatgtactttcaattgtttggcatttcattctcactgcagggtaactgggtaaggtggcctttccccagttttgagaagtacctctaattgtcgtcagctgttggttttcaatgtgtgatcttcacccaccttatttgacgccaaaaaggaaactacgaaatgagattcaatctgacagttgccattagtttgagactgagtgaatgagctgaccttggtgtcttcccaagaatagtgtattgagattggatttgcatcagtgcaattttttatttcgtctatgaaagtcaacattttaaggtactcctactccgttttttttcaagagattgaccagtgctattcgcaaaccgagatgatcaagtgactaatcttgttctgcccaaaaagaaaaaaaaaactaactagagcatgtgcccaatttattagaggcttatctcttccttttctcttttcatgtaaattgaatcatgaaatgagcctcgctaataattgggcacatgcttgcctaacaggctaacactaccaagttgcactgtccgagttcatcttgtagagtagaggcttatccacgcaaaaagagccaaagaagactcctagggttccaatctgtgcatctagccagactgcaacaaatggtgtaaggctcctgttttcactggtttccaccgaaattaggcagatgaaacaagcaaccaatatgtgatggcgatcatactagcggatctttaaattatcacatgccggcgtaaaacagtttttagtcgcatgtttggaaaggtggaaatgccacattgccagtattggaggacactttgctaccgatcgatatgttacagtaaattttgcccgtgctctttgtagatttactacctttggacttgacctagagatagaagtttatttacccttcagcgaaaagtaactttaattattctaatttactactctctttatttcaaaatataattttatatgattcaaaatttatacagcaaaataagtctttctccatctatacttctttatctcaataaattacaacaatttctcgtctcaaccttagtttctattaaaactctcagaaatgctcatatttttattgaaacagaggaagtaatttatattgcataccaaaaatgtaaacaaaatacccatcgacatagagggttgaagctgagatggacaagtctgtaatataatttaatctagaatttaataaaatggatttataggccatacacatatttcactccactccattcatatctagtactctactacgataaggacagtactacagacatagttaatgacagcatacccattcttattcgttgttataattaatctagtcaaggccataagctcactcaaatcttcaaaagacgaaaagaagttcactactctgattccgtattttccatgggtggtagcacactagtactactttttaaaactgatagccacataaaaacaaataccaaacaattggcgccatattttggagtgagcatatcaacctctctctgtgctatataagcaaccatcgcttccctcatcctccttcccgccacaagcaaccaagaaatcaagaaaccgtttcagacaacccactgcgctgcccgccgccgccgtctccggccgaggataccaacgacaacgatgaatcacccgtcctccgccgcgaccgccaccgtactcctcctcctcgccctcctcggcgtcgccgctggcggcggcgaggacggccagaagcgcgccgccggcgtgtacatcgtcatcgtgcagcccccggccgacggcgccgacaccgtcgcctaccacacgtgcatcctcgccgccgcgctcggcaggtagcctagcttagctagctgcgagcaccaaatcacccccaagataacggaaagacaaaaattgcaaaaaaaaaaaaaatcgcatcaccgatcgatgtgcatgctctgtttcaactttcaccgagtgattttaattaccctgtttttctcttaatttctctgcaattgcaaaagcgaggagagggcgaaggaggcgttgctgtacagctaccgggcggtcgccagcgggttcgccgccaagctcacgccgccggagctctccgccctgcagagtgagttaattagtttttgctgctttccgtataatccatcctgtattcctgttcctcccaactatgatgaactgatcagtaaactttatgtcggctgcagtagaatcttctccatctctcgctagtagtaaaatcttcccgatggtcttcacatgttcatcatattatactacacacgtaattaagcgcagttgttaatagttaattgcggcgaggtttttctgggattagtggactaatttttttgtcagaggaaagggccaaggcccaaggggatcctcttggcaattccgaggtcaatgttaggcttggttcagtagtggctctggctcacagctttgctgatgatgcactgcactcttccgagtgtttgaccttacctagaaggccgagaaaggtataacttcgttgagggtgtaatcgtgtaaattttcccggttttatcttttaactgaggttagggatcatgctcaccaatgcaaagaataaagtgcatgcaaaccaaactttgtggtctcttttcatgtttcctccttttcttttgctctttgcttgttatcccgttcctaaataaactttttgtgtgctactcattagcccaagtggataaaattattctttcctttgctgcatgtatatgctattaaaatccttggaaccttacaagattcactctttcattttattctatttcttttgttcagagcatcctgcagttcttcaggtgcgccctgatcagatgtatcatgctgtggacaacctcaactgaaagcttcttccctttgtgagagagagagagagagagagagagagagagagaggatgatacaaagtatagtgcaatactgaaatgttcttcatgcttctccgatgttggtgattatgctaatcgacaatctaattaggcagtaaagaaggctataggctctgttgtgaaagagtttcatgttattctttattgatcttctctactatacatacatcgaaatatatacagccaatgtattactaattgagggaataacaattacttacaatgttgttgtaattcctactttacaatgttgttgtaattcctacacatctagtgatatacaatctgtatgttagaacctataatggaatataatcttatgatggattgggtcttatttggcaacttaatccacaatattgacctgtggaatgatttgcacactagattactcatgatgtggcaattgtggctaatgcaacgagaggtgataagttgataacatttaagaacataatatacaaaagtaatgcagagtattcaattcacttgtttttattctccttgcaagaaagatgcatacactaagtttgtttttcttgttacaagcacgagttatccgtagagcaaaagaaaacatctttggaaaccatacgcacacaacaccacatgtataccatatgaaaacattcacctccacatgcattgttctctagcttgagaatcatgcatgatatcgttgatcgtctggacctttaacttctaccaaacctagtcccaatccatcatcggctatactcccatggactcaagaaacacctgcatatgaacaacaaagaaattttatatccgagtataaatttgcaccaacttgtctcacatcatcacacaatagtatcacataagaatagaaaaccatctagaagtcgtaaacatgaagcaatctagaaattctacgaaaacaatatgaaactgactccctcccggaatctgccggtttgaccgtcgagctacccggtctgaccgcccggatactttcggtctgaccggcatgcaccacccagtctaaccggtcacctagcgccaacctacactgctcatcgtctgaaaacactatgcaccatgttttccaaaatactcacctttgacaatttgttcatcacatggattgaatcatcacatgattctagaatcagacacatctgaacattcaattagatgatagggaaaattttgtgaacatcttaaattcttgttataatacactctcatgcgtaaatagaaatcatgattgcatctactagtatttttaacgagcattttgaatatgtacacgtttcgatgacatgacttgaacataataaatgatccaatattaacacagttcttctcgcaacgaagaagaagaagaagaagaagaagaagaagaagaagaagaagaagaagaagaagaagaagaagaagaagaagaagaagaataggtcaatcacacaagggaacttgataaattgtgtatcatttcaaattgagcatcaatctacaactaattgtattataaacaacatgggtgcagtgcatctattatctattatattattattaaaggaatagaaaaaggagcctccacgtcgctctcatggcctagaaattctcacattaatcggagaaaaaaaaagcagagtccatatagaaatacaatttagaaatagctgaaattcggaattaaaaaataagaaatattagaagaggagactagagtccatatagaaatacaattaggaaataactgaaattcggaattaaaaataaggaatattagaagtagagtatagagtccatatagaaatacaattagaaaataatagaaatttggaattaaaaataaggaatattaaaagtagagtatagagtctatatagaaatacaattaagaaaaaaatagaaattcggaattaaaaaaataagaaatattagaagtagagtatagagttcatataggaatttaaaactaactaaaattcggaataaacataataaaattaaaagtagagtttagagtctgtataaaaatacaatttacaaatgactaaaattcgaaattaagaaaaacatgggaagaagagtttaaagtcaatatagtaatacaatttagaagtatctgaaattttaaattaaaaattaaagaatattgaaagatgagtttatatagaaatacaatttagaaatagctgaaaatcggaatttaaaaattaggaatattaggagagtagattagagtccatatagaaatacaatttagaaatagtagaaattcggaatttaaaaataaggaatattagaagagcatattagagtctatatagaaatacaattaggaaataactgaaatttagaattaaaaataaggaatattggaagtaaagtatagagtccatatagaaaaacaattaggaaataatagaaattcggaattaaaaataagaaatattagaagtatagtatagagtccatatagaaatacaattaagaaaaaaatagaaatttagaattaaaaaataaggaatattagaagtagtgtatagagtccatactaaaattcagaataaacatactaaaattaaaggtagtgtttagagtcagtataaaaatacaattcacaaataactaaaattcgaaaataagaaaaacatgggaagaagagtttaaagtcaatatatgaatacaatttaaaagtaactgaaatttgaaattaaaaattaaagaatattgaaagatgagtttagagtccacatagaaatacaattagaaataataaaaattcagaattaaaaaaaaaattaaaagacggatctagagtccatataggagtatatataatttagaaataattaaaatctgatattaaaaataattaataactaacacgtatataaaatacaatatgaatattatacattagtagtttcgtaaatttattacaaaatttaaaattatgctatcattatttgaataatacaatgagaaaacacatatgctattatatgagagaaaatataataatactagccgcgcaatctgcgcgggtcaccatgctttatatataattatccaaataatatgtggagcggtgggcctaataacaaaagaatataaatatttaccatgaatatgtttcccttggggggaagtatcaggtgcaatagcacaatttagtgtaatcgtgcaacttccatctttcaccgttggatctagcagactagcatgaacgtgcaagatcaatcccctcctccctcaccgtgcattttgcagaaaaccgcccaccaccaaagaaagttttgcattttagtccctctggcaatctggcttcctcaccctctctccttaccatcttcatccgagttgggaatttgtgagcgaaaaaataactcagtgtcaaatttgagaataaaaaaattactgcaattaatgaattcgagtaaagaaattacattgagcacaaaaaaatgaaaggtaaaaagaaatgtgcacgatgggatatctattcacagccggcgaggggaggttggcggcaccgagcagatctgacgcccatgacgagtgcgagcatggccccgtcgtccccgatcggcaggagcgaggagagagggaggacgacgccggcagttgcgaggagaaagagggggaagaaaggggaccggtcgagattcacgcgcgctgctcgtcgtcgaccccggaccggctgctccctcccgttgtcgtcgcctccttcgctgtgtctgctcgcgctcctgcccgtcgttgtgctgccgcatccctccgcctctatccccgacctcgccgcatcgggacatacgccgcagccgcccctttgccgtcgccacttttcctttttttttctttttttgctgtataattttttttactctttaattcatggataaatattggttgtaatttttttactgataggatacaacatttgtaatatttttaccttcaaaatccacaaagagtgatttttttactcttggttttaagcatgagtaaaattttcactcccaactttaaacgtgagtaaatttttttactttgattatagatatgagtaaatctttggttttaagcatgagtaaaattttcactcccgactttaagcgtgattatttttttactcccgtttataggtgtgtaaatcttttactcggtgaggtgaggaaagtggaacgatataaagagaaaggaagatgagttcaaggaccaaaataaaaaaaatataacgagagataggtgttttttctttttttgcaaaatgtgcgatagggatgagattgtacacaaaggaggttgcatgattacactgaattgtgctattgcacttgatacttctccatttcccttgtggaccctgttgggccaacataaattcacctatgtctgtccaagtgtctacgtggtttccagtttccaccatccagctatggtcgccactagtcaagagaagggctaaggtagtaagtgcaaatgaaataaaatggataacgttcttatttatagggataaatttgtatgttataaatctcataaataacttagaagaagtcatctaaaaagtacaatagggaaaaagagtttttaataaatcgtattttaaaatacattgagcaagtaatccatgataataaactaatgaccctcatgtgagcgctcagggcgactgtggataccttaagatcataaaattattatcttttatccgagcaagtgaagttgccatacaaaacaaaaataaatttgacacaaatctaaaacgaaaatgaatgtgacacggatactattatagcaatgtgatgtctatagggaccagtggtagtgacttgccactcctaccatcatcaatttcacgatgagatggatgaaataggatagatgttattagtacggccgggtttacttctcaactttttcttttaacttttaacttttccatcacatcaaaactttcctacacacataaatttttaacttttttcttcaaactttcaattttagtcaaacttccaattttagcgtggaactaaacatattattacttacatttatatttaggacatgtttagatcccctagcaaaatttttcatcctgtcacatcgaatgtttggacacatgcatgaagtattaaatataaacgaaaaaaatatctaattacacagattgcatgtaaattgcgagaagaatcttttaagcctaattgccccatgatttaacaatgtggtgctacagtaaacatttgctaatgacggattaattaggcttcataaatttatctcgcagtttacatgtgaaatctgtaatttattttgttattagtctacgtttagtactttaaatgtgtgtctgtatatccgatgtaacacgccaaaactttttacccctgatctaaacacaaccaattgcatttgagtgacatcgcgacggaactacggaagagctgaggtccatgctgaggcatttggaggtgaattggatattgtatatgggaacgtatcgtatacacataaattcttcatgtgtacatggactttcaatagtattgtattcacgtgtagaaattagaaaaaaaaatgtacatggacttttcaaattcatcatgcataaaagagtgaaaagaaaagataaagatctgatagacttgtagtttaaaattttcagaacttttttttcacggctaaaatataatgaatttgggttaagattttacatgtagttataatatacctttttctatatttttgtgacattttttaattattgtgcatgcaaaacttgtgtgcatagaatatggtctcatcttaccctacgtcctaccgacccctagcttctatgctcctattatttggcatatatctaaggtctgtttagatcccacctcaaaatttttcaccctgtcacatcgaacatttaaacacctacatgaaatattaaatatatgttaaaaaaataactaattatatagatagcgactaatttgtgagacaaatcttttaagcctaattgcttcatgatttgataatgtggtgctacagtaaatatttgctaatgacggactaattaggcttaatgaattcgtctcgcaatttacagacggattatgtaatttgttttgttattaggctatgttaaatacttgaaatgtgtatccgtatatccaatgtgacacggtaaaaaaatttacccctgatctaaatacagactgattatatgttgtgatggataatctgtgagtaaaacgtatttacaccacactatttgaaaattcaataaaaaataaactacgatggaaaaatgtttaaaaccaactccaaagttaaatttctaaaaatacaaattttgacagctgcttataagctgaaagtaaaaaaatcagctccaaaataaaattccaaaatttcaaattcagattcgcacattgattatcattccccttgggttcgttctagcgtgtcttggctggcgaccgttacagtcagccagtcaccgaccgaccgcgacgacgcctcctcctcctcctcgtgtcgtgtcgtgtcgtgcggtgcggtccagccaaacttttcttatgcctattatgtgaaaccaaaaaccaaaccaaaccacatttcgccttcgcctctttccctctccgctgcatcgccaccaccacgcaaagccaccgcctccgccgcggccgccaagagcagcagccgcctccgccgccgccaccgccgccgcgcggtcgacgcaagggtaagggtaagggtaagggtagggcagagcggaccgcggcggcgatgctcgcttggaaggagaaggtggcggacaggctcgcccgcctcctcgccgactcccccgcctccccctcctccgccgccgccgccgccgctgccgttgagccgcaggtgagatccgcgtccctccctcccttcccgcgcgggcacgctgtgccggatccacattttccatttctctttttttttaacctcgcacaagaatttggtggcggttggtgtggggtcgcctcgcattcgcatccaacccggtggttctggaaggcagagaagcgggatcctcggagggtgacccatgtcgaatcggaatcgaagaattgtttctcttcctttgtagaacgtgtaattcttcgatgtagaaaattgcattgcggcgtagatatgtatgtgttcctcgtgttcatttggatctgggggctgatttgaaaggcgccgccatgtaggggaggtgagtcacacgaggagagttctttgaggaacgctggcctcgtttgctcattgcctgtcccttctctgtgatcaatttgatatattagtatgtatatagttactttgtcgctgtgaaagctcaggtgcagattggtgcttaataagttgatgttgtgttgtctaatgattttgtcttctcccaaggcattgatgttctttctacatgtgaattttctcacatttgatagttgagagttgacgctttagccaggagagactattcttcggttttcaggataaaaaggttgtgttttggcaacaaacctgagtgccggtaactgcctaacccattaacgatggaggcaatgttgcaacgtatataggtgtacagaaaaaaaatactaagtttgagctgactcaatactgatgtagtgcctatttgtgatgcacagtcttagtctttgaaacattaatgacttgtttagttcatagaaagaaacattttaaatattttcatggcttgtgtcagcttaagcagcagtacctcataatttttacaagtttaagctgtggtacgtcataactttttgttactatagttttactagttcaaagatgttgctttcttgcatatatcatgttttgtttgtttgctgtacttctgtattaatacttaatagcaatgtgtttattcaggcaacgccttttccagtggagcattttacttcccctaagaaaggatcattatcttcttacgtgatgtcccttctaccaacctcaaatccgggacatgaaaggacttcaccgagttcacagcatatgaaaccactgcctcctgaatcgcttcctaaacgatggagggggaatgatttcttgtggcatgatccgcccctggcattaagtgaggaatctggatctgaaagtgagagagacgaaaggaatggaaattctaataacgagcagatcctgcagtcacacaggcccatcgataactcaaatggaaatgaagaaacatcaacatcagactgcacagactctctttattatttaactgaaaagtctacatttatatctccaaaattgtttggattctttcaatcttctctccctgggaccttaaagggttgtcactgggttttgctatataggtaagcagtaaatcaacatgccatggttgaaatttttatttaatcatgccttgtgtagtattaccttttgatttcttcattctttgttgttttggcaaatgaagtgcagcacttggaagcatggaacatcgctaagaacacttttccgtaggagtgaaaatctccagggtccatgcctattggtatgtccaactatgatttatttaccattttgaggtgttatgtgtcattacaattcaacttgtttctagaagctgggtttcaacggacaatatttctcacctttctcatgttagattgtcggagacatgcggggggctgtgtttggtggcttgttaaatggtcctctcaggcctacagagaaaagaaaataccaggtcagccattagatagcttttcgtgctacttatgcttatgaagtcatgctatgagggcatgagccctagttcaccaaggcactagaaactagtcaggtggcaagccagtgcctagggcctaatttgtaattaggcttgcctaggcaggagaatgcccttcagtgcctagtattgccttagcaggctaggttactgccttttagaccatcctttattaggtttttccctagtttgtgtaatgattgtatttatattcctgatgaagcagggaactaatcagacatttgtattcacaacgatttatggtgaacctaggcttttcagaccaaccggtaagcattttattttggtatacctttttggcgtcggagaacaattttttgttttggcacattcttcataaattacacatcttctgccattatagttttgaacttctacagttgtcacatcaaactggttgatgtgacaagaaaatttggttccacttctcttgatgattggtcaggaatattgcaatgcattttcatgaaagtagccagaatgatatggtgatggattgtgattttatggtgaaaattccaaatgatcgcataactttataatttacatgttaatgttgtatgtaatattcaccttttgcattttgcataatgccacttttgttgatccattggtcaggaaaattgcaatgcattttaatgaaagtagccaggatgatatgctgatggatgtaatttgtggtgaaagttataaatgaatgcataaatctataatctaccatgttaatgttctatgtaatattcaagaaatataaaatgaaatttatgtaccgcttgattcattttaatagtagtacaaatgttctgtatcaacatagagaatatactgttaaaattgaagttgtacttgtcggaacaaaaatattcaggtgccaacaggtactactacttatgcttgaatgatgctttggcatttggaggaggtgggagtttcgcgttgtgcctcgatgaagatttgtaagttgctattgtggcatacaatttcctcgatttgcggaaaacaatcatagttagtattatatcttgatttatggagtaggttacatggaaccagtggatcatgtcagacatttgggaactcatgcttggctcatagtccagattttgaactgaagaatgttgaggtaagatgatgtttttttacattcaagtctaaagacttctttggactttaagtcatattatctcacaagttagtagaatgctcaagtactctagtgtgatcatgatgaaaaatgtgcaccatgctgggccacgactagcataatctcgacatttataaattttaacttctgttacttttgggacagtatttgatcatttgtttgctacatggaatatgcacgggaattttttaagtataatattatttttaccataatatttctaatattatcaacaccagatcctttttacaaatagtttgatatctctataaaatgaaagtagctagtagtaggtggtgtttgaatctcctgaagatgaagataaagataaagattaagtgtttcacgcaaaacgaggtggtataacgtgtgattaattgagttttaattattacaaacttgaaaaaggattaatcttatattttagaacaactttcatatagaaagttttcgtacaaaacgtgcagtttagaagtttgaaaagcgtgccgcgagtatccaaaattcaatccaacttttgttggagaaaagaacagggtcaggtggttggtggttgtgagtataccccatcccacaactgacccctcgagttgtgggatcttccaagaatgaggatatgcatttgtccgtatggcttctaggcaatgttcgatcgtgctgaagagactgggattattgatttattgcggcatggaaaacatggcagatcattaattaagaaaaatgttttaaaatttgaaaaatgggtttatttgatttttaaaaaaatctgcacagaaacttttcttaaaaaaaatgttttgcagcttgggaggcgtgcctgcgataatctactaaccagtagctgaatcaaacagggctttttgtggcaacattatttgcggattgatgtttgattgcggattttgtatgttttctcctaaaaatgatgcaactttactagtttgaaaagtatgatatacttctatttgaagtctgttgcaatgcatggttacttggctagtcaggaaagatataaccagtcataaatgatcacagatcaaagataggaagttcatatgcacttctcccaatgacatgttatttgcatctgaaatactactactacttttagattgccttctatgatggagttaatccgcatatgtttccgct

SEQ ID NO: 25489 - DNA, 2942 bp, Oryza sativa
  unsure (1)..(2942): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccagaaactatgtcatatcttagaacaattagatattagaattaaattaaattcatattacagagagcagaaattggtactagaattgttatgttgttagcattattatgttactctatattacagattgtttctgcattttctcagcactcaagtggaaaataagttggaaattcatgcatcgttttgtaattttaataaatttctaaactaataaataacccatggagatctttctcatacattgtagtgctgtcgaaactcaagtatggttgaattggtaccatgattaatcgtagcttcatgcactttcttttattttggcaatggtctctttgcgtactcttctattcatgcaatgacatgagcattgaattctgaaactgaactggcattattttgaagaaataaaaaaaaacccaatcatgttatcttattaggcaacaagatcagtgatcatgctcaagttgataaggaaccatattattaaatgtttaattttgattattttcctggtactgaagtactgtctaatttgacctctttgaagtacttgacatttgaattttttctaactttgccatgaagattttgtaaggttgctttttattatacctgtacagttagatgcagtatttaaccaatctaagtaggcgtttttgtgtattcttttaatatataatttttttcttttcaaaaatgcggaagaaacacaaattggaattgcaaaatttaacgctgacaaagcatccattcaaggcattccttttttttttagagaatctcttatatgccactagaaattggctagttctcttatatgccactcaaaattggcttctcccttatacaccactagttcaagtttttccacccttttattctactcccagcactatagcatttgttgatggttagtcaaatgttagttttttcataaatgaccaatatgccctctcaactaaaaaaaatgtgtaaacttcaaaaaaatcataactaatttattttaaatcctttttgagtgaacaaagttttgtcagaaccggtggaaaatgctctttgtattaaaaatatgggtaatttggaaccatgccattataattttgcaaagtttgagatatgtcatcggtatctcaatgacatgtaggacccacatgagtcaatgacatgtgggtcaggatggcatatctcaaattttacaaaattataatggcatggtttcaattttccctaaaagtattgttggaaagctgcatgtttcatacttatattgaaagtttatttgtgatggtgatgtctaaaattgcatgtgattgaaaaaaaatcaattttcatatgttgtatccagtagatatattagtacgaaaatacctatcattggttgtataccaactctcaatggtaaatgcgtctttttactatgaagttaacgatcaattgacggtggagtgacagcaatggcataaaagggaggacaaacttgaaccggtggcatagaaaggaggagccaatttgaaagggcatataagggaaccggttaatttggagtggcatataagggattctctctctttttttcatgttagcaatggtgtaattaatactcacctgccaaatacataaattccatgccaatggttctactgagtcctttttcttgctcttgttcaagaacaatttatgttcctcttctgatcttaagtcccaacgtctattaatttatttctttaggtttctggttcaatgttttaagaaaaaggaaaaagtacgaaatacccccccgaactatagcggtcgtctgaaatacgcccctaaaaacgaaaaccggatataattcaccctcaactatcaaaaccggttacttaaccccctaaggcagaattatgggcggttttgaccggtcttcgtacacgtggcagtacagtgtggcaaggggacggcacgtcagcacggggtcactatataacagcggagcgttctctctctctctctctttctctctctctctcgcaaaatttcccctttctccccgaaaccctagaatgggcggcgattccggtgactccggcgaggctggctgcggcggggctgggcggcgctctaggcgggcgggggtggcgcgctccaaggtggccacggcgacgaggccggcgagctccactgcgaccacggtggcgcattgcaaggcggctgggatcaactaggctggaagaaaccgggcatttgaggtatgtgatttagctcgatttgaagtgtggattttttggtgaagtagttgtagtgtgggatggattgatatttttttgagcagttcttgctagatattagtcagatgcgttgggattgttattatagtgcagaaaggtggagtaagtgggaatatgggggaggttgattttcgtgttgggattgtaggtgcatgcatagggattgattttgttcattttatagtaaaggtggaagtatggtggttgttttttaactgtcatcttaggggacatatgcattgggattgattttttagtcttaactttttttaggacaattttaccatcactgcaatggatcctctagagt

SEQ ID NO: 25490 - DNA, 21027 bp, Oryza sativa
gggtatgtcttagcattggaacgtgacagaatatccttgcctgaggttaattgggtatctaaaagatcactgcgaagtgctccctggtatgcttttgcgctggctttttcctgggaaagaactggcagatggggctgagggtgttggttgagtgacaaggtctgtggctatatgtcgaagtgtgttgtggatggaggaggtggctgagatatgtgtagaggcagtagtgggaggggagtccaatgagtctggtagcagtgatgacagtgactttgaagatgaattggaggacatgtctcctgctgatgatgaatgggatgatttaaatgatgatgctgtgtttgaattacctactgcgaagcctattcttcttattcagtcaacaccagagaagacaaaaagtgatttagatagattgagagcttggagtaccccaagcccaaaggataaggggaaagctgtggtactatgtgaagagagggtgaagagtgcagacttgtctggttctcacagtgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagtcttggttcagattcagggtgaggaagataatagcccatatgagaacagcagtgcagatggtgattcatatgaagaggatagtgatggatagtttgtcagaaagaagtccaaataccccagatttaatgccaaccagccccatgttaggcttgctcttaggatgaaatttgatgggaaaaaagagtttaaggaggtagtggtccagctagccttgcagaacaaaagattcataaggttccccaaagatgaaggttgcaggacaagggcaaagtgtgactgggcaacctatccatggagttttttgctatcaaggaacagcaggacaaatagctggcaaatagcaagtcttgttaatgagcacaattgtcctccaaggaaggataacaacctggtcacatacaagagaattgctcagaaatatgagaagataatcacagataacccaacttggagtattcagagcatgcagtcaactgtctctgagcaaatgtttgcaaatgtcagtgcatctcagtgcaagagagcaaaagcatatgtcctgaagaagatatatgagtctagaagggatgaatactccagaatttttgactatcaattggaattgttgaggagtaatcctgggagtacagttgttgtcaagcttgatactgaccagccaagcccagtgttcaaaaggatatatgtttgcctagctgcttgtaagaatgggttcttattgggatgtagaaaggttgttggtttggatggctgctttttcaaaggttcaaacaatggggagctattatgtgctgttggcagagatgccaacaactccatgtacccaattgcatgggctgtggtggaaaaggaaacaaatgactcatgggattggttctgtgatttgctatgcaaggacttgggagttggtgaaggtgatggttgggtgtttatttcagactagcagaaggtatactcttctaacatattttgttcagtgttatttactgtatttcttgatgtgttgttgttattaaatggcttctatgtggttgattgcagggaattgtaaatgcagttcagcactgggctccaagtgctgagcacagaaattgtgcaaggcatatttatgctaactggaagaagaaattcagcaagaaggagtggcagaagaagttttggaggtgtgccaaagctccaaatgtcatgctattcaacctagcaaagccaagactggcacaagagactgttgaaggtgcaagggctatcatgaacacagatcctagccactggagcagggcttggttcaggtttggctcaaactgtgattctgtagacaataatatttgtgagacattcaacaagtggatagttcaggctaggttcctacccattattagcatgttggaagctattagaaggaaggtgatggttaggatacatgagaaaagaaccttgatggacaagtggctagaatcaatttgtccaaacatacataagaaacttaatgcatacatcatcgattaaggaaactgtcatgcaatctgcaatgggatggacaagtttgaagttaagcatcagaatcataggtttactgttgatcttgagaggaaaacttgttcatgcagatattgggagttggctgggttgctatgttgccatgctatagcctgcattcactttaaaaccaactgccttgacagttatattgcaccttgctactctatttattccttcaaaaagacctaaagctgttgtttggaacctgttgagggaatggaaagctggcctacatctgataggccaaggccaaaggctccaggttatgttagaatgctaggaaggccttccaagaaggaaaggagaagagagccacatgaaaagcccaaagcaacaagggtgtcaagggtagggtcagtgatgacttgaaggttgtgcaaactccctgggcacaacaaggcttcatgtcacaagaggagacagcaatagcagggcaatgtgcaggtactaacttgttcatgcagattttgcttcaatttattactagcacagcatcataactgatattttctctcaaccttacaggctcaaggatctcagccaagctctacacaggattaggcacatgttgcagccaaggtaataatggcttgcttcctgtttgcacttgcttcagtcatatgtctaactgctaccacttgctgttgaaagcttcatcatctcgaaagaggcagctaaaagcttcaacatctgcaagggcagctggaatggttggggttgagcagccaagaaagaagttggaagttaggagatctcctcggctaaacagaggatgaataggatattaggttcataatacttttggacatgcttactggattagcaataggcagaagatcaccaccttttgtagagtaacatgtggtatgaaacttctgtaatatgatatctgtggcatctaataggccatcttttgtgtagtaactgaaggaattacagtgctctaaagtttgaagcaacctgtgacatttactgccaccactcttgtttacttgctgatgtaatcagatacaatgggttccagatgtggcaatatatgtcattattcatcatcacttttgctgtttccattatctccaattgccataacatgcattgattcccagtcacccaatatggctggtccatttgccagtacaggtcatcaaatcagctgatttttaactgtcatctcaaacaaaaccacaattttgcattcattccaatttgcaattacagattctagtagaacagctgacaacacaacaattccattcattccagtacccattacagattataatagaacacctgacattttcttaactccacactgaccacctaaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctcttagaccctgaacctcattgctttctttcttgggggtagactgcaagttgtgctgggctactgtcctgtcccaaagtgcagcctccaggccattcacctgctcacgtgcagaccacacagcattcctcaaatcaagcaacagttgcttcatatatggttttgcctcaacagttgcttcatatatggttctgcctcatcatcacaccactcccaaaatccgcagcccccagacttcacaaaaaaaggggaagtgaaagagtcaatcccttgaaaacaaatctaaaatgcaaaatcaatttaaaaggcacaaaatttaactcacacgcgcattgtagcatgtaaaatatctcctcccggggttatggggactccaagaaatccaccgagctgccttcactttacaatcacagaacacgggaagctcataatcaagaagcccctgcctgtatggcaccggcggctgacgccttcctcgctcaccacctccatcccaagaagacaatggcgagccacgcgatgtacctgagctcggcatgcccacattcatatagatgttaatgaatctagacatatgtgtacctagattcattaacatatatatgaatatgggcaatcttttttaaaaataaccaatttaatcggtatatatgatagaaaaatgtttaagtatttataataataatataatagcccgtgaaacgtacgggatgatgactagtagtcataattcatgatattttaatccagatatatagcataattctgagaggtactaatcccataacattaattgtgggcccatggaatttactagcattaagaaaatattgtgatagacaatcatccatgtttagcaatgttagtaaaatacataagataagattatccacttactaattaacacaattcatttaacacaaacttagacagacatttaagataagccttaatttatttgtcacagaatggccagacatttcatacaagatttaaggttgtaagctattatttcgtgctaaaattatacatgagagatggagtattggtttaaaatagcaagtatttggtacctaacgaaaaagattagtatagatagccagacgttcgggataagtcttatgtttggatgccattaatttcacaaaaatacaaatgtttgtgagatatatatatatatatatagcttcatacagcataaccaaatgggcaagcagatgaggtcccgtagcctactcttggttctgttcgtggttcatcttgctatgcctgcacgcatatatggtaatttgctaactgatattcattctcaaagggacttccaatattttcgttcatttaagtgttattttattcttctagagtagtcaggatgcactaagagaacatatcttataggttccattttgtttttttttttgtcttgttctccctattcacctatccgtgcatcacatttgttttatttttatttctttgtttcattctaaaagtgttcgttttgtttgtaaggtaaaaacatggtttacactgctagcgaaaccaggaacgaaggaaggtacaaagtcggtatcaatggtttggaccagtgaaatgcaccatttcccaagatggatactgctgttatgaccaaaaatcaaaagcttacaagacgtgctaccctaacgcatcagaatgctggagcaattgccataaacttgaggctcgtgtttgatcggctgacaatgcttgtaattctaaggaatttataataatactgtcgcaaacctacgtgatgcatgggttattattgtaaatattactccctccatctcatcttagcacatagaccaaggataagtaatcctacttatcatccatttaaatatgctactagtcattcctcgtaaacaagtgattcattaatatttacatttctcaatgcccatatagccaatcatgtgtggaagaatggagagtcatgtattaaaatccgagaaagtcattaagatgatatgttgttggattgaaatatgcctatcaaaaataaattttttagatttggaaatatgactatcaaaagtagatggagcgagtacttaataaagatgcattagttgttttctaaaattgcagtgatttagagtcctttgtcaattacaatatgctaattataattctggatttcaaaacataatacaatttcatatgtattaattaattccaaagttaaaataaaaaaaccaaagtatcgaacgatagtatgatagtataaactaaaggctcatcggccttggccctccccttatggtcctggcgggggtaccatattggtcctcacttacgcatgggccctacgagagaattagaaatctaacatcttttcataggcagacaaatgaggccctcgctgggctttcccaagaaagcgacttgaacttgaattcactaattcgatgtccatctagttggaaataaattttgactactctgtgccctgggactagtatatacgttcagagttgttctggttttagaaaggggcaccttagtggagtacaagaattgttggtttgaactttatttcgtcaagacaagatgccgactactataaatcctccgactagtctcttttactcggaccaattgctctaatctcctatacaaattgggcactttctacgagctttgtcgtaaaccaaaaaatatgaccatttattatgttattcgaacaatcatgaccttagattaatagatcttacattacaggcatagtacgtacatatatcaatccatgtgcagcatagtacgtacgcaacaaccaaaacctctcagatatatctcctaatctcgatcagccacagtacataacaaaaaagtctgtcaaatagatctccatatcaatctgatattacgacttccacgacttcaatctgatattacgacttccacgacttccactagtatgactatgccaggagcagctcttggaatagagacaacagggtacatcatgcatatgacgtccataattctccagtgtagggcatgacgggatttttttcagttccaattatactttattaactagaaaggtctggttaaaacttagaagcatgttgcaaccatgatacctctcttttcaatgaaagatccaaatagaattttataattttaattatgttgtttaattaaacgtttcctatctgaaaataggtcgaccaagtttcagatcctatctgatgcacgatgcaaagcacattgatacatgcctacatggtactacaaagaaatttcagtccattagtctcacaggaacaactttcgagatttcttcagttggacagcatcgtccagttgacaatgacgagaaaaaaattacaagttttcttaaacgttagcaacgttcctaaatcagaacatgcggagtccattaaacatagcaaaactggggacctatatgaattttcaagcattgatgtttttttccaagagaataaatagcaaaacatacttatcaggtaagatgttgtttgctagactatttcctgccagcaaaattaattacttcagttgcttcatattaactccatgtttttgtttttagatgtcattggcttcgcaccatatgtagtaggacatatggaagaaatatgataagtcatggaataaggaaactcagtgacactatactctgaattttgtgagttaaattaaaaccagttatagctgcaatttttttactctcaacatatgtagtgattaattagagatcaatgaaaaggatatgatgcaactctctttgaaaaaatatgcttcagaaaacactattgtaagcgaataaggagagttgttaaaagctgggaacgattgaagagttgatgctatattggcaagaacacaagaagtatatgtgagttttatgtttcttattattggttccttatgcttaactttttttactgaagaagtttcctaattatgttgccgtaatccagaacaatagtatagagtgtagtagtctaacgtaaaattttagtaattaagaaattggataaaaattaaaatatactcaaccttgcctacaacagttttggtactaaaatttgtcccagtgttaactgatgtaatatttaatagttatttttattatttaaattctagaaaatatatgtagtcatttgaatagatcatttttaaaaataaccaatttaatcagcatatatgatagaaaaatgtttaagtatttataatattaatataatagcccgtgaaatgcacagattgacgactagtagtcacaattcagcatattttaatccagatatataggataatactgagaggtactaatcccttaacaataattgtgggcccatggaatttactagcattaagaggatgttgtgatagacaatcatccatgtttagcaatatcaataaaatacagaagattatccacttactaattaacatcagacatttaacacaaacttagacagacgtttaggataagtcttaatttatttgtcatagaatggccagaagtatcatacaagatttaaggttgcacggtattatttcatgctaaaattatacatgagagacggagtattggtttaaaacagcaagtatttggtacctaacgtaaaagattagtatagatagccagacatccgggagaagtcttatgtttggatgccattatatatatatatatatatatatatatatatatatatatatatatatatatattatagtaaatttgtttggtgctccatggtgcccgggcaccattgttgaaattgagtatatacccaattcaaatgagtatgaatctttttcaattacttaggtattaatattaaccactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtatatgtatgaatcgaattattataactagatatatactcacaatttgaaaattttgaaaaatttgagtgattttgtgcatttgataccatggtgcccgggcaccatggtgccccatatgagtgtcatatatatatatatatatatatatatatatatatatatatatatttataatcatggagcaacaaaaaaggtacacaatccatagcttcatacagcataaccaaatgggcaagcagatgaggtcccgtagcctactcttggttctgttcgtggttcttcttgctatgcctgcacgcatatatggtaatttgctaactgatattcattctcatagggacttccaatcttttcgttcatttaagtgttattttattcttctagagtaatcaggatgcactaagagaacatatcttataggttccattttgttttttttggtcttgttctccctatttaccaatccgtgcaccacaaaacaaccatacacatatcacacacatgcacattcttgatcaaagagtatgacttgctatctccttgggtctggtattttggctttgcaaaatatgtgatgcaggtatgccccaattgatccctatcgagctccacctatacagcctaatagaatagggacaattcggcaaacatgccttggtgaggatccacaaatcaaaccacatgagtgatctaagagaaggtcatttgaggagtaaagctactttgcgaaaatatatgaaaaccccaagaaattcataggaggaacaagaaagacttgagttatgactgttccattcatcaattacccaagatggtaagttagacactgcaaaagtgcaaaagttcacaggtacaggtatggcttggaataatttgtgtacttgtatagtatcttagaaaaatttattccacattaatccttaacctttactcgggacgagtaaagagctaagtgtgggggggggggtttgttgacgactattaagtaccaaaataacaccatcaatacctgcataaaaccataaatgtgaaacatccaacatagtgacaggatttatttctaacaatttccacgattgttggtgtatatttgtatgcaagtgatcaaccacaaaagttgggagagaataggcataaagaatggaaatatatcttgcgttgatggacttgcttggttttgagatacaacatataaaatgtgcaatcattcggagccaaaacatggagtaggataaagtagggcatacatgtcagcatcctgaagaaagatgtgagccaggggagcaaaccagggttcggtcgaacccccagctggcctaaccaggcccatcttttaccaggcaatagttattcttatcccaataacggttgtgagcgttgtacctgaagaaaccgtcatggacacatgacaagaggagatgaaatatgctctttggatgcttgagtatgccacttgtcatgaggagagcaaagatgctcataagatgcttggagcatctccactctcccaaggcacctctccacctataaatacccctctcctccctcattcttacacacaccaaagcatgagctgaattacaagaggctctagtgtactttattgtatattagaatagggagagagtaaggtggaaggaatcggaggaatcccggagttgtcggtaatctcctcttactattgtatcttgttaattactctacttttaataaaaatatcattctgagtaattaaggtttgcttagtgagaattacttcttggttagttcctaattagcatacgggatcattgttcactatagtccatttatctatagtgattgtgttagtgtttgatcggcactagagtagttattaattgcgcagacgcggtgtttgggtaattaatttccagtggttgctgcgtttcccacagtacatttgaggtgggtgtagaggtggtgacagccctcaagagcacttaagtcctccctgtccgggtatgtagtagagcaacatcttggaatagcgggttgctagtgcatgaagtattgcattaggattaaagttaagctttctctagacactgtttctcattagaaatcatctctgccctctgcacatattagctttgtgtccttgcatgaacctgatgaggagataatcacacacgttcccttggattcgatacccttggaatactctgtaggggaagtgctacatcagtatatccgtgcgcttgcggattctatctgtgagtgtaagaaataccaacactactcgtagcacaaaattgggggacatatactagatagatgaaaagtatggattttaaaaactttttgtaacagttgatgtgttgatgcatcgccttgagatgggcgatattcatatcgcccttagacaaaaccaaatacaaacaacaagtgttgcaaaagtattatcggcttgatggccgatacagatacatatttatatataggatgtttttgttacaggagttaagtatgaagccaagattgttcatgtctatctattacatcaacccaggaaggtatggattgcctctattgcacggagatgaagactatcgatctcttctattatctttttgtcttcggcgtcagttccttgccattgctgcaagattgaggaagactaatagagagcaggggagaacgccgccggaagactggatcgccggagatgaaggggtttttgcaacaagaaggcttgtgaaggatttaaccggagaaaggagattttgaaggagtgggcctctgcttataagcttaacagtgaaggcagaaatacttagtttttcgcgggttcgaatagagcaaattccaccgcattatataatacagcggaagtggggggcatgtgttaacaacggaattttgcatcaggttcagagaagaaggaagaagatcgaagtggatttgatttcggatcgagttggatttggagtcgggctgcgcatcggctggatgtcatatcggctaaaatagagtgtgagttgatcaaggttgatgaggatggtagccgatatagccgatatgggacagctttggttcggtttgggcctaaatcatgataaccatcattgccaattggaggtagagctcaattaaggcaattgtatctattaattaggttagtttaagtcgattttgttagatttggtaagagaccgccgtatgttgtcttgtttgtatcttatctttaggaaggtttgagtcatgtccataatggactaagtctgtatttggggtacaaatatgaaccccctaccactgtaatatgggagacaatccaatacaacttcgacgcatcgccacccttttttgttcttattttcagcgagttctctcgacaagaggtaacccgtctcgatggcttgtgctatcggggctatcatgttgttttagatgtttaagtccttttctcatgaccatctgtcatcatatgtcctagttaatctagccttagtatcacaatttagccttatcggctggttctcgctttagggttcccgccggcatcagctacattgccatactatagattagttaacgcatccgccatcttgaaaagtggttaattccttgattgtttagattttaggtttttttacttactttgagatgcatcaccccgagtcttgtctagaacactaaaaactaacctggaattaatcataattagagatagcatcggagtttcagccgatcttacctaatatacatgctttttactagttttatgtatatttgccacttatatagacagatcatcccatataatcatatcaagttagatcagtatcggctgggtatttgaattactaactgattgtcacgaccgaaaaaatgcctttttccaatcgctagtgcattgatccccatcctaggaaaagccggggtacacattaacaatcatgatacaaaagacatgtctttattgcatcgataatatttacattattacaaaggtgcttaaggcctgacaaataaaaataaacaacaatgggctagcaggcatatggctccatcttcataggcgctcagctggagtataagccaagactccacctaggactttttcaccaaagctttctcttactaaagggagaaagattgagcaagaatgagtacaaccacaatactcagcaagtcacaccagaagatgcatgattaatgcaaggggtacaaggagtaataatataaggggttaagttttgcagcaaacaagcatttcaaaccacttagttgctcaaagctatttgctaaattcgatcctgagtctacacaatattattaatcaaggccgtgaacccacacgaccctgccttagcccaaggcctacgatgagtcagaccaaattggcaaccctgacccggatcccagctcgtcccaagccaacccaggccaaccattccaggttttagttggttaaccaaattttagggctatagggctgcttcaggatgcaaagataacagttcgctaaggtacaagcttctgatggttgggtattgcatgggtcggcttgctatcaactgggtttctcagtttggggcacttgtcggtgtaatgacctagttcttgacaattgaaacaacatatatctttccgaactcaggatttgtttttcccatctcgattcttctgtcctggcactgggttaggagaaaactgttgtcttggtggggaatcgcgttgccttcatgcttctctccattggagctggtgggttagttgccatcttcttcatcagcagaaaactgaattgacaatcttttggtacatgatcagttccttcgcacaagaaacaagtgatcttccttgtaggacattcgcctagtggatgctcttatccacaataagggcagtgagcaacacacgtgttagcaatatgtccaatttcaccacagcgagagcatgccttgagttcccttccacacgtggaagtacggtagtgctttgcaataggcaatagaggcccaaagaccggtccttatggtggccgatgtgcttctatcaaaacaatgcaacttgagcccagcttaaaaccattttgggggttttgaatagagggggaggtgtatgtccaattccaacataagccaaccattccataatgtccaagtgaaatgatataattcccaaagtctaagattatgaaaccacctagggttgcctagttaaccagcaaagtatctacctaaattcatactagtggaaccatggatagagtacccgctagttggggttttattttcctagggtgagcaaggtgataataacaatagcaatgataaggctataacaaggaataataggaaagctaaatataacagtgataacgcgggagtttaaataaagcggtaatccaataatttaaaataaaataattttataaactggaattcaatatactcaatgtaacaccctaaaaaaaaggcaagcaggcgtgcaggccctgggccttggcctacccatgcatgcggcccagcagcagcacagcacgcagagcaacgagtagtagcaactgggtactgtagctggaatgatcccacctcgctagttgagagtgatcaacactagcttataaggatgtttgcctgggtagtgttaactccgattccggaatttttgtgttaaagcgaggacgaaaagctaagagaagacgtgttcctggtcatttgggaaagcacgtacggtcgtacactaagagaagacgtgttcctggtcatttgggaaagcacaggtatagattagttcgatggggacgtcgaacctttgagggtgggtgtatgtaaaaccctataagaaaaaaagggcaagcaggcgtgcaggccatgggccttggcctacccatgcatgcggcctagcagcagcacagcacgcagagcaacgagtagtagcagctgggtactgtagctggaatgatcccacctcgctagttgagagtgatcaacaccagcttataaggatatttgcctgggtagtgttaactccgattccggaatttttacgttaaagtgaggacgaaaaacacagagagttgcaatgttaggtgtggttttcggccctgggctatcacaaggatgatgcgacttgcctctctcagagagaatggtgtggacccccgtttttataacaggaatcaatcgtgtaaacagtactatttccctggatcaagtagtctggtacacacgaattcatagctgaaataccaagtgcacatacacgagtgtctagtacggcttattacatcataagcccgcaggcatagttcttaaatcatcgaaccgagcggtccggaatacattccaaaagcagaaatagataaggcagcggaatttaggcagcggcacgccattgccacaggcaacgaccgtaactaagacctactgggcgccttcgtcttcatcaccctcctggtagtacgcgtaaggatcctccaaagcttcatctccaacctctgattaagtttgtatattgcaagggtgagtaccaaccgtactcagcaaaccaccacagcaataatgcacatgacaggggaatccaaaggatggctatggttcttttgcgcaaagcaagttttgtaattcttttcacaagcctaagacctagcatagactgatcaagttttaataccagtgttcacattaaacaacgacggttctgtccactatctattgtgatcccaaggatagcttcccgccattgagtcgtcatggttttctgagaacgtccatattcccgcctctcaggaagtggctccatcagcatagaaatcatcatgcaatatcccatctgtcggtgtcatggggccgggggtatcgtgactagaggcttgggtagccgcggtcacccacgtggcctgaccccctcgggggggggggtcgggcccgagggtgacgtggccacccctccctctgtctccccgaggggtcgggccgctcccgtgtcggccccgagggatcgggcgcccccgtttcggccccgagggctggggcgccccgaccccctatggttttggcgccacgtgtgtgggttaggtgagcacagcggggctcacctaaccgcatttataacaggttggacgagcgcgccacgccgcatttaatgcggcgcagcgcacgctcgttcggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccagagccggcgtgctaactcctggagttggtatgtcagtcccggtcagatccattccaggcttcagcacaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctagaggcccctgtggtgacccctgaccagataaaaaggaggcccaggcctaggagagagagggaggaaaaaaaagaagaagaggggtgctagagcctgaactctctctggctctgcggctctctgtattccttcacatacagatccaccagaacacaggagtagggtgttacgcttctcagcggcccgaacctgtccaagtgtaatacatgtcccggtgctcaataaccgcgagcacggctattcgaatagatttggtttactcacactacagtggatgtacactttacccgcactccgtgactgcccaacacatgagcctcgtcctaacacataagacgcgtcacggcaaagcctttcgataaccttgcattggcagtacccgctccatgaactttagccctcatgcactctaggcgtcatacgcttctagcagtgagaggagttctggcgctcccgggaagggaaaaacacacacattcctacgttgcttcttgtcgttgaacccagtccatcatgattgttctcttatgggtattctcatgtagtattgccaagccagcctctgaccatccggaacgggcatccgccatccacctggccatccaaaccgggcatccgccagcagactacttgccgcatcacacacctaaaagaagaccactacgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatctcaattaccttcccaaaggtaattgcccaagcatataacatttgataaatatgagtatgcatgattctagaatagcatttctaagcaaaggtcatagttgactagggactcatacgtaatcatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttgaccttcgcttggatccgcaactccctcgggctctatagctacgtgctaaaattgatttgaattcggttagaattcaaatagaaatccaaataaatccaaatgaaagtcgaatgcgaaagtcgatttctttatattaactttactattcgcgaactaaggcaaacccaatttcgattcaaactattttgcgggtataaatattttgttgtcataagtttttaatttaatctacccgagcattatatccatataataggttagaaatttctatcgcgagctaaatatcggacgaaatcctagaaatattatacgaattaatttagtctatgactaaatgattaaatataatacacgggtaaaatccctagtaattaaatccgaatttcaaccgtgaatcgattacttacagggattacccaaaataataatctataagaatctataagaattcatctatttgtttagttattaactacatctaaattattaccgcgaattgatctcttatagaaattgccaagaataatccataatttatattaaattttgcaattctacgactataattaatccataattaaattctaatcattttaaattttctaaacttccctaatcttcctctaatttctatttatttttttcttttctttttctctcttcttttctctcttttcttttctttttctgtctttttctctcttttctctcctcccagctcctttctttctttttccttctcttcctctcttctcttttcttcttcctccctaccggcctctcctttcctctctctctctcggctcttgtccacccgagcagcggcggtagtggacgcgagggggggaaagacggctcaccggcggcggcggcggcgacgacggcggcagcgcggcggtggcgactatggcggcgcaaggcgacggcgacacccggcgcggcacacgatgtggcgcggcggcaccgagggcagcggcgcggcggcacgaggacggcggcgcggtggagggagagaggggaggaagaggaaaatggagtgggggaaatggagtgggggagtatttataaggaagagggggagaaggagagggggaggggcggcggcctgatgcgacggcggcgcggggctcggggcggcgcgcggggctcggcgcacggtgatgggacggcgatggaacgcgcgcggcgacgggacgggcggtgacggggcggcagcggtggcgcgcggcgcgaggcgggacgcgacggcgacggcgacagcgcggcagcggcggcacagggcgcaaggcgacgcgacgggcggtgacggggcggtagcggtggtgcgcggcgcgaggcgggacgcgacggcaacggcgacggcgacgcggcagcgacggcgacggcgtgcggcggtacgaggcgcgaggcgcgacggcgacggccgagcggcgcgcggcggcaggcgacagcggcacggcggcaggcggcgatggcgatggctcggggcgcgaggcgcgcatggcaggggaggggaagaggctaggtaacctcgtcgaacacctagagtgcaatgaacagtgtctttttcctatttatcccgattttagtttatttcccatataaatttgattctataatttctaaatcttgcataaatgaagtttactcaatatttgtgttatctcaactaatgaattcaccctagattattattactcataatttatttgaatttttaattagggttaattcttgttccattgcatttaaatctaattaatacaaatatggccgcgatgatattttatttattcctatccttacataatctttattttaaattataatttatttatttctttaaccaaatctaatttcagggttaattcctaattaattttcccctatttgtgatcgatgaattccgaaatcaaaatccaataaaatcatcgaataaaattggcatgatgcaatttatttaaaaagtttttgaaggcccatatttttagagtttagatttttgtcggtcgaattttcagggtgttacaaatggccttccaaacttccaaaccttcggcgatgacagcgaaccatgcttcgggaacctccggaacaagaggagctacgcgaaagcacactagcaaacctaaaaccctagaaagaagtaataacaatacataaaaagaaaggcacggggttctttagattataacaaaagttctttagattataaaaaaaattaagaaacttggacgggtcaattcggagtttgtataacaagatatggttatccaaagtttaatgctgttatatggagatttacggttgttgtgattaattttgcaactataaaacatgtgtaagtgcaagcctggaaaagaaaggatggttgcaccgttgacatgcagcgtgcacatgtcaacctaagggaccatggtggaccgggtgcacagagacaatccacgggtcgacagaagcgcaccccgtgtgtcaaccgagacgagtggccgacaaacggactccactagacaccacgtgggttacgcacatggaaactacacggctaccgagtgggcatactaacacggtcaccacacgtgcacacgaacaaccgccgacaccggtacacgggtaccggggttgacaacggcacgacgtgcacagtgacaaacaccgagaggacgaggagggggaagcgaggggaggggtcctcaccacaaataggacgagaagcagaacgacgacgatgaacgggcacggcggagacggctcggggtacaccggcggcgacaaacaacgacacttcagtggcgaccctaggacgaaggcgagacgaggccggcgcaacgcttgatgacgcgaagctgaggacgaagacgacgatggggcagcagcacacttgacgaaacgcagacggcgaacgagcgcggcttgacagagggacaaacaccatgatgaggaggaagacggccgggaacaatgatagaacaacgatgacgaccggtggcagcagcacggaggcgaggacagcgtggaactagggatgcaagtgagtagtcctgctacccgcataaaaacccgcttgctagttcattttccacatggtagtataaattttagaaaaaaatgaactagaaatgagataagtggactaaaaaaacccgcttacctgtcccgcttgcatccctacgtggaacacgctgctgcgatgctgacggcggtggcggtatagcgagacgacgagccaacgtagaggaacggccaaacgaaggggacgctgacaaggatgaacagtgacgacggcgatgaacaccggcggggttcggccgaaagggaggcgaggctgaggacgaccttgcccatgcaatgcctgaggtggtggtggttcggccgagcggcgcacgggcgaggaggaagggccgaccaaaagaactccggcgaggcggatgaagaggccggtgcggttgcctccgggcaaaggcgggcagcggccagagtggagagcgatgctgcggtgtcggaggaggagacggcgacgtcagccggtgctatggcgccgcggcgggggcggctggaggcggtgcagtggcggcaacgccactggttgccggtgggggcg

SEQ ID NO: 25491 - DNA, 574 bp, Oryza sativa
atcaccagctgcatagaactgtttcagtcaaattgttcccagcagggacatcatctgtatatccaagcaagccatcaactggatcaggacaccacgtcggcccagcatctcttggaaaatcagtcaaggaaggttcaaagcctccatattgtgatccataattgagcgttgaagaactcccactactcggcggttgagaattgtaaggattggcatttgtatattgctcattgcttgaaactgaagagaaccttatcgcctgggacgaacgcagaggcccaacagacccggtactggactgaaaatgcccatgaagaggagcaacagtactctgattctgatgaggtggcataggtgtgcttctcaattctctctcccgcggaacattctgcccatctggaatcctgggaatgttttcatccagggtagctggtatagcaggcagaggcgatggcacagtcaccggaattccagaattgtagagctgattggtgcttattctctccatttacaaacactcaagccagaattatccttcactgtgttaattggcaagaccttttgttgactcgat

SEQ ID NO: 25492 - DNA, 763 bp, Oryza sativa
tattcccctacggtatctccggataccgtcaggagatacgaaagcgctatctctgatctcgccgggcacggattcgaggaggaagactaccctgttgttgactacgagtcagactttcagaccaacatgttgataacagttagataggctgcccacatattgtactggtgtgattatggtgaataagagcaataccggctttggccaacaggatgtagggttattacctgacaactcaggggcccgaaccatgtataaaaatccctgtctccatctcttttacctcagtctcgcatatatcctagcaccaacgatccccatactgtccaaataccgtagtcgagacatcaaacgtcgacaaatgtataaggactactttagaggcttaagacccccctcctattgctacattgtggctgccctaaggagttgtttagattgacgtcattataagatataccatttttttaaagtaaagttgccaaacatgagcaaccatttagctttttaccatattttggtaaataaaaaaaatcttaccaattgataatgttaccaaattgggagtacctatacatctttcgaaagatttgttatcaaattttaaaaagatttattttagctataatctgaacaagaacaacctttgatgcccgagccattttaataggccacgggtactcgagatgggccgatccatgcgcgatgagccgtgaattttttttatttataatttttttatttataattttttttattaaaa

SEQ ID NO: 25493 - DNA, 298 bp, Oryza sativa
ttttgtggttgaagccttgagggacctcaaaaaatcttgctgttaaattgaaggacctccggtgaactaattccgcaacggaacggcctacatcgagcggacggcctcaccgcgcccggcccgcgtacaacaccggattttgctccgcccgtccgctgcttgtcccgcgcggatacgtacgcgggcgcacggtgtcaccggcggcgcacgcacagcacgcgcttgaaacaccaccgggacgacgacgacgacgacgactgcgcccgtgtttcgtcgatcgcggcgtgcgtacgtacgc

SEQ ID NO: 25494 - DNA, 2273 bp, Oryza sativa
tcgtgaggtatttgtggctacatacgtataataaatcgatcgatcagttccccgaatgtggacgtgcgcaataacgaacatgtaaccgtttctttttcgggacttgtcaatgtcagtcgagcaatgcattataacctcgcccccaattatcacttgtagtccccggacagagagaaacagccgcacatcaacgtcgcttcttctgtccgttcctccgtgccatttctgagtggattgcaattttacgtatgttcttcactcaagtacagtgtaatatagaacaaattgaaaagagagaaaaaagaaataaagggctaagacgctgaaatgtagtggcccgtgtcctctggcgctgacgaggggcgcaaaaaccgggagagctcagccaggagataaaccaaaaaaaagctacaattatactactgtgcgagatacttatttaaattcacgaccaacgtttaatcattcgttttatttaaattttttgtacaaatatgaaaatatttatgtcatgtttaaagaacatttgatgataaattaagtcataataaaataaatgataattacataaatttttttaataagataaatggtcaaacatagaataaaaaattaagggcgacatatattaaaatatggagatagtaataaagaagaaaaggactcgtcgtcgtcgttgtcgacggtgcacgcgatggacctggacgccaccacaccaccactcgtcccgtcatctgctgtgtggacgagacgacgcagatgccactacgccccccaaaagaaaaaaaaaagaagcactcgcttttgtgagagggtactccgcgcgcgcgtacgtgacgacgtcgtttttccggcggcgcggcgctcgcggggtcggcgcgccgacgaagagacgtcacggcacggcgcgtcgcgcgacacgacacgactcacgagcgtctcggtgtgcgggtagttttttttcctctctccctctggagagatcgcggtgtgaaacctggtcggcactgggcgagcggggtggccacgcggtgcgagggaaactcacggcgttttttttacccacaagcggaggggatccactaattgggtgcttgtgtgtgctagttgtgtgacgaagaaaatggagttttccattaaaaaaagaaaatggagttgttaacttaacccttctttcaacagaaagtccatataaattttgatttattaaatatatttcgtgatttatgttacatgtactttttattcaactccaacaactttcttttttttccacatacataataggcaaaatttgctacaggacattcaaaatttatgtaattggctggaggacaccgtaagatcgtgtcattgccgagagacaccaaaaaatagtgtaattggctataggaatattattttataattttcgagtaaaaaggggagagagaaattaaaaagaaatacaagtttgcccctgccttggcctgagcatcagttgattttcgagtaaaaagggactttctgcttctgctcgaaaaaacaaagcgctggtttagtgatccgcacgtattcaaccaacaaaagatgatcaaataccaatcaatacaatgtaaaaaaacgcgtggacatacgtgatgtaccaggttggccgtgctgtgtggatgaacaaatacaaatcaatactggagcttcttgcggatgctaccatagtcgttgccgtccggctcgcctgaccgtccgccgacgacaccatctcaccgttgatctcctccacacactcccacttcaccgccacgccgacggacagctatataatgacgcaatgcgtagggccacggtcaccgtcgcagctgcatctgccgcgtttgtcaagcatgctcaggatcagcgatggctccagcgcagcaatacggccaccacagtgtgccgtcgcgttggtctcctccaccgctgccgagggacaggcccagcgccggaccgttactctagtggctgacgtccacctgtgcgggccgcccatcgcagcaggtcactgctttgcttgcactgccactcgccaccgttgaagctgccgtcgcctcctcatagccatggggagaaagggtaatcaggggtaaacttgtctttttaaaaaattctctctctactttgccttgaaaattataaaataatgtgttcggcgtcctgtagccaattacaccgttttttgatgtcctttagcagtcacacaattttacggtctcctatgaccaattacacaaattttagatgccatgtagcaaattttg

SEQ ID NO: 25495 - DNA, 341 bp, Oryza sativa
catgttcttaacgatctaaaagcaaaagttgaagaataaacttcgatgaaaaaaaccttaaaatcaccttcaaatttaaggttaaaaatttaaattttggctgataagtagtataaacatttgttggaatgcatatggcaggacgcacgccaacaaggtggcgctggtgatgacgtcggagtcgatcgccccaaactggtacgccgggaacaagcgcagcttcatgctgggcaactgcctcttccgctccggcggctgcgcctacttcctcaccaacgacccccgccaccgccggcacgccaagctccgcctccgccaccttgtccgcacccacaccggcg

SEQ ID NO: 25496 - DNA, 353 bp, Oryza sativa
attggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagaacccaagacatgaagagcacgaaccaaaacagcgctgttcgtgtcgatgccatgggacacgatggaaacaactgccacgtattaccgggccatcgaggacatatgggaacttgactat

SEQ ID NO: 25497 - DNA, 1793 bp, Oryza sativa
aatttttttgccaaaacaactaaacacggtctttgagacctgataataacccccatatggcacagcaaactgcatgcgtgctgacgtgccggtgggggcggaccggggccggggacaatttttaacccgcgggtcgatcgggtcggggccctgaacataaccggggccggggcggggatgaaagctgacccgcaggtgaccctatgaggccccaaaagtctatgtctatgttaatatggcccgttactccataggcccaaacggatgaaaggatgtacacatataaggaaacctatgccttatgatttaaaatcaatcatatgccttatcatcaatcaatcttatacatcgatacatgctcaatggtgcatatccagcgaaatcccctcgctcatccgcgtcgttgtgcgccacccgcgccgtagccaacctcccgtccactcccctcgctcgctcggctgcgtcgttgtgtggcctcctcaccacaacacgacacggcgtcggtctccctcccgctcgcctcgtcgctggtccccctcatcatcgtgttgtctcgtcgccggccgcgcgcctcgtcggcatgctgcctcgcggccgcaccgcatcgtctccgcactgccatcgttggtcgttgattcgtcgctacctagtcagtcgttggctcgtcgccgtgctgtctcgttgccattggcggatccagaaaatcgtttcgttggtgtcataacgtgtctattattaatgtcatagtatactaattatatttaaatcatggtgtcataatatatggataagcagtttcttcgttacaagttttgccccattcctccctccagggctagggccaggtgaacctgcacatgagcagggcgtgtgcgcaccagcaacttactccatccgtcccaaaaaaccaaaaaaataaacataagaaaattgtattaggattttataaaataaagaaaattttatttgttttatttgtgtgtgtgtgtgtatatatatatatatatatatatatatatatatatatatatatatatatatgtcggtgacatgggaccgggagtatcatgacttagagacttgaggcagacacgatcacccacgtggcctaaccccctcgggggggggggggggtcgggcccgagggtgatatggccgcccttctctttgtctccccgaggggtcggaccgctcccgtctcggccccgagggctagggcgccccgaccccttgtggattttgcgccgcgtgtatgggttaggtgagcgcagcggcactcacctaatcgcatttattgcggtttggacgagcgcgtcacgccgcatgtagcgcagtgcagcgcgctcgttcatccggtctgtgatcagtcacagaccggtcaaatcgtgggttaggtggcgacaggcggtctgacgcacgcctcgccccatcccgtcaggacgagagcctccaagcacttgtccctagccggagccggcgtgttagctcctggagatggcacgttggtcccggtcagatatataccaggcttcatcctaaccattacaagcaagacattgtatgaagaggggcgagcatgcagattgttaaactgacacgtggtgtacaagaatgaccgatttgagaccggtctgacaatggtcatgtcgtcagcagacagccatgttcccacgtcgcgcctgcttccggcggaagtggaggtaggtatgggccgtcccatcagaaggtcattcggatggcagccatacaaatctccgtccatcaatgaagagaagtcaattggagggaagaga

SEQ ID NO: 25498 - DNA, 1740 bp, Oryza sativa
ctctcacttagacatttaatgcatttgtcttggagctagtgataaactagctcttacataagagccaacatcctaatttttcactatctctttcctccacctaagcttataataggcttatagctcactattatacttgcttttacagtcactgtttcgggataatcctttctaaccccgacgcgtcgttctaccaagcacaggataaattcatgtgagtaagaaaaagataaaatgtcggttgataaataagttcgctgtcaagatcatgaaactaaccgaaagtgagttctctccaaaaaaaaaaagaaaagaaaaggaaaaagggcaagccaaagagcacgcactggttctcttctgataggagtagatgtgtcttcgcaacagggacatattctgaaggaactctatatataagggaaataaaattagggacagcctatactagaaataataatttggatgatcagttgactatttgtgggttggtttagttatatgtatatgtagatgttagcaattgacttttaacttgagattgcacaagcatgcacaaatacccttttttttcacactgatgctagaacagtgacttgtgaagtgaaaataggcagtgtatagcaagtggtatagatgagaaaatgctcaaacgaccctagcagttgttttttccaatagctctggtttttgtggaatgaagggaacttctccaaatttggaaaatgagtacagtattatatgcaacaatgtgattgcataatgtgtttggatataggcatatagcctagcacagttacgcttaatgtagttattgatcgtaaataaaatggaatcacgtgtcctcaaaagatagaagggcttatgggtggaatataagctaggtatgtactaaaacagatgttggagaccagtaacttttatatatctatccttatactgtaaaatctagtattgaaaaatcaagtatgttgaacatatattaacgttaagcatatgtgccgttgtgtcattggtgacttaacatcatgtttatttgagagtattggtgtggatttctacctattatatgaaataaataaaatattttaagaaataacataattttaaataagaggtgtaaataatgagctaccttttcttctaggaaatatattaattaatttttagaagcgtagagcaaataaaaggaaaaggcatccttttgaaacccttttcaccatcattatgctcgtgtgtctaaggctaacatcaagcagcatacgcaaacttaaaatatcaatcaaatatgaacatattccctcatactttattgatgtataaccacacataacccttgtcaccacgggtttattgacacaaaatactatccacacgaaattattcccccctcccactcccatttcctcgcaaagaaaagatgcaaatattccaatcctcttcatccgtaaccttcacccttcagcacagattcgtggaggtaataataataataataataataataataataataataataataataataataataataataataataataacccatcataaattaggtgtagttttgattttttctggtaacgtttgaccattcatcttatttaaaaaatagtgtaaatataaaaatggataagttatacttaaaatacttttgataataaaacaaatcacagataaaataaataataatttcataaccttttaaataagatgaatgggtattatagacaa

SEQ ID NO: 25499 - DNA, 1086 bp, Oryza sativa
  unsure (1)..(1086): unsure at all n locations
gcatgttgttcaagcagtttgatttctgtaacacctgcgtcgtttcctttttaatgctgctatctgctaatcatttgttttttggaatgtgaaaaatttcagatgagccttggcctgaggctatggtcgtatgtccgagaggaggcttctcatggaagggtaccatcggctgttcttatgctatttatatttcattacttaatggaatttccttttatctaaaattataccaaacatctatgaatataaattgtgtgtggtgataaaatggggtctgctatgcttgcagaaagctccaattgatccgtttaccaaagagaaatgtaagccgtctgcttcgcagggcgtaccgcttggtgggatggggtgtgtccgcctgaattgatgttttaacctccaataatctcatgtttatgcttgtctatttgcactatggatgctgtaattttgataccaatacactggttttgcaggagtggtagcatttcaagaggtttcaggggagagttcaagaattggcatatcattcctggtttatgtgagacttccccggtcatggagaaccagttttcagtaatgctttcttcttctttctgctgttgctggttaatcaacttggtttatggtgatgcataattgaattttggaccattagctagcttatctgaaggattttcttctgactgctgaaaatgctcctagcccctcactagtcactagtattatttttggggaaagtcttatgacatctacccttcactggtgtctcacatactcatattatggcaattcactaaatatgcgtcanaaagaatcttttaagtgctatctttgttgtgccggctgtgctcaagtgtgaaatcaactgttgagtggagtgtttttggggacctttgttgagataaaaaggcacgactgtttccactgtttaatgtttgtggagggacgagttccatctgctgcctgggaccctttttgatgagtgtggtaatcagtaagcaagttcttggtcaattcgccagttattacccacttatttttcctatcgatgtatataaacttccatggatgtgggacacccaatca

SEQ ID NO: 25500 - DNA, 1589 bp, Oryza sativa
ctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaagggagatcgatcgcgatcggagccgatttgatcggcggcgggcggcggccatggccgtggtgctcggcgcgttcgtgccggacaccgcggcgcagtggcgcagcgtggtgaagggggaggtggcgcggcagctgggcgtggaggcggaggcgaggaagctgggggcgaggctggagaaggtgggcgccgcggtgcgcgacgccgaggcgcgggtggcgcgcgggagcgacgccgcggcgcggtggctcgccagggtgcgcgccgcggcgtacgaggccgacgtcgccgtcgaccggtgcagggccacggcgcgccgcctgacgaggggccgggagcagcagctgcagcagcataaccaggtgagatcgctagccttgaattccgacaaaagcaagaacaccttggtgacaatggcgtcgcagagcagctaatttttgtttcgtgttgtt

SEQ ID NO: 25501 - DNA, 912 bp, Oryza sativa
tcttgaacttgtcccagacaaggatcaaggcgcttccagaaaccatttgcaatctgtggagcctaaaattcttgttgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttctccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattg

SEQ ID NO: 25502 - DNA, 976 bp, Oryza sativa
ccgtgatcaaggacattgcacaagttcatggatactcgaatgactctagttacatatactattcccagagtctcaagatctttgagggcagcgcgagtattcgagaaagccgtgatgcagaaaggagtgtggcagattctgataaagttgacgatgcatcaatagagagcagaaacgttgatcgagatgcagaaatcgatggcttcttcagctcaaaattagtggagacaggaactgccaggagtgaagacaatgtaccggataggaatatggagaggttcatgacaagatccactggccgccgattgcataagctggaagaagtccccgaaggagatgaggatgaggaagaggaaggtgcagatccagtagttctgattcctgatgatacaactaaatctgacaccgtactggagaaacttcatcctgttgttactcatgatcataatgataaagcgggatccaagatgaaaagggatcctcctgcaaaaactgctccaggtacttctgttattcaatctgctgccacaatgtgtcataagttggtccgagaagggtctcaagcaatcagcattactgaaactgatcaagatctgagcctcgattcatttcgaagcaaagaacatgcatctagtaagcagaaagttgacacatctggttctgtcatagaaaaagtaaaggaaggaagatataaatctgcaaatatcaatgaccgtaagcacattgagagagttcatgactctgcaaataagatgtcaactacttctgtggagaaaagcattcccgaaacagtcaaacctatgaaagcaacaaagaataattctaaagcaacagactatcatggaactgagaataagtcacctgatagtttggcttgttccaggccaacaataagccagatagaaaaggatgtttctgatgctgataaggctgcaaatcatccatccagcgcgatcacagagaatcgtctacccaa

SEQ ID NO: 25503 - DNA, 995 bp, Oryza sativa
tatgtactagctactataaggagtatatgttttattcatatcttttgagaaccaattcagacttgattaaggtttatccttttttcattctaagtatttttcctaaaacacaatatacatatagaggctcatatataaacattaccacactcttattcaaagttagagcatcccagcaactcgtctaaatttgatcttccatatagctatatagatggtcataaaaaaaaggaaaaagtacgaattactccctctcaactattgcacgcgttcaatttacccccctaaattacaataccagatatttttaaccctaaacttttcaaaccggacaaattacccccctaactcacctcgaagcggttttgatccaacgtggcgcacacgtggcggtccagtcaaccaaaaataatactcctaaaaaatagtggctcccacttgtcagcatcttctcctctcttctactttcttccaccttcccctcccatccatctctctctctctctctctctcaccaaggagcaagggccggggaacggcagcaacggcgtcaccagcgtgggaggagacgagcagcaggcagcgcgcgtctcgcgaccgcaacggcacgagctaggggtggcggaagacggcgcgacagtctaggctagggcggcggcagcgttcccggggtggaaacgggtcggcggcgggagacgcttggcagtgcgccaggcggcaatggtgtgcgaaacgagggcgcaaagatgggacgcgaccttgcttccatcgacgcacaggagggccgccggacgttgtcgtcgtcgtccttgatgtggccgagctccatcgccatgccgaagacttgctgcaacctgcagatgctcctgaggaccacctgcatcacgatctggaccacgcagtactccatggacgcccccgactcgatccctcatcaaacagaaactatcctaccatgatccatccagccagagatcggtcaagaaccgaatcca

SEQ ID NO: 25504 - DNA, 2860 bp, Oryza sativa
ggactaaagatcatctttagccccggtttttattgcatccgggactattgtggaaatcggccgaccgacgaaagatggtttctccaccagtgttacttcctctaattaacgtgtcagcggtctaggtcacgtaagagatttctaatataatgtatgcgtttgttcggagaacaaagggagtttgtttgtttcgttttccacacgcacgtttcccaaactactaaacgatgcgtttttttaaaaaaaatatatatgaaagttgctttaaaaaatcatattaatctatttttaaagtctaaaataattaatactcaattaataatacgctaatagcccacctcgttttgcgtatctttccaatcttctctatctccttctcctcaaagtctcaaacacagctacacaagatttctctggtatactgtactctaacatacgtgtgtacaaacatgtcagcttcacaaaatcggagagagagagagagatcgacgtcgacgtcgctgcgaggctagtgcgtgctgtgccccgcaagctccggtacgtacttcggtacttactctatatctacacacgtacgtgtgctatagctagcagctgagcttgcgcgagctgcagggaattggttaatggcgtcgccgccgcgggaggaggccatggatcagaaggcgaaggaggcggcgccggcggcgagggggcacccggcgctgcggggcccggcgaggcgggagcggtacacgcacgggctcggggcggcgcagatgggggcgctcagggccatgtgcggcgcgctcatcccggcgctgccggcggaggaggacgacggcgcccgcggcggcggcgacatggacgtcgagcggttctacctcgccaccgccgccgagtgcaccgtccccgacgaggtgagcgcatgcgtcgtcatcgatcaggggcgacgacgcatatggtattgatttgatcgagatgattgcgtcgcgactgatcagcgctgtcagagaccataatcaactaatcaacctgatgactcaatgcttgtccctccatgagtacattgtaaaacttttgaaagcttcaatatatggccacttattattttgttaaaaaatactttttgccagtggcgagttgattagtgtttttagaactagggggccaagccccccattgtcattactaaaaatgaaaataaactacagcaagtcttaaaaaaaaaagagagatagctatcgatagaaagaccaggtcctagccgataccacaaaagaaacatccaccctgcccattaagactaacaggaaactaacacagctcgacccaagccctgataagctgtagcaatctaacagaaattccatctgtcttcacccaagctactccaattcttcgagttgattagttggcatttgatcagtcagttaactgaaacattagatgcagtgcatttttatcatgatctaatcttcgtagacgtagttttctcgtgctaattatgatagctacactaaccaactaaccacttttgcccccttctttcgaaaaaagaaacttcggacaataggcccgaaattattattattattattattattattattttttgcacatttcagtcccaactattcaagtcaactctcgaacaattgtcttttaataactactgaaaaatctctgattcttctaactatttcagataactttgataaacaccaagttgtgtttaatttaacatttttttttctctttgtctctaatctcttgcaagaaaaggttgctgagctgaccatgacacggtgcatctgggaggcaggggtgctggtgaggatcatcctgtggatctggccacgaggggtcggcacgctggcgctgtgcggcccgctgtgcgtcttcggtgaattcccctacgtgcgccggttcgccgacaagccggtggagcggcgggagggtgcccttgaacgctcaagaacatttttgcgcttataatgtcctttgccacttcgtcttctacaccgtggtaatgttaattctaacgaaaatggttttttttattacgcgtaagacatataaaacatgaacgggtgatatatccctaccttaactagtaattttttattgacagctcactcacgtatattcatcgattaccctaacgggtggagtcgagtcatacaccaacgaggccacaactccaccaccttacaactagtcgtactttccgaatttgtttcgatttgaactttgcatagtaaaaaaaaaggatattgctaaaaaaagtttgggtaaaaaaaactttcaaatataagcatgtagtgcaactatatgtaatcactctttaacttaaatagtaatctctatgattcaagctacatatatttttttaatacttatacagaaattacataaaattacaatgtaattaaaatatacttacggtataattatattacaatacagttacatttgaaagtttttacataataaacttgtggagtttttcttagatagcccctaaaaaatctactcctggtttggtaggttccaagtgttaatatatcatatagtaagtttagactgtgaagtacttccatcccataataattgcattattaagaatccgtcttaggcacgtacatcggtgttattagtggtctctctctattgccatgcaagtaaatttgatgacatggaagaaagagaaatgtgtatggttgttatgcatgacaacagctcagagtcgactcttagtatttattagagcaaattttgttgcatggtggtgaaagaaaggaaagaaaagtaagaaaaagtattttgatacattaatgattagagaccatattgtctctaactgttataggatgctagt

SEQ ID NO: 25505 - DNA, 2866 bp, Oryza sativa
cgcgacggtcggcggcggctcggcggtgaactggtcggcctgcatccgcacgccggcgaacgtgttgcaggagtggtcgaacgaccatgggctccctctgttcgggggcaaggctacgtgcaggccatggacgccgtgtgcgctcggctcggcgtcaccggccggtgccgggaggaggggttccagaacaaggcggtgcgccgcggctgcgaagcgcttgggctgcgcgtcgaggccgtgtcgcgcaactcgtcggaggggcacttctgcggcagctgcaacctcgggtgccccaccggcgagaagcgcggcaccgacacgacgtggctcgtcgacgccgtcggccgcggcgccgtcatcctgaccgggtgcaaggccgaacggttcatcctcgagacgaacaccggcggcggcggcggccggcgcaagaagtgcgtcggcgtcgtggcgaagtgcttgggcaaaggcatcaccaagaagctccggatcgaggcgaaggtgtccgtctcggcgtgcggcgcgctcatgacgccgccgctgctgcgcaacagcgggctcaagaaccgccacatcggccggaacctgcacccccacccggtgttcatggcgtggggctacttcccggacagcacggcggagctcccgggcaagtcctacgagggcggcatcatcaccagcatgcaccgcgtcaccaccgcaccatcatcgagacgccggcgctcggcccgggcgcgttcgccgccgtggtgccgtgggagtccggccgcgacatgaaggagcggatgcggcggtacgcgcgcacggcgcacgcggtggtgctcgtccgcgaccgcgccgcgggcaccgtcggcggcgagggccgcgtccgcttcaccccgagccgcggcgacgccggcgagctccgcgccggcctgcggcgcgcgctgcgcatcctggtggccgccggcgccgccgaggtgggcacgaaccgcagcgacgggctgcgcctccggtgcaagggcgcgcgtgacgaggacgtggaggcgttcctggacgaggtgagcgtggagaaggggccgatgcacccggggtcggacaagtgggcgctccttgcctcggcgcaccagatggggagctgccggatggggaggagcgccaagcacggcggcgtcgacggcggcggcgagagctgggaggcggaggggctgtacgtctgcgacggcagcttgctcccgacggccgtcggcgtcaacccgatgatcaccatcgagtccgtggcgtattgcgtcgccaagggcatcgccgagtcgctcgcgtcgcgcgcagcgcgctcagtggaaaaccgtgatgtgtccacgaaccctcctctagcttgtgaatcgtaatacgattattaacttcttaattaatactgtgctttattttaagataatgaaaataaatctcagcgtttagcgcacgagcttccgggcaatttaacagtttattactctctctaattcatactccctccatccaaaaaaaaaaaagacaaactattatgtctgtgttcaacgtttgaccgtcggtcttattgaaaaaattatgaaaaaattaaaaagataagtcacgcataaaatattaatcatgttttatcatctaacaacaatgaaaatactaattataaaaaaaattcatataaaacggacagtcaaatgttggcatggaaacccacagtttgtcttttttttagaacggagggagtattgtttattactttctatatttaatattataagtcgttttaatcaaatatgtataaaaatataataatatttttaacacaagacaaatatattatcaaaatatatttaatgttagatttaacaaaattaatttggtgttatatgtgttgctatttttcttcacaagtatggttaaactttaggaagattgattaggaaaatgtgaaacgacctttagttctaaattttttcttcaaacttcaacttttccatcacatcaaaactttcctacacacataaacttttaacttttccgtcacatcgttctaatttcaaccaaacttctaactttagcgtgaactaaacacaccctaactcctcttcataaatcactggtgaaaatgtgttgttggtcacgtgttgattccaaaaatcagtcgtaagagcatcgaaccactagctgacaacttttaacactgagatttcaaattaaggggtacaaaaatattctgaaaagggaaggagtagaacaaatgatcagctctcgggcaagcatcgacaccaaggtcttattacggatagatgtggatggcggtggagcatctccgatgaacgcataagagtaaaggcaagtccatgccatggtggatggcttcgcgatgctctaggagcatcgaggactttgacgatctgcggaagacagtgatagcatggcagagtgctttacgacacactagaagtgttcagaatgtggtggcgacgtaaggtgatttggaaggcgatgacgaacaatagacacaaatagttggcaaccgatagtggttgtgatccgtatagctggagatggtgtggcaacgggtagcacggagtactttccattcacccctttcgccctctctcatttcgttaggaagaaaaagtcgttgataaaagattggagtataattaattttgaagggaaatggaaggcatccttcttgggtcccattaagatcttattcggttaatcccttccacaaaaaaattggggggatttggaaggatttttccatatctattgtgatgtattctcccccaaatcccttttttgggattaaacgaacaaggcctaatgctggggctgaaaaagaatcggcctacgtctgacgcatgcattctgggcc

SEQ ID NO: 25506 - DNA, 2456 bp, Oryza sativa
tatatcacattcgtttaaaatctcttatttttttgggacggacggagtacgttttaaattgagtgaatattagatgttcgaaggtgcattgcagttttacttctgtttggagcaacgaagccttccatgtgattatgtgaaataattcaatttgaaaagattccttccaggtttctgttttccaatttccattcaaggcccaaacaagaaatttatttctcgctgttggcgcactatcccatccaaatggaccaatgatcatctagattcgttgcattatgatgtattacattcaactaaaatctttatatatagggactgagggagtacatgagctgcctgacttttgcttttgtgtcatctgtcactgacatcgactaattaattcgagaagacgcaaatgaggaattttgctacacttggcggttgattagcatttgggccttctaattatgcgtgattgaactttgcacgttgtttctttgccaaagagtggtttttctacgctttattagtgctttacagatcaactgaatggtggttcgagtcaccacaatgtcctttggatgttcacaaatcacaaatacttcctccatttcacaatataagttattctaacattttccatatttatattaaagttaatgaatctagatagatatatatgtctagattcattatcatcaatatgaatgtggaaaatgctagaatgacttacattgtgaaacggagggattgtgaaccggagggagtagtgcttagcactgttcgtttcagaggttggaggaaggagcaattgacttatcgcaaaaaggcacttaattgagaaattagttaaatattaactatgacaaaattaaaaataaaattatttattttccttaaagaaacttctatataaaattttacttttcaaaaatcacaacatttagcaattttaaaaagcgtgatcgcaataatttaatatagccaatagctgaaaagaatcatggcgcctaatgggttggtctcagagtgaagcaagacagttcaccttacgaatctttggagataatccggagtcacttccttaccatctggtaccccaaagccagatgaaaaagccgcaaaccaagatttgaaaagatgaggtttgagcaccaactgtttcctcggcttcatcatctccgagagagcagttcaaatcaaattgctggctcaagggttagtgaagtgaaatgcagataccatatgacacgaatttaaggttacgaagtactcctttcgtcctctaatataagagattttgacattttgcttacactggttgaccattattacttaaaaaaatttagaataattatttattttatttatgacttaatttattatctacagtactttaagcacaacttttcattttttatatttacataattttttttaataagacaagtgatcaaatcttacaattaaaatattaaaatcatttgtattagggggcggagcggcggagggagtatgaactatgatcaataatgaatcgtggtggcattttgcatcatgccatcatgtagggttgactgccgaaaataggtagatgaagggggtctagcttgtagattttagatggtgttcttttctcctgaaaatgaagatgaaaattaagtttttttacgcaaaacgatatggtattaatgtatgattgattgaattttaattattataaacttgaaaaatagattaatatgatattttagggcaactttcatatagaaagttttcgcacgaaacgtaccgtttagcagtttgaaaaacgtgccacgaaaatcttaatgttcatccaactcttattgaagaaaagatcaggattttttagaaacaaccccaccttttggcttacaattataatctgtaacggcttattaatatgaagtaatttataagtaaatttttttgatttatatgttctatcaggtatagtaagcatcgtggagtactaagaagaacactgaataaaaaatatttattattttgctatgtatttgtcctcacctctctcttcatgctattatttgctaaatggtatttcctccattttatacttatataagtcgtttgattttttcttagtatttaactaaatttataaaaaaatagcaacaactgcaacaccaaattagattcattaaatttaactatattttatattataagtcgtttgagattttttagtattgaaaatgtaattatattttctacaaactagtttaactaacaaaaaaaaagtatacgacttataatataaaacagagagcgggagtatactattattgcttgttatccatttgtaaatttttaacaatagtttttgttgtggttggtagagatacattggtctgcctgccgtagcagagtttgattaagctgggatgtactaattgatcatttctcacatataaagcgtataaattata

SEQ ID NO: 25507 - DNA, 643 bp, Oryza sativa
ccatgctgaaagaaaattatggaatcacaagctgctatatgtacctatgaattgaatccttagttttttttttgttcaactcattgattgttcttacttcttcttccccctccctgtaaatataatgttcatcctaatcatcaacagagctgcagcaaatggcgataaaattaattaactaaccgatcgcttaattaatccatgcacgcaagcaagcacatgcaatatcgattgattatattggttcttgagagatcgatcgaggaattaattggggaatttgatggatcgatcacaagttcatcatgtccttgacgaagccgtacttctccatgaaggggttggcgagctccttgggagggtagtggtcgatgcagtccttccagacgccggcgtcggagacgggcttctcgacggtccagacgcagctgttgcacttgaagccggcgccgaaggtgagcatgaggacgcggtcgccggggcggaggcggcgcttggcctccatgtagccgagcacgtaccagacgctgctcgccgacgtgttcccgaacctgtgcagcgtcatccgcgacggctcgaggtcgtgctccgtcagggtgagccccttgccgacgccgtcgatcaccgcggcgccgccggtgtg

SEQ ID NO: 25508 - DNA, 730 bp, Oryza sativa
attaatggaggaggaggaagaagaaggagctagctagctgttagtataagctatgggggcagtatggagcagagcagctggctcacatgcagtgtggttgaaagctcagtccagtgcagcgcagctctagcttcacgatcccatttacttctctgtcgatgagcgatggagtattggagtgtagtaccaaagagtgtgtacttctactgttctactacaacaatcatcactgtattctccttcatgttattataggtttttatgaaatttatgaaaacatggtggagagactgaaagcctgaaaagaaaatctattatgcatttgcccataattaaatcttaatattttgacgatcggaaacagtctaatacgatattttcaaaacgaatatctctctatatgtatatatatataatggaccaaaattcgtgccttctaataagggtgtgtttagttcacgtcaaaaattggaagtttggttgaaattggaacgatgtgatggaaaagttgaaagtttatgtgtgtaggaaagttttgatgtgatggaaaagttggaagtttgaagaaaaagtttggaactaaacaatgcctaaatggtaatggtacatgcatgtacatccttatagtatactaatatgcactacttgtagtagatttaataagggtagcatgctgtatgataaatgataatagtacatgcacaagcatctttatagtttactaatatgc

SEQ ID NO: 25509 - DNA, 1734 bp, Oryza sativa
tacggtatctacggatactgtcaggagagacatagcgctgtctttgatctcgccggatgcagattcgaggagaaagactaccttgttgtcgactacgagtcacacttcagaccgccaaatcaacaacagttagataggctaccccaaatattgtactggtgtgattatggtgaataagagcaacgaccggcttcggccaacaggagtagggttattacctgacaattcagggggcccaaacctgtataaaaatcctcgtccacatctcttttattataatctcgcatatatcctagtaccaacgatccctatactatgtaaatgaaattgcgacatcaaacgtcggcaatatgaatcgaaaaaaaaaaggagggtttggcttacttatctggactgtttaattagctcttgcgttgagatatatgatatcatgatcgaacaagagaggcggggctagctgtaggcatgtatggatgcacgttatctatggtactgttacttgatatgtaagtctcacttgcactctctctctttcgactgcatgtaccaagatgcatgcattccccttcatgagttgatcatatcaaaatttggtcctgccaaatgattgttactgttcagtagttagctgttgatttagctggaattggagcttatgtacgtcgaattgaatgtgaagaggcggccggcgtcgcgtgtgtatatatgctcactgctcaacaccgtctcttttaatttcgttctgctgtactagagttatgagagactgtacaccgtactcatacataggctgtgtttagttcacgtcaaaattagaagtttagttataattgaaatgatgtgacggaaaagttagaagtttgtgggtaggaaagttttgatgtgacaaaaaagttataagtttaaaaaaaagtttgaaactaaacacagtcatattcccgtaatgggcagcaatgatgggcgtggccgtatttggttatgaggttgatcagtaatcaggcttaagacaaaattgtcattaaaattttttttgtcagcattcgaatattttggagtaatcacgagacagagcatcaccgggttcgatcttcacgtacctaaattgcaacaaggaaactttgaaaaagacgtgccatcaacaatcccatagccccatactctcgattcatagcccccacaacccactccatcttcttcctctcgtcgctgccccatgccgtcttctcccggtttgtgatagctcatgccgtgtttttttcattgagttgaaacttatcttccgcgcacttaaaatagagcgactcactgacacatatgattgattaagtattatctggagtaacttttttaaaaaataaaataaattaatgtgatttttagagcaactttcttatataaaaatttcttataaaaaacaccatgcttaatagtttagaaagcatgtatgaagtttagacaagtgagaaaaaaaaccacatccgtcaccatctaaccagttctttcttttattacttatttctgccatcaccaaggccgtgtttagtttcctccatattctcaatttttcatcacatcatatcatatcaaaaacttttctacacacataaacttttaactttttttccaaacttccaactttctttcaaactttcaacttttttcaggatctaaacacggacttttaggtacattctactgctagtatatactactagtatatttgatctaatggtg

SEQ ID NO: 25510 - DNA, 620 bp, Oryza sativa
ctctccgtgggatgtccaacaattatagcttggcatgaaccccgactcaaacaagtggaaatgaatagtccgggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttatttttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattgg

SEQ ID NO: 25511 - DNA, 736 bp, Oryza sativa
tgttatcccatcctcagtcatgcctacctgacatacatgcaagtcactgaggagcaggaagcaacgaggagtcggggtgacgtcatcatgcatgcatgttaactttttaagcgaactttaaaccgatttttctcttaaattacttatccaaatcatgattcaattgcaccattaaattcgttgcaatcaaatcttcaaaacaagaccacacatggatatattccgacgaaaaaaattaatttattattgaatttttttaaaatgttgtacgatgttccaccagatatatcggaatggtttcactaagtagatcgaaaatatttcactcgtttaaattggatgttgtttcaacttatataaaaacaatgtttcagcaaatagcgaaagaatgtttcagttcactgcaacattagatctatacatagtgaaacattgtgagtacactaggttaaacatttttcggtggaacaaaaaaaaataaaccaaattcccttaataggagatgtccaaaatatgtgggctttttgttgcaatggaatgtttcgttcagtgcaacattagatctatacatagtgaaacattatgagtacactatgtgaaacatttttggtggaacaaaatataaaacggatttccttaatagaagatttccataatatgcgcgtgatttgttgcaagggcgtcttctataatatcaaaatctattgcaacatttgatccgtacacagtgaaacat

SEQ ID NO: 25512 - DNA, 17029 bp, Oryza sativa
  unsure (1)..(17029): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcctggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctgggctgtaaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacctgaacaagcatagcaggtgatcaaatcacaacaaaactgcctgtgcaagtcattcttttcaacatctcatgagtgaattgcacatggaaccacttatttatttttacccatatgttgcaaatcggattaggggtacatcaatctgcttatgcaatgcattcttttacaagatctataaacctcagctcctactgtagtaatgtacaactgcagaaactgcttgagagtttaatctcttacagtctagcggccttctagcgctgtcaggctcgcgttattaacggaactttccgagccttgtctttcttcttcgtcgtaatgcctttgcacgaaatatataggctgcttcggtattgggcgtgccatgtcctcgttgtccagcatcgacacaactaatgacatatgcggcctggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattagtaaagatttcttaacttgttttaactatattgtgttcgaattgttaacataagtattggtagcagcatgcacttacataagctataaggttcggaaaatccatcacaatatgatgaggggagctgatctttaatccacttacaatctccagtagcaatacgccaaagctataggtgtcagatttgactgaaaaaatgccttccattgcatattcaggtgccatgtagccgctatttaaatcatttgcaagcaagcaggaaaaaagtgaataagttcaagcacatgaatatgttgaactagtcggctagagaacaagtccacttactaggtcccaacgactcgtctagtacttgcttgctgttcactgtttccaaaaatccttgccataccaaaatctgatatttttgggttcatctctgcatccaacaagatgttgcttgtcttgagatctctatgaattatcatcattcttgaatcttgatggagataaagaagtcctctagctacccctttgattatgttaaaccttgtttgccaatcaatcacagacttcattgcgtgatctaccaagaaaatggataatggacaggaatgaaaccattagagaattcgataatgttgactcctccattagagtatgcactttgtcttaatggaaattcaggtggggaacctctcccctccggtgaacattccaaaaaaaaaaaatcaagacttttttttaatgcatccttttctgaaaaacaagcttttcatttaatatctgataaaacttaccaaagaggaatttgtctaagcttttgttgggtaagtattcataaataagcaacttctcatctccatgaatgcaacaaccaagaagtctaactaggttcttatgctgcagttttgcaataagaactacttcattcctaaattgctctaccccttgctcagaatccttgttaagccttttaacagcaacttccatgccatcttccaatgttccctgtggtatttcattaccatggagacatggtgttaaaaaagaataaagtgacatgaatgctacactcacattgtgtaatttacaaggtaaaattttataccaccttatatactttgccaaaaccaccttttccaagcatgttagtttcatggaaaccgtttgttgcagaggtgaggtcttcatagctaatatcagggaactctagattttgatcccatgagtcatgaaaagcactcaagtatcctagctccgtttttttaagtacttccttgtttcgtcgtatgcctaatataaatatcaaaacatgtcaacacaacaatattacatttagcagctgcatattgcaagtagctgttatctcttgctttacctcttgactcgcatttacagagtacaacgcatgagcatgctgtcagtatcagcaggcatgctatagctgggagtacaatctttacaatgttcttgttgtttactgcagaatgacatttatcgtcatgttcatggagaatgtggggcaattgctagagaaaacatcatgagacggcgcatacctgcaggagagccggcgagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctcctcctttcttcggcatcctctggaagagttgaggctaaatccatcggccggctcgaagccatcaaggcacttgcactcctggaagctgccggtgatgtcgcagtagccgaacggcccgcaggcgccgtagtggagacagccatggcctggtcgctcgaatgggctcgtccaagtcgatgatacgttgttccatgcccggaagctcacgttcccggtgtagtccagcttccagtgtgtcaaaatgccatcagctgcgttgtatatcgcgtagatctcctcgccattgtcaacgatctgggaccatatgtacctggtgaggccggtggccgtcgcgccgttccagacaccgctgcgccacgacgggctcgccccatgccagatgacgatatggagcccccactggtcagggtcaccgctgagggagaactcgcaggtggacgggtcgcgacgacccctccaagcaactacgcgcaccgcctcatggttcttgtatgttcgtccatagcttgaagccagggaggccagggaggatcgtgtccgtggggtgatcgggcaaccggagcacgaagttgcccgtgttctgcagcaccgcggtggctccaccacctccgatggtgaccgtgttcgccgtggtccccttggagtcggatagcacaagcccggaggtgttggtaacagccagcctcgccgtatgggtggtgattgggttgtcgcggttggcgacccagacataggtgcgctccgggatgttgttgtaccatatgccaaggtagagcaggcttggggttgagttggtggtggtcagggagaagaagccgacagcaaagacgccgccatccgagatgagcttgtcgccgccggggaagatgagtggctttgccggtgttaggcggtcatcggattggcagaaactaatcaagaacatgaagatgactacatgcagtctggtcatattctcttgtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgtaaaagagtggtttcgctggaatgctatcccttcaaactgattcattaaaatgctattctaaattgaaggtgttcaccaaaatgctattttcgtttttttaggtaaatagaaatgttttttctcaattataacttttttccggaccaaaatacccctgatgcgggcccacctgtcatactccctctactctctcctcctcttcatctctctcgagggagcgccggtggttggaagcgagcagtggccgacagcgccgttgaagctcggtgtcggcctgtacgacagcgccggcgactcgccaccggcgtacgacggcgcggtgctcggcggctgcgatggcgcgcggaggcgccgctgctcgtggtacagcacctgcaccaccgtctgcaccggccacataagcatttagtggagtgattaacgaaggatttagccattttttagtgatcgatgtgaatggcagcttctaaccttcaagtagatgtcgatggcgtggtacatgccgtcctcgttgaacctggcgtgctccgggatgagctcggcgagggcggtgaactagtcaatggacaggttctcgtcggaggcgatctcggcgaggtagctctccatgagcctgccgacctgggcgacgtcgttgtgcggcggcgacaccgctgagctgaagtcgtcgtcggtggtgcagtccagccgtggcggcgccgccgccgcgtcgccctcatggtcgaggtagccggccaggatcctctgcacggcgtcaatgtcgtaggccgttgtggcggcggcgtcgggcgaggaggacgggatgaggaggtcgtcgagcacgggctagccgagctgcgccgccatcagcttctcgaggtcgagccggcacgccagcgacggcgacgcggcgccggccactgctcgcctcccgccaccggcgctccctcgatagaggggagggggagaaggagagagtggagagtatgacatgtgggcccgtagcaggggtattttggtccagaaaaaagttaaaattgaggaaaaaaatttctatttacccaaaagagtgaaaatagcactttggtgaacacctccagtttaagatagcattttagtgaattagtttgaagagatagcattccagcgaaaccactcttttacgatagtataatcccaattttctcgttgagagtggccagatgatcagaacgacacgctagtagttgtatgtcaccgttaagattgaagacccgatttattgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccagaacaaattcggcccaccagtccgcgaccggaactgtgagattcgtgggccgtgaaagtgctcgtgatgggctattgggcctaggtcgattgatctgtggacgaagacgaacgtgcttcggttacttcgccggcggagtggtggttggcggcggtggggggcggtgagccggcgacggtcggcaccgcacgtcgaagcgcccggcgtccgcggtctgccgctcccggtggagctcggcgaggtggcggaggcgttgcagcctaggagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatagaaagtcataacacaccaaaaaggaaggcgtccaagcttttgttaggcaagtattcatagatcagtaacttctcatcttcatgaatgcagcaaccaagaagtctaactaggttcctgtgctgcagttttgcaattagaaccacttcattcctaaactcttcaatgccttgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgtttttctttccaactgcagaaatgtacacctcagatgttagtgttatggcatggagcataacttggaaagttaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgctgtcaagtgtgaggcgtgtgtagatggagctgtcggagacagtgtatgagtagtagagcttgttccctgagtcgatgagtgtttgatacatgaataagctgctgttactcggatactgggcgccggacaccgtcacgctggttctgacgccgttacggcagtatggcttggtcccgttccaggtcatgccctggaggtccgagctggggtcgaggctgaaggagaaatctccagtggatgggtcatcatggctcctccacgcagtgaggcgtccgatgatctcggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatgtggccttgggagtccgacagcaccatgcctgagctgttggtgatggcaagggtcgctgacgaaggggtggtgattgggttgtcgcggttggcaacccacacaacggtgcgctgggggatgttgtggaaccagactccaacatagaggctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataattgagtccacaaatttctctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatatgtgtcagacttgacagagaagatgccttccattgcatattcaggagacatgtaaccactgtttgaatcgtgccaccaataacaagaagtgtgggtaatttgaaagtatccaagtatataaaatttagtattttaatcataagtagtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtacgggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatccccagtccagagcaagcaccttgactgatcggacatggtgtcggctttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccaggacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgttcaaaaggtgtggccttctaaatctgacaatacaaagttagaactattgctgatggcgagcatcgcagatgaaggggcagtgatcggcttgtcacggttggcaatccaaacgtatgtgcgctctgggatgtt

SEQ ID NO: 25513 - DNA, 15651 bp, Oryza sativa
agactttccttcttttttttttttgtaaaccattgaaaatgaaccatacacccacaaagcaatcatattcctaggttcttgcacaattgatcaagtggtgaattctacagccagctaaatctgaaattaaacatctaacgtccttgtagtgtggtaagacttatactgttcacagacttgttggcatcctctcttgcccctcctgccatgcaattccttggcacaaaatatgcaggttgcttaggagtaggaagtgttgtggcttcattctcgagcatggccacaactgatgacatgagtggtctagcatttgggtcttcctgaacgcataacagtcctacatggatacagagcaaaaactcattaagtgaatatatctgcagaataattgagtccacgagatcctctgcctttccattcttccacaagctccatgcctgaaccaagggaacaaagttcctaattagtgcaaaatcctagctattgaaactttatgcattttgatatttcttagaacttacacacttacacaggctataagatttggaaaacccattataagatgaggagagcttatcttagagccgcttataagttccaaaactaaaacaccaaagctgtaggtgtcagactgacagagaagatgccttccattgcatatcaggagacatgtaaccactatatgaatcatgtcaccaacgagtgtaagttatttaagtgttttccaagtatataaaagttagtattgtaatcataagtagtgcaatagttactcactatgtcccgactacatgtctagtgtttgcttgatgctggttgccaccaaagatccttgtcatgccaaaatctgatattttggggctcatcccctcatccaataaaatgttgctcgctttgagatctctgtgaattattgtcatcctcgaatcttggtggagataaacaagtcctctagctactcctttgattatgttgaaccgtgtttgccagtcaagcatagacttttttgaatcatctaccgtgaacaatataaaacgatacttatagttgttcacacatggccttttggtaacagtcttccaccaaacgtggaaaaagaaaaggtaaaaaaggaatatatgattaggacataccaaaaaggaagtaatccaagcttttgttgggcaagtattcatatatgagaagcttttcctctccgtgaatgcagcaaccaagaagcctgactagatttttgtgctgcaatttggcaataaggaccacttcatttctgaactcttctactccttgtccagaatgcttgctagccttttaatggccacttctttgttaccgcctagcatgccctgcacaatttaatcactttaatttttattaagaaagttcatcgggatatacacttgttcacacagtatcatggatgtatggtttcacccctgaggttctatatttgattcttaacacaatcatacattcttctcaattatttaacaccaagtttgttggaacaaaatccaataagcatggcaagggcttcccttcaatgggagggaggccaagcttggtcctgtgaggagatgagaggaagaggatgaaggatgagagccctttcctcgaatggttcctgtgtcatctagttcaattctgccagaacaaatacggcccgctaatgcccacaaggacgccaagcccatgttgacaagaacccgatttcaagtcgagatcaatgggttacgggtgtgtcttcttaactcgtttccggtgcgatggctcaaagtttgggtaccgaggaacaaaatcgatggtaaataatcaattttatcatcacaaaaaatgcaattgtatgccacatatgttacggtcctactcctctccaaatatcaattatacatgtttcaccatgtgctcctaaaggaagcacttagcgtgcagaaaaataacataaacacctaccgtccctctaataagctgatgctattttcacctgtttgtctgccttcaaaggccctatgtgcaaaatacacaggctgtataggagctgaaagcgttgtggtctcgttctccaacatggacacaaccgaagacatgagtggtctattatttggattatcttgcacgcacaatagacctatttggatacatagtaaaacttcagttggtgagcaactcttagaaatggatgagtccatcaaatccatcgccctgtcgttcttccacaagttccatgcctgaaacagtggaatcaagtccatataaaattagtacaattaatctgaattgtagagataaagcattccaccatacttacataagctaacaaattggggaagtccgtcagccgaggcaagctaatcttcaggcaacttacaatctctaagagtataacaccaaagctatatgtgtcggatttgactgaaaaggcgccatccattgcatattcaggagacatgtaaccgctgcttaatgatttagcagtaagtaaagattcgagcaaataaacattgtgaacattaatgcatgaatgactcactatgttccaacaactctgttagtatttgcttcatgctggttgcctccaaagattcttgccataccaaaatctgatatcttaggactcatatcaacatccaataagatattgcttggtttgagatctctatgaattacagttaaccttgaatcttggtggagataaagaagtcctctagctactcctttgattatcttgaaccttgttggccaatcaagaacatatttatttgcatgatctataagaatggtaaactatgttattattaagtatgcagccaagtttctttggatcatatgataagtttatgcaatactgtagtatataaatctgaacagtaccaaaaatgaaagcatccaagcttttgtttggcaagtattcgtaaattagcagcttctcatctccgtatatacaataaccaagaagtctaacgaggtttctatgctgcagtttggcaattagaacaacttcatttctgaactcttctgctccttggccagaacccttgctaagccttttaattgcgacttctttgccgtcatctagcattccctgcataatttaatcactttattttttttattaagaaggctgttcatttgtaaatgagtggttttacagttcctaaagactgaagtctgaaaaggtactacagtcttaatgttaatttgaggtacctccatatttgggatggtaaaaatctctctgctaatttatcagtacactgcaggggcattcctacttcctagttccttttttttttgacatgctacttcctagttcctagttcctacagcatactatacggggtcacgagaccctaggtaaaatttcaatctctagttgttttagcctatattaactatattattagttaaaaattatagtattatatatgttagtttttgtccctattgtaattctcaagatagaacttattttgtaccttgtaaaccttcccgaagcccccttgtccgagcatgttgtcatcagaaaaattgtttgtggcagcagcaatttctccaaaactaacaaacgggagctctaaattttcatctccaagttcatttgatgcactcaagtatcctagaatccctctcttctggacaaccttattctgatgacgtttgcctgacaggactacaaatatatatagtgtgttaatattagctctagtaggagtagaggatataagctgcgagtattacctctgcacttgtataaccatacaaggaatatgctcatcagcagaagcaaacatgctgctgtaagtgggagcataatttttaccacagtcctcttcttattgttaactgaatgggaagaaaattttcaccgagaaaaccataaagtaattaattgctgaacccattagtttcaggcaaatgaatgcacatgcgtgcaattttgtgatagtcatgtgtacctagttcagactttgccaatctcacatgcaagtcctgccctttgtccacataacgaacatcaaccatgtcgccgatccacatgacgcagccgcggccgctgatgtccgcggcggcgtaggcgacgcaggaacagttggccaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcacccaccggaggtatccctcatggaccaccgcgagggggacaccgggctgaaccccgccatgcagctgcagaagagcgtcgacgcggtgtcctcgttgcacagcccgaacgcgccgcacttggcgtagtcgtcgcacacgccgcgcggtgccttcatgtacgggatccacaccttgctgctgggatcccacacgaggcgctcggtcacgccggcctcgtccagcacgaggcgggagaagggggagccggcggcggcggcggcggtgaagacgtaggcgatctcgtcgggcgtgaccaccacctggctcgagaagatggattcgtacgacgccatctccgggacgccgctgaaccactgcccgttccatggccccgtccggtacttcttggcgccgccgcaccacgtgacgcagtccgggagccccctcgtgtccagcacgcggcggcagtctcccgtcgccgggtcgtcgtgcgcgcgccacgacgagaggaaccacgcgtcgccggtctgccggttgttgccgagcctcatgccggcgatcagtgtgttcgacgggtgatcgaacgactgccagatgaagacaccggtgttcagctggtcgcgctcgcgcacgacgaggtttccggactccagcagctgcgccgccgtcgctgatgaagacttgccagtcgtgttcgacgaccaggcggccctgccggagccgtcgagtaggacgagcccgcccgcgccattgttaaccagtacgccggcggtgtcgttcagtgggctgtcacggttggccacccagacggcgtccgcggactcggagaaccatatcgcgaggtatctcctgtttggcaagccgagtgagaagaagcccagagtgaaggagccaccggccgacacgagcgtgttgccgtcagtgaggttgcggccattgctcagagtgtccgatgcaacgccggcggcagatgttccgagagtaaggaggaccatgaagaagaaggtgaggctaaggtggaaaatgttggcggttgctgcttccataacgggtgagtttttcttgcacgtccttgcccagaattgttcacggactacagtgcacgggaacaggttggcctcacaagtatcatacatacacggaatctagtgcccgtgtaggaggaattcaaacgcgttctaacttccaacacagtaattaatatcccacgattgactagctagctagatgcatgagtccatacggataagttgcaaagcagcggaaactgtagagaagaaagatgcatgagtccatacggataagttgcaaagcagcggagtttattgcatgtcagttagatagttatgaaaaatttttaaaaaaattgacaagatagatcaatatgtattatatcactccataaacatacaagtttaaattcaacttctacaagctgtaacaaaaataacaaatttaattgtaaatatatatgtaataatttgagttttgtttgttatttttgttacaatttgtagaagttgaattttatcttgcatgtttgtggattgatatattacatattgatctatcttgttcatatttttttaatttttttcataaccatttagatgacatgcaataaacatccattcgagctgttaaaacagttttccctatttaacgccttggaaagtgcgcccatggtaatttgattctgaatataacgtactagccaagttactatgatagtgcacacatttaagggtgttcaaactactcacaaaatcaaccttttcaaaagttggtaataccaaaactttgataagttgacaatattattaaattttcatatgcattaccaatgttccgtaacaaactaaatgaatccatatatttatcgaatttacctgatatgaattaaaatggcatcaatataaataaacccttacacgtatgattggtttcaaagtttatagtatatttatgtattatctctacttaatttgtttttcaacctcaaatggaaaatctgattatttgatggaaactgtggctttcctggtgtcagccgatcatcagttcggcgaccgagaccagccgcaggagatgagaaaagtagaccataatgaaccttaggatttctgattcgtttgattgtcacgactcatgagtcaaattatatcataaattcataatgcagatatgaaactgacttgtgtagttagagtttaattccattgctatcaacacctttggggattggaagaaatgaagctgtttaagtcttgattcagaccaatggaaatagacggtgaagggactagtcgaaagctgaatatctcatggccagttcaactgatcatgataaagttttctttttttaaaaaaaaaaactggtcatgatacttccaagtcttgtgacaacgctgcacgaaaaaagaacgccatgaccacgaatttaggttggactttggagggagcgggcagagcaggcgaaagccaaacctcgcgtctgtcccatggcgtggcgggttctcctaccagcgttgggtagtacttcctccgtattaggttacacaagtcgtttaaatttgttgtcaaaattaaactatttcaaatttaattaagctcatagaaaaaaatagaaacattttcaacccaagacaaaatatttatgaaaagatattcaattatcgatttgacgaatcgaatttggtgtcgtaaatattatactatatttgtctacaaacttatttaatcttgaagcagcttgactttgatcaaagtcaaacgatttataatctggatggagtagtaagggcatgctcaatgtataaggtctacttggataataaggtaggacccggtattagttatagtgtttgctacaatgtatatgataagagaagacattagcctgggtcccactggtcccactcaattgcatggcatgtgagagagaagatgagagagagaagagaaagtattgctattttattcttatgggtgggcattatgcatatgggtagctcatgttaaagactactatatggactactatcacaatgttgtcatggttatggataccacatacctaataatagttgactaaatctcggcatgacccaccacataccatgtcctatacggaaaccgacttcagatatggagggagttccggataaggaaagacaactagagttctacatggaaacgacaaggactactcggattgtatccatattggtttccctagttctacttggacaagaggacacctatgggtataaatacaagcccccctaggaggacaggggggacacccaccatgagacgatcaacacgatcaccacgatcgggacgaccacctcatcaacgcccaacacaatccacatacaagcctatatacgccaagacacgctgccggatatcgacttcagggataggcatggctattcccctacggtatctccggataccgtcaggagatacgaaagcgctatctctgatctcgccgggcacggattcgaggaggaagactaccttgttgtcgactatgagtcagactttcagaccaacatgtcgataacagttagataggctgcccacatattgtactggtgtgattatggtgaataagagcaataccggcttcggccaacaggatgtagggttattacctgacaactcaggggcccgaacctgtataaaaatccctgtctccatctcttttacctcagtctcgcatatatcctagcaccaacgatccccatactgtccaaataccgtagtcgagacatcaaacgtcgacagtggcacgccaggtagggggattttggtgctctaggatttcgacgagatgggttcaaacgatggattctccgacaacaagttactcgacaacttcggctctgggagatccaacctgtccaaatacatcttccgacgagatcagaatcatcaccatcgactattcgatcaggcgagatcgaccaagcttcaagacgtcgccgtcgcggaagaccttgacgaattaccgccggaccagggtcaactacacgtcgtctacccgccaatcaatcagctggccgactgcatctacacatgtattaagcatgtatgcggtgggaaccatgtacagtaatgcacggcgtgtaccgaaggcttttttagccataggtatgcttgcatgcgtacataggtgccatctagacgtgctaattgtggagtacaattcaatttggctaaaaggtaattagtggattgacttattaattaatctactaatttcgtagatacattgtaacgctccacttctcgtgagatgttaaaaactaattcggcaaatcctaattgtgaaaaattttgtcctttgagtgcgagtctaagtcgtgccgtggatctcaattcaaatcccgttgttccctctcatcgaaatcaaaatcccccgcctcaaatttcctctaccaattcaagtctccgaaatctaattccgaaagtcaatcccttcctttgaatcctcgccaaatacatttccgaatcccaaaatatccaaactcccattttgtttccttccttgactccttgaacccttgtgtacaaagtatcaaatttagattcaaagcccaaactccaaatctctccaaatcaaaatctttcagcaaaagtctattttgcctcccttgtcgatgggctgattcctctctctcccggcccatcccctcctctcggcccatctctctccctcagccgctccttcctccctcgcgtgcctcgctcgtgcgccgctctgagcgagggtgctcgctctctctctctctgtatctctcactctctccctcgtcgaactccctctccccggcgccgatttcccgccaccgctgttcgaaatccggccgcacccccgcgtcgcgcgcgcgctcgctcgcgaggtggccgaccgactggccgccgccgccatcagcccttgcgccaccgacgccacgtgctgccgccttgcccctactccatgacaaaccgcccgccgccgtcatcgccgacgtcatccatggccctcgccactccatgccgcatgcgtccaaagacgtgaggctgggctcgtgctctcatctttcttcccccccaaaacggaaggagcaaggctccctttcctcctcctcctttcgctttatcccttacgggcaaggccgcctcgctctctcccttgtcctggtgcgggagcggacacagggtgccgctgacgccgcctttgcgccctaccgcgcccacgccaccaccgcgaccatgccagctcgccgcccccaccttgaccgtgctagcccgcgctcgcggttcgattcccaccgcaaggtccaccgccttcgtcgcccaatgcatccacgtcgtcgccgctttcccaccgcccacgaaaccgccgctgtcgccagccaagcgcctcttcacctataaaatcccaaccccatgcccacaatcctttgcccttcaccccgtgctccttgaaacggagtactaccgcctcctccctcgaccccggtggccgtcgcgcggccaaccccagagcaccgccacctccttcatcgtctcggccaagaacgccaccgccgcgaccaaggacgtcgttcccacacgcttccgacccctttcccggcgcgcccgccgcggcaccatgccacctcggcatcgtgttcgtcgccgtgcgccgctgctcgtccatgcgccgccatcggccttcctccccttcccatcactgaagtccggcgacgccgttccccgctcaacagtgagctcctcggctcctccctcccgttggcaccccctttccttttccgcatcgtgtagctctcgccaccgccgcttggcgccgctgcgtgagcagccgcggcgagcttcgccgatgccgcacccggctgtgcgccaccgtcggtctccctctcttcaagcccgctcgccattgccttcctcgggaccccctcgacctccccaatcctttcctgtggccgccacctcagcggccgggcccgcttgaccgagtcagcggcgacctggttagccgcctcctcagcccctcccgctcgtgggcttggcccatcaaccaaccttcccttcggcctgatgaaacagaaaaagttcacttataatccctcctcccgagcccagtacccacacctaagagctaaagtccatctttaatcccttccccaaacacagtgaccaaaagtccatatctgctccctctcaatttactctctcttaccttcttgttgaccccacttgtcaatgagtcaaagatattctcgagaatatcttttccaatattccacaaatatttccctcttctagaaattcaaaaatcattttatcttattccatgagttaataaatctttttcccttgttccataaatcatttccattggtcccacacgtcagtgactgtcaataatattcttgagaatattatttatataaatttcataaatcaatttccccttgttccacaaatatcttccttcgcccagaaattccacttaaacttccaaaattcatatctccctatccgtaattccgattgactccgttcaacttccaataattccataaaattgagatctatttaatggcactattatttagtctaaaataggatcttttcttggtctttgtttaggttttaattgtttgcgtacagttgcggttgccggattttcgtcgatcgcgggttttctcgaagattcgtgaagaccttgagcaaggcaagtcaccctttgaccaattgctcctataattggaaaatcattattattttgtttgcaacttgcattagtagaatcacacactcaacttgattggcctcggtttgcgtgccaaaccgacggacctaccaagtagtcgcactaattcctgtaggttgtactaccctgatttcctcgtcgctccacctttgtggtacctcggtatccgtgctctttgagcgcgaataccaaatatcccacatacaccgttgtttgtcgaaaacttgggaaatgggtttgagaagccttgaaagcccgacatgtggcgtcggtgtgtttgaaaataaaatggaatgtgaaaactcgcgatgcgggggttgtgcctgtgtggcactgtcccgtattcgcatataaggaccgattcctgtgggaaattcatccgagaatataacaagtgcgaccacacgggtgcaatgggacgcccctggctgagtaattagctaatcgggggagccatgatgccaagagacatgtggattcaacggggtggtgtcggggagaaccctcgggcttcctggcacagtatggtctgggacccctcttgttggcatatggtgaacctgtgtcggctttcaaaatgccttgtcatgaaagccttaaggtctcccgacgtggctgatctcacgggctgggtgatccgggttagtaatgtcgtgtgggtaaagtgtgccccctctgcagaggttaactaactgttcgaacagccgtgcccacggtcatgggcggatgtgaggtgtttcctgtagcgtagatttgtttgcctgtgctttgtgaaaagttgttgtggtgtgggaatcgttaccagaatcagcctatgtggcagatggatgacctgagtggtcaagaaacgaatctgtgtgattcgggatgtctatgggcatcatagtctaggcttcccgagtggaagcggattgttgtgctgctgggcagctggactctaggagtccgagaaaatgaaaaaggctctgggagccgattaatcaagtggaatggctctgggagccgagaagtaatgatctgacccgggaggtcggtacattaccaaatgagctgttgaaaaacatctcttaaagacgaaacgagacgcaagtctcttttcggcctaaacttagaaagagataaatcacttagtgatttcaaaacgtcttcaaataaaagatttgcaaaacaaccttgcctctcttccaagcttgcattaaacacctaagttcccgtgacttgctgagtacgaaggtactcacccttgctctatataaatatatatagttcctccacccggaagttgaagatgaagtaaagtgaagattagggtttcgtcctggttcccagccgtcgcctgtggtgttgggtgttagtccgttggttccgctgctgccgctgttgttggtgtttcctcgttcgcgtcgtcggttgcaatctcgggctgttctgagctgcaacctaagttaaggtaaataagtcctctatttattttaaggattgcaatgattcatatttgtcaccgtgggtaccagcactatgtcctgggactggtactgagatcgcggtttcgtaggaagcggtccgcaccgtttttcctacgacacactcctatcaggtgccgttgtacggcggtgccagattggggtgtgacatacatccggcatgtatctacaaaggtacgcaatattctatatgcaatttatcgtacctattcagatcatatagcattgtcagatctataatttattatgtttacctagagcatgtttcttatacaatatccgttgcacgagtgcttccgacgttaaaccaactacagtctaacgctgggggctcactccgttttcttctgtataaatcatgcttgtttacggtttacataatgcctgataattacatctgctcgttataacctgataatgctagaagatccatgcagtttttagtacatactcgatattatctgctatatatcttgccttctagaaaatatttttcaggaacaattgagcactcgagtaggttatggtcgagtacactccattatcgagaacattctcgacaaatgcggagttatcgcacccaacctaccaacaaagactgacgacctgtctcatagcatcggccatcgctggactacttgaagaaaggttgttaacggatgattcctcgcgaacgtcgtcggcttgatcacccgacatgattgcgaacggacatccggatatgctataagttgggtacgtgagtcatgctggccacatgaaatacacttgcaataaaccaactctagcacttctatcggtgttcgagagataattctgctcgctcactggttctcgcaccagtacacagcaatctctcgcacctcaacttccatcggtgttcgagagataattctgctcgctcactggttctcgcaccagtacgtagcaatctctcgcaccgcaccttccattggtgttcgagagataattctgctcgctcactggttctcgcaccagtacgcagcaatctctcgcaccgcaccttccattggtgttcgagagataattctgctcgctcactagttctcgcaccagtacgcagcaatctctcgcaccgcacctttcatcggtgttcgagacataattctactcgctcactggttctcacaccagtacgtagcaatctctcacacctcaacttccatcggtgtttgagagataattcggctcgctcactggttctcgcaccagtacgcagcaaactctcacaccgcagcgtccattggtgttcgagagataattccgctcgctcactggttctcgcaccagtacgcagcaatctctcacaccgcagcatccattggtgttcgagagataattcggctcgctcactggttctcgcaccagtacgcagcaatctctcacaccgcaacttccattggtgttcgagagataattctgctcgctcactggttcttgcaccagtacgtagcaatctctcgcacctttacttcagatggtcaaggtacgactacaacagtgtagcggtcctcgtaccacgactccaagtgatcgagggacacctactcaccggtcctcaaccagttgatcgtagtgatctctcgtacatttgcttcaagtggtcgagttacggctactgcctggtcctcgaccagcgatgtagcgttcctccgactacttccactttcagtggtcgagttacggctaagttacggctactgcctggtcctcgaccagcgatgtagtgatccttcgactacttccactttcagtggtcgagttacggctactgcctggtcctcgaccagcgatgtaacgttcctccgactacttccactttcagtggtcgagttacggctactgcctggttctcaaccagcgatgtagcgatttctcccactacctttacttcaacaaagttggtagcaggtacacaatatcgccaagtgttttacccagagatcccttaccacgacgacacctagcgttgaaacctatcctactgacccttaacgccgtcttgacaaggcctccgaggaacctaagggatcttcggctggggacgcccagagctgataaggccttgttggatccttcagagacgaaagaccatgtaagatatggtcgtgtaagagttctcgccgtgcgtattaaccaagctgtgtaatcggaaattgacttttccaacttcacggccgggggctaggatcagtgcttattcaaccaaggcaggtcaagagtccaagagcctactcctctgagaacgattctccgacgacaaggctgggggctagggagagtgaacaactcaaacgactgaccaaagtcgtgaactgagaagacactcttacacaaaacattggtcggtaaatttaattcattttcaatttaccatacatattataacatgtcaccctttgggcattcgctcaggggctatttctatttgatattcttttctgagtattcattttaggaaaattctattcgacattgtggaagactccatgtctctatggttctacaccaggatcgactaaggcgagtacgaccaatgttgacaaagctcctttgcagactctacgccttctcgattgctcgagaacggttgctagatcttgacaaggaatacggactgaagagatggtgtacccgccgagataaaatttcttgacttcaatccaaattctcgactacagcaaaacgggagacttagtcgtacgctctgtactttttcggtcgacatcagagattcacttagacaaaccctttcggtgcccacacggggctgacaaaggaagtccaacattatctctaaactcaccgagaacggtcacatgagcttgataacagttactccaatgtctgcgcgcggttgagaataggaattcgttcatttgcatcgaagtcgggggctgctgtcatggttatggataccacatacctaatagtagttgactaaatctcggcaggacccaccacataccatgtcctatacgaaaaccgacttcagatatggagggagttccgaataaggaaagacaactagagttttacatggaaacgacaaggactactcagattgtatccatattggtttccctagttctacttggacaaggggacacctatgggtataaatacaagcctccctaggaggacaggggggacaccca

SEQ ID NO: 25514 - DNA, 14429 bp, Oryza sativa
gcccccttgccgccctgggggagggcgatttttgcctcccccctataaagcccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgtgatctgtcagattttgtaatgacatctaagggcatcgataggcctgcggagagaacatttgagtcaatttatagttggttgttgagaggatttagaatagaccaagaagtctacacaatgtcagtatctgttgtagtgagtcgtgcaatagaaggttatttttgggaactaatgcggatggacagcactgctgcttggagacggtatgtggaaatggcttttgacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagaacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagaatgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattggggtgatgggaacaaccaggttctacctatggctttcgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggatctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagttcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgctgatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgatgtaatgagtgttcggactaaatacttctatcgtgtaatttcaattcaatcttgttgtaatgagtacctccgactattgttgtactagtagtattgcgaactattcggtgttgtatcgtaatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaactgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgcgacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagcagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgttccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatgtattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccagtcttggagattttaatcttgtatagttttcaatataaaaagatttgataactattgatatttatataaaaaaatatagagcacagtacaaaatcgccctcccccagggcggcaagggggccgcctgcaaaattccatgccccctcgccgcccatttgcaggcggccccccgcacagtagaaaatcgccctcgcggagggcggcaagggggccgcctgcaaatttcgttgacggccgtctgccacgtcattttcgccgccctctgggagggcgatttttaaaaatcgccctcccagagggcggtaggcgactatttccgttaattttcaaaatggaaaattatttttgtaaaacttttaataaaaaaaattataaataaaaaaaattcgatgagccgtgagtgctggagaccggcagagcggtgagccgagctgagtagggtcgggcagtgagccggtgacccagcgttgggtcgccgcgtccaaccccattgtcccgcactcccgctcggcgaggtagcggaggagatcaggagagggaagcgcttggatgagggctgaggcggtggccggtggaagacccaagtgacgtcggctgccccggcacggaggcgccacgtcaaccggcgagcgggcgcgggtgccgcggagccatccgtcgaacaggggcagtgaaccggcggagggcggctcggcccgcacgtccaagtgccccgacgcccggcgtccgccgctcccaatgcagcgcgcgcgagatggaggccggaggggttgcatcatgccattgccgcctagggagaggacagaagaagcgctcggctgaggcagtagggagggggacggattagcggccatggcagccggctgatgaggcggaagacacggcgagcctaacctgcactgttccggccgctcacgggtgtcacatgcttgtgcggcggtgacacaagttcgcggtgccacctcgacacgacgcgacgtcgcgagccccatccaagccaggtattgctaatttcgatttcgaattctatttcaagatcagctataatctttgggaaaataaaaaaggaaactcgtttccagtacaatgggatcaaagtttgtgtactaaggaatttgttaagatttgttagaaacttagaataataaattttgtagaatataattatatggcatatatgttatgatcctactctagctccttaagattaattactcctatgcatgttcaccgtgcattcctcctttttggtacgtataacctggtgtagaacttccgacttcttgaaacactaaaacatccaacttactagcagttatttgacgaaactgatcctgaaaggatgttgaaatattcttttgtacaacacacaatcttgggagaaccacatattccacatattctagttagtgtaatgttaatactctctccttccctaaatgtttgacgccgttgacttttctaaacatgtttgaccgttcgtcttattcaaaaacttttgtgaaatgtataaaactatatgtatacataatagtatatttaataataaatcaaatgatatgaaaagaattaataattacttaatttttttgaataagacgaacggtcaaacatttttaaaaaagtcaacggcgtcaaatgttttgggatggagggagtatatgtctcttgtttctattaattttatggaaatccacaatccgattacaggacttgtccaaaggaaacgctttgtgcctttgcgtgcaaaaagtaaatctaccgtccttctaataccgtgaggctcatgttattattagagctgctggtatttcctcctgattgtttggctccagaggccctatgtgcaaaatacacaggttgtattggagctggaagcgctgcagcttcattctctaacatgaaaacaacagaagacatgggtggcctattatttggattatcttgcacgcacaacagccctatgtggatacatagtaaaacttccatttttgagcaactctcagcaatggatgaatccaccaaatccatggccttgtcatccttccataagctccatgcctaaacagtgaaatagatcagtccatataaaagcggtatagttattttgaatttttatggacatagagcattccatggtacttacataagctaataggttgggaaagtccatcagccgaggtaagctaatcttcagaccacttacaatctccaagagtataacaccatagctatatgtgtcggacttgactgaaaaggcgccatccattgcatattcaggagacatgtaaccactgcttaacagttttagtaataagtaacaaaggatttttcaggaaatcaatgtaatagtaaaaaacaaattcctggatcactcactatgttccaacaactcggttagtattggcttcttgctggttgccaccgaagattcttgccataccaaaatcagatatcttagggctcatatccacatccaacaagatgttgcttgatttgagatctctatgaattattgtcaaccttgagtcttggtggagataaagaagtcctctagctactcctttgattatcttaaaccttgttggccaatcaagagcatacttacttgcaggatctatcaagaatggtatacaatgttcttatagtaaggataattttatcatctttgagaaagtactggtaagtatcacattgtttattgtaaattttggtaccttcagatactaaatatctcaaggtaccaaaaattttagtgtaaaatttaggtatcttgagatactttttcaagaacaataaaatttctctatcagtaagcatggagtgaagtttattggatcgcatggtatgtttttgaacagtaccgaaaatgaaagcttccaagcttttgtttggcaagtattcataaattagcagcttctcatctccatgtatgcaacagccaagaagtttaacgaggttcctgtgctgcaatttggcaattagaacaacttcatttctgaactcttctactccttgtccagaacccttgctaagccttttaattgccacttctttgttatcacccagcatgccctacacaatttaatcaattaatttttttattaagaaagttcatctcgagatgcactttttaccgcaatataagggacgtggtttcgaccccaaggttccttattcgattcttaacacgctcacacattcttcttaattatttaacaccatgtttcttgtcggttctcccttttttaaaaataaagttcatcatccataattgggattttcatatggtatcactgttttcacttttcagtagtaaactactccctccgtcctatggtataagggattttgggtagatgtgacacccaaaatctcttatatttttggacggagggagtactaattgtggcacttcttctgtaatactcctaaaaaatatgctctaaaattgaagaatattgtgcgatagttttgtcctactgtagttttcaatacagtttttgtgggctaccttataaacctttccgaagccaccttgtccgagcatgttgtcgtcagaaaaattatttgttgcagcagcaatgtctccaaaactgacaaacgggagttctaaattttcatcaccaagttcatttaatgcactcaagtatcctagcatccttttctggacaaccttattctgacgtttgcctgacaggaatatcaatatcgtgtattttaatattaatagtagtattattcttaattagataagctgtgagaactgagaagtgaggtggctcggtatctacctctgcacttgcgtaaccacacaaggaacatgctcatcagcagaagcaaacatgctgctgtaactgggagcagaacttttatcacagtcctcttcttattgttaactgcgaaaagaaatatttcaccaaaataattagtacttcctccacgctaaaatatagtaacgtagtactcaatcagacatcacaaatattatagactctaatcgagtactaggcgatgtttaaccgagtactaggatattttacagcgaaggaaatatatatgtaattaaccattgccaaacacattgagcaattctacggtccttaagaaggtatcatgaggtatcaaaaatttagtgtaaaatttggtaccttatagtacctagttaccaaaaggtaccaaatttacaatagaaaaagtggtaccttatggtacctcctcaagaacacattagctcgaacacattagtttcagtgttgtacctagttcaggctttgccagcctcaaatagagatcctgccctttgtcgacataccgaacgtcaatgacgtcacccgtccacatcacgcatccgctgccgccgccggcgcctcggatgtccgcggcggcgtaggcgacgcaggaacagttggcgaagcacctcgccctgcactcgtcaagcgtggcgcccgtgtccaccgtggcgttgtccgtgtcggggagcttcacgccgcgcaccggcacgaacccgtccgtggtgctcccgttgccgcactccagcggcgcgttcctccggcaaccaccggaggtctccctcatggaccactgggaggggaacatcgggctgaaccccgccatgcagctgcagaagagcgtcgacgcggtgttcacgttgcacagcccgaacgcgccgcacttggcgtagtcgtcgcatacgtcgcgcggcgcctgcgcgaacgtgttccaccccttgctgctgggatcccacacgaggcgctggatcacgccggcctcactcagcacgaggcgggagaagggggccgcggcggtggcggcggtgaagacgtaggcgatctcgtcgggcttgaccaccacctggttcgcgaacatggacgagtacgatgccatctccgggacaccgctgaaccacagcccgttccatggccccgtgcggtacttcttgccggcgccgcaccacgagacgcagtccgctagccctctcgtgtccatcacgcggcggcagccccccgtcgccgggtcgtcgggcgcgcgccacgacgtgagggaccactcggcgccggtccgtgggttcctgccgagcctcatgccggcgatcagggtgttcgacgggttgtcgaacgactgccacagcacgtcgccgctgccctggtcgcgcacgacgaggttcccagactcgagcagctgcaccgccaccgatggagacgagccagtcgtgttcgacgaccaggcggcctggccggcggcgccgtcgagcaggacgagcccgcccgtgccatcgataaccactacgccggcggtgtcgttcagtgggctgtcgcggttggccacccagacggcgtccgccgactcggagaaccatatcgcgaggtatctcctgcttggcaagccgggtgagaagaaccccagagtgaaggagccattggctgacacgagcgtgtcgccatcagtgaggttgcggccattgctgagcgtgtccgatgcaacgccggcggcacggtattggaaacaaaggagcacggagaagaagatgacgggacggtagaaaatgttggtggttgctgcttccataactgttgattctttttttccttgcatctccttggaaaattgttcacggccgctgtgcagggagcacgtacgccggccggcctcagtgtctcacgactcacgagcaccatacataggctgtgcttaatctaaattttggatccaaacttcagtacttttccatcacatcaacctgtcatacacacataacttttcagtcatatcatctctaattttaaccaaaatataaactttacgctgaactaaacatagccatatacggaatctaggaactagtagtgccccgccgcataggaagactgcaagtgcgttcctacttcctgccacctccgtccctccgtaccagtttaaatgcagccgtggattctcgtctctaacgtttgactatcttatttaaaaattttaattttttaaataatacgaacggtgaaacgttgaacataaataacgtgaaactatgatctttctgagacggaggtagtacagtaatatcccatgattgactagctagatgaatccatatgggtgagttgcatggtaatgcaaactgcaaagaagattggctgtccatggaatcatggatgattcgtgactgcatataacatgcatggtgtactctccgtcgtgatagccagggtaaagcatcttcatggcaatggtcaaaagagagatgaatggaaacataagtgagggatactgttgccctcgaccccaagaaaaggaaaccataattcatcaaagtgataagtccacaacacatccctatcatagtcgtgctgttgaaaactgctggtaaagtgacgatagctttattaaacttcgtttgacctagctaaagatccgtgaagtcgtgctaaatgctagtactactgtacttaagtggttcagaatcatatcgcgcagaaaagcaaggagcgtagtgatcatctgattaacatctcgcctcattcaaaaagcccgcgtgaaccctgttattttccgattaagatgtagattctatctcgattttcactattacgtttcgaaactgcttaaggatatgttttatgagaaaactttctatacaaaggtttttctaaaaccacaaataaatttaattttctaattcatactagtaattaaaacttgactaatcttaaactaatgactttctcgttttatgtgccgacctggtaggccttgagccgtctggggcctcgtatttatgggcctcaataactcagtacggcccactagcccattggaccaggagtctcccgtacatgcggcctgatttgacccaatcccgtgcggcggcggccgccggcggcacgggagcggcgccgcgcggcgggaggagagcgagtggctgcggccatggccatggccggcgagcccgcgtcgggtggcgtcaacgcgggtgctgccacgcgagggagcagacggcatcgacaggaagtttgccagcctagggggaatcgctctcggctgaagcatttggagaagtagcggcggacgccacggcagccggctgaggggggaagacggcggccctcacggggttacaagtcgtggcgccaagctcccggtggccggtgccacggtgccacctcgtcgcgagccacttgaagccaaggtatacttctgaagttctgatttggatttatattccaagattaactactaggacttggtcgaagtttttagattgaggatatttttcagacttttaattggtggtattgagtgagcctgaagaaaatgattgaaagtggataaaaagcgatagtaaataattaattttgtcatcaaagactttgttattcccatatttcccctcaaaaaaaattgtcatgccaaaatatattgcacacaatcacgcatgttatgatcctacactccatacagttgtcttgggagtgttttttgatatagcctactccctccgtttcacaatgtaagttat

SEQ ID NO: 25515 - DNA, 18345 bp, Oryza sativa
cttacattgtgaaacggagggagtattttataacttcccaacttttaaactgtatacatccaacttagaatagtttaatgaattgatggtaaaaatatgttgcgattcttttgcaggacagtgtatcgagaaccacattatctactgttattttgtaatacctgcacattaaaaataccatctcaagggccatgataaaagaaaaaactcatccaaaaaaaatgtaacatctgccctttgtttctaatattttatggaaaagaacaaactaattacagaagtggtaaaatctaaatgctttctatgcagaaaataggtaacataaacatctaccgtccctctaataccgtgagactcatgttattattagagctgctggtattttcccctgtttgtttggtttcagaggccctatgtgcaaaatacacaggttgtattggagcgggaagtgctgcctgttcgttctccaacatgaaaacaacagaagacatgagtggcctactatttggattatcttgcacgcacaacaggcctatgtggatacatagtaaaacctcgttttttgagcaactctcagcaatggatgagtccaccaaatccatggtcttatcatccttccataatctccatgcctgaaccaatagaatagggtccatataaaatcagtacagttagtttgcattatattcctcccaatcttaatgaaatttggtcgccggttccttcggccgacccggcaaaaaaaaaagaaaaaaagtttgcattatatgaagatagatcatttcaccgtacttacataggccaacaagttgggaaaatccatcagctgaggtaagctaatcttcaaaccgcttacaatctccaagagtataacaccaaagctatatatgtcagacttgactgaaaagaccccatccattgcgtattcaggagacatgtaaccgctgcttaacagttttagcaataagtaacaaatattgtttcaggaaaggaaataaatatcattctaaacactaacacataaatcactcactatgttccaacaactcggttagtatttgcttcttgctggtttccgccaaagattcttgccataccaaaatccgatatcttaggactcatatccgcatccaacaagatgttgcttgttttgagatctctatgaattatagttaaccttgaatcttggtggagataaagaagtcctctagctactcctttgattatcttgaaccttgttggccaatcaagaataaatttacttgctggatctatcaacaatggtgaataatgctaattagtaagcattcagccaattatatctggatcatgtggtaagtttctgaacagtaccaaaaaggaagtgatccaagcttttgtttggtaagtattcataaataaggagcttttcatctccatgaatgcagcaaccaagaagcctaacaagatttttgtgctgcaatttggcaataaggaccacttcatttgtaaaatgctctaatccctgtgtggaacctgtactgagtcttttaaccgcaatttctttgccacctcccaacttgccctgtataataacatcattttagcatgataaaatgttgtaggtttctccactgttgcgtttgtctgtgtaaattgttaccttataaaccttgccgaaacctccttctccaagcatatttgaatcactaaaattgtttgttgcagtgacaacatcttcaaaattaatacatgggaattcctgattttgctcatatacttcatgagaagctctaaagtttcctagcatcgctctattctgattttcattatttctcttttcacctaataggaacatcaatatcataagtacaattacaggaggaaaacatgatatgagtcggtgttgagtattggctcctgctgtaccttttgatatccatttccagacaaggtatatgcacgtgagcattagcacgcatgctataatggggactacaaccttgactacatacctgctctttttatgacctattaagagaaatgaagaagctttcagaatttctaaccatagattgcaggtatatgcatggatgttgcttttaattggatgttcaggctatctaagatctttattgtcatttgtcaccacagggataaaaggtgggcatacctggagagtcggccaaccggaggtacaagttgtcaccaagattgttcctcgccatgtcaacaagctcaccaacccaaagcaagcaccttgactggctggctgtggtaccgggagagccggttatggtcaagttggtgtaagcataggccgtgcatgagcagtttcggctacactcagccgcgcactcctcaaagcttctgtcctggacataaaagaacttgtcagggagcttcattccaggcatggtcatgaaatggttcccttctccacatcttaattgttgctttctccggcatccacttgaagagttggagccgttaggctcaaatccatccgggcactggcatcttgggatgaccgacgtgaagtcacagtaaccgaatgggccacacgagccgtagggatcacaatcgccaatggctgctgggcgttgagaatagattgcccatgatgacgagttgacgttccaactcaggagcctgaaggtgcccgtgtagtcaagcatgatgcgcatgtatggtgagccatcagaggtggtgtagataacatagaactcatcctgtgtgtttacatatgtttggtacatgaaggaggtgctgctgccatatgctttgccggacacccacacactgtcaagcacaatggagcggtaatatggcttggtcccgtgccagacgaagacctgaaggtctgagctggggtctccgctgcatgagaagtcccccgttgttggatcatcaaggcccttccaagctacaagccgcatgcctacttgctccttgtacctcagcagaatcttcatgttcgacagaatggtgtcagttgggtgatcgaaactttgccatatggttacattgtttgacagccggagaaccaagtttcctgagtcgagcagcactgcataagctccgtcacctccggtgacatttgccattgtcgtccagacggtgcgacctttggaatctgacaatacaaggtcagaactattgctgatggcgagcatcgctgatgaaggtgtggtgattgggttgtcacggttagcaacccaaacgtatgttcgctctgggatgttgttataccatatgccgaggaataagctctggttggaagtggctggggagaagaaaccgagtgcaaagacgccgctcttggagacgagcttgccgctgggggagatcaatcgatttacctgtgtcagctgatcatcgcatttgcagaaagagatgagcagcaagtagatgagaactgggaggtaggccatattcatctggcccttgttcttcttttttggacaagcaaggcaggagctctgcaaaatcaaaattagattatgcgattaaaaagacacagagtcttacaaaagaagagcccgaggagaggcgaggcaactggaaaagaagatgtacatctgataaaaaggagaactgctctcgtagctcttgaaattaccaggctaagctctgctaagctctatctgatttaactcctgcacaattgggcagctacttttgcttctccctctggctttggtgttggaaattcttctgttccgttcctgccacaccaaccaccaaggttcttgcattcatcttccttttccttccatactttggctctaaatctcattaggtcttgttcttctgtttcctagttgccttcaaaaatgtaaatgtgaagaaatagagcatatgtatccaattatcagatgcatactagatgatttcccatagtcttagagcatggttggaccgaagaaagcaaacatacggccaagacatttctgtccttccagatcaggatgcacgcgcaaagcgaaaacgaagttcggatacgacgagaaaatcaacgagagcgaaaccgttatactgttatttttttttcctttttccttttttacctttcccgggacggcaaaagaacctggccagaacagtacaactgtaactaataaaacaaggctgccaacaagtacaatagatcctgttaaaaacggttacagcaaaaggagaaatctctagttaatttctgaaagtttactactccctccaggctgataatacttgtcgttttggataagggtgtagtcaaactttataatctttgattataaatcatttttaaaatatttgtcttttaaatatggtgactatatgtatagattagtcttaaaaagtactttaatataatcgtatatttgttaacaattttatacatattataatgaaaaataatggtcaaagttgttttttagagaccgtgcccttatccaaaacgaaaagtattatcaaaccggtatgaaacaaagaaatcagcaatcagggcgatttggccgtatcagtaataagtaaatggaatatatgttccgctcaaaaaaaatagaaatcagcagtcaggcgagacgcaaaattccttcttgatcttctaacctccagactccagaggcgtattggattcagattggaagatttttgcattaacgttgtttccaaataagccagaagaccaaaatgatctgagagttgaacgcggcacgttgatgatctgcgtcatgacatcgacctcactccacgattaaccaaattccatttcatggcatcggtagcgctgtactaaccacccgtcagccaacaagtctatagttgacgagacctcatgggaagtcctagttacatacctcatttttcgttaagaaacattaaaaaaacaaaataacttagtacaggtagcttaacacaaaatagtttagagcaaatagctggcctacaatatatatgtttttttaaaacacagtataacgttcacacactcacctctataaacacatatttggaaaactgagacaacacatatgatttttgcacgggctattaaaatagattattttacatagaacaaatagcttagaataaatgatccaaactatttgaaaaaaaagaagatcgagcgtgggagtaaataacatgtgacaaaaatctggtgaagaaaaaaaaaagaacaatctgtcgccgagacctattttcttccgtcaaaagccgaaaagataaactatcgctacaaaactgaactctcgatagagatcgagaaaagtcgacggcagcgaaacctcgcggcatatgcagatatgcttttgtccttgccatggcgaagtaatctcatgctcttgctcagcactcagcaggtggaataagttcactttaggtccctctatttgtcggttggtccgattttcgtctcttggccgcaaaaccggatacgacccattccccaacttacgaaaaccggacaaacgagatcccttggcagtatagaggacggtttttgccgacgtggcgcctacgtggctcctttaactagatcttcatcccacatagtgttaaggtggcgcttacgtggcaattttatcccaaaaaataataaaaaccgtagaacccatatggctacatgtcagctacatataaaaataattaaaaaaggtggggccatgtggttccacatgtcagcctcctcctctctatcccctctctccctctcccttacgctgaaggagaaggacgagcggcggcgggcggtggacgttgctcctggccgcgggcgctaccgacgacatgggcgtggtggcgtcggggcggtggcagatggcggcggcggtggagacgtgcgacggcgccgtcagggagtgcgacgtggacgacgaggaggaggtggaggagatggcgttgatgggggcggccgccgccgccgccgccggggagacgctgatgcggcggccgacgaactggtaggtgagctacgcggtgctggacgccaacaaggtgtcgtgcaataagcgcggtcagtcctactaccagaactgcgcctcacagaaggccggcaacccctaccgccgcggctgctccgccatcacccgatgcgctcgcaacaccaactgatctccctcttccttcgccggcgtcactgccgttgccggcggcggcagtgaatacgctgctctcatatgtgtatgtacatatcgactctatccaaagcgtacgtgagcaactgctactgctgccaaaaaaaatcttcagtttctctctcagctcgatctatacaagccaaagtggtagcatgcattatattattggcctgaacctaagaatcttttaaagagtacagtaagtaacaaggcattcacatctttcctgtaaatggcgccctggaagtagagcagcgtcggccggtcatcgtagccggcggagtcgttggccagcgaagttggggacgacgtgccggtacggcgcgatgacgtccttgtcgaggccaacgacgctgggcgggtacctcccgaagtcgcagagcacgaagacgcatggccagagcttgtagcgcgcgtcgagcatcccgttggggtggtgcgcgagcacgacgtggtccctcccgccggacctccgccactcggggcgcgcggcgaggtaatcgagcagcctccgctgcaacgtgcgacaaccggtctccccggcggcggcgccggccgcccccatcaacgccatctcctccacctcctcctcatcgtccacgtcgcactccccgacggtgtcgtcacacgttgccgccgccaccgcggccattagggctgtcaaaaaagctcgagactcgcgagctgctcgagctcgactcgtcctaggctcgattcgagctcggctcgagctccaaacgagccgagcccgagctgtcccaaagctcgtgagctttgtcgagccgagctcgagcttctaacgagcctagtaatatatgattttttattgctatttaataaattggtagatcaaatatgttatttgtatgccttgtattagcatcgtatgtttattttattctttttcctcttatactaatatgataaacaataaattaaatttttttaaaaattatcctttgaaatatacattgttctaattaaaaatcgagctcgatagtcgagctcgagcttgatcgagctcaaacaggcttagttcgagcttatatcgagctcgagcataggcaggcaagctcgctcgagctcggctcgttgacagccctagcgccgatgtcgttggcggcgcccgcggagaccgggagcaaggccaccgtccgccaccgctcgcccttctccttgcaggcttgcagtgtatgggagagggagagaggggatagagagaagagggaggctgacatgtaggaccacatgggcactacctttttaaattatttttacatgtatctgacatgtgggtcctacggtttttattattttttcgggataaaattaccacgtaagcgccacgtcaacgccacgtgggatgaagacctagtcaaaggagccacgtcggccaaaaccgccctccatactgccgagggacctcgtttacccggtttcgtaagttgggggacgggtcgtacccggtcttgcggtcaagggacgaaaatcggactgaccgacaaatagagggacctaaagtgaacttatttcctcagcaggtagtcaatggtagagttgggctgtaaatactcggcccatctcgatgatgctggaggtggtgctcgttcatttccttataggcttcatggattaaatcacaggatcgttgatggactaattataggcccgccggagccagcccagccgtagagtagaggccaccgagccggcactggggcggcccatccgaggtggaggccgttcctcccgaattcccgatccgctactgaggtggcggagatgttgcaggcgaaggcgcggcgaggcaggagagcgagcggccgccggccaggacgtggaggccggatcgaggatgcaggcggtggcggttaagcagggagcagacggcatcaagggaagaagcgcggcaggtctctgttgaacttgcacacctctcaaaggtgcagtgcctatctaatctctaataccgattatagggttctaaccctagccaaagattgggccacgtggcgtctcagaaatcaagttttgcgcctctgaaaatatgccacgtgtctcctttctctcctcccccaccgttcgatcgagtatcgacggttaaatttcgctgcgatggacctctttataaaactgaggtttgaaaaaaatgactactataaagaggtagggggtcttggaaatgtaggccgacacaggtcgtagctgcagtgccgaagtacctggcacccccacccccacccccatccccatgcatgcgctgcatgcaaacctcgggtgattatccatctaatccatacaattagctcattaattagttgcaagttgagcctatatctagctgtccacctgagttaattaacatatcaaagcgatgtggttgcaagtctccaaaactaaaaaggatgaatagaaatgatgtcgtgtcattcaagtattgagtaaagttggtgctatttagtgacatagtttaaaattggttctttttatgctatattaagggtatgttctgattgtagccaaaataaaccttaccaaattttggcattggcggcaagttgataatattcccaaaattttggcaggatttcttatgtatttaccaaagtttggcaacaaactaaacgtaggcacttttttaacaactttacccaaaaaatggtatggctaaaaatggcataaatctgaacagcccctaaagtacattcagactcggacatacactctccatcctaaaataagttcaattttatatatgaatctagaagaatgtgttgaaatatataaaaaaaatcatatcaacaatcattttatgtatatattagtgcaaacgacaaataaccacaaaattcaaaatataattatacgaggggcgactacgtatattagagcgaacaaaagtcgactgggcgtgaggccaatctgccactctgcaggatttaagccaccaagattcacatcattgtctaccgaggcgttgatgagttcttacgtctcgtgccaccacccctatctctaaatcctggcttcgtcattgtgtagctggatcggtcgacccaccctgtctaggtacaataaatctggttaaggaaaggaaaacaatagtaggattgcatatacactgtacgactcatgttccctaatgagaaaccagattcgagcgtttgtcaatgataaaccatagaattctcctttaactgcattttctaagaataaacagcatgacatttatggtgatgccatcctattacgatatccttttcttggggtcaagggcaacgtacggtatcctcacttatctgccatgcatctctttttaccatggccatgaagatgctctgccctgtatcacggtaagccgagaaaagggctgatggatgagaagataatgcgcggccacgtatcatcacggtaagccttctttgcaggttgcaccaccttgctcgtctatggactcagctgctagtcagccttttaattgcccagagcaaattatactttggttcatattttatttctaaagttttagtttgcacggcaactttttaatattttccgtttgtactctcgatttatagtcaataaagtcattttcatccgtcgttagtaatccgtaatctgttgagaacgcagcctgttgtgctgggtttttctgtctagtaggtttttgaacgtacaggttttcctaatttcctttgtgtttcatcccgatatgacggacaaaaaagtatctgcatacacgtcgcttcctagttccttcggtctcaagattctggaaacaatgtatacgtacgtcagtaacatatatactgaatgataacaatgtatatttctgtgtgcttcgtgcttcgcaggctcgcagctaagcgaagaaacaaggcagaacaaatatggcctgcctgagccacaacctcccagttttcatccacttgctactactaatctctttctgcagatgcgatgaccagttgagacatgcgaagcgactaatctctcctagcgacatgctcatctccaaaggtggagactttgcgctcggattcttctccccggccacctccaaccagagcttattccttggtatatggtatcacaatatctccgagcgcacctatgtttgggttgccaaccgcgacgacccgatcgctgcatcttcatccgcgacgctctccatcagcaacaattctgctcttgtattgtcagattccaaaggccgcaccctatggacgacgatggcaagtcccaacagtattgtcaccgaagacgacggagtttacgcggtgctgctcgactcaggaaatttggttcttcggctatcgaacaatacaaccatatggcaaagctttgatcaaccaactgataccattctgcccaacatgaagtttttagtgagatcctacggacaagtcgccatgcggttcatcgcttggaagggcccagatgacccatccaccggggatttctccttcagcggcgatcccacgtcaaactttcagatcttcatctggcacgagacaaggccatattaccgtttcattctgtttgatagtgtctcggtgtccggtgcaacatacttgcacaacagcacctcttttgtctataaaacagtcgtgaacactaaggatgagttttacctcaagtacacaatctctgatgattcaccatacacgcgcgtcatgattgactacatgggcaactttaggttcatgagttggaacagcagcttgtcctcatggactgtcgcaaatcaactcccaagggcccctggctgcgatacctatggctcgtgtggcccattcggctactgcgacctcacgtcggccgtcccaagttgccaatgcctcgatgggtttgagcctgttggctccaattcttcttcaggatgccggagaaagcaacaattgagatgtggagatgaccattttgtgatcatgtctagaatgaaggttcctgacaagttcttgcatgtccagaacagaaacttcgacgagtgcacggacgagtgtacccgcaactgctcgtgcacggcctacgcctacaccaacttgaccgcaaccggcaccatgtccaaccagccaaggtgtttgctttggacaggggagcttgccgacgcgtggagggacatcaggaacaccattgctgagaacctgtacctccggttggccgattctactggtatgcccaccctttttcccctgcgacgatagaatagctcttagattagcagtcctgaattttgttcacttgtgttgataggacacacttcaaactcaacagaaagaaaaaagaatctagtgaaggtggtagtctaaatttagcatgcctgtttttgaacacgaccaccaggttactatctcccacaagcttgcaagctactgtatgtttgacgctgtaacttctgttcacccacattcttcacagggtcaaattctacagtaaacagaaagaagaagaggcacatggtggtaaatattgtactcccagctatagtgtgcctactaatactcacagcgtgcatatatcttgtcagtaaatgcaagtcaagaggtactataagcagtaggacctgcttaattgcaaagcgtgcatatatcttgtcagtaactgtaagtattgacattgttgattttactataaggcgtccgacaaaacaaggaaaaaacgaaaagacctgtcattcaacagttgagcactattcatgatttgtgggatcaaaatctggaatttccatgtattagctttgaagacatcactgctgcaacagacagtttccatgacaccaacatgcttggaaaaggaggttttggcaaagtatataaggtgatatataattttaccttgtcattctgtcaatgatatgaggaatagcgatgtcatttactcctattactttaataatgatgaaatcacacagggaacattggaggatggcaaggaaattgctgttaaaaggctcagcaagtgttctgagcaagggatggagcagttcagaaatgaactggttcttattgccaaactgcaacacaaaaacttagttagacttcttggttgctgtattcatggagatgagaagctgcttatttacgaatacttgcccaacaaaagcttagataaattccttttcagtatgttcgaccaatccaaagaaatactcttgcttggttaattatttgtttgattctactatcctaactgtgttctgggcagatcatacaacagaggctacacttgattggctgacaaggttcaacattatcaaaggggtagcaagaggacttctttatctccatcaagattcaagaatgaagataattcatagagatctcaaagcaagcaacatactgctcgatggagagatgaaccccaaaatatcggattttggtatggcgaggatatttggaggcaatgagcaacaagaaagtactagacgagttgttgggacatagtaagtaacttctgctcttgccaaccaaaattattcaaatacccaggttctggaaattattaaacttctttcttattcaaatagtggttacatgtcacctgaatatgcaatggaaggcaccttttcagtcaagtccgacacatatagctttggtattttgcttctagaaattgtaagtggattaaagatcagctcacctcatcatcttgtgatggattttccaaaccttatagcttacgtaagtgttgccggtacccaatgcttcaaaatttaacaatcaaagaacaaacataacattgccagaacaaatattgaagttattctcttgtttcaggcatggaacttatggaaagatggaagacaaagggattttgtggacaaatcaattttggagagctgttccctcagcgaagtttttaaatgcatccatattggactcatgtgtgttcaggacagcccaaatgctaggccactgatgtcattcgttgtgtctatgctggagaacgaggacatgccacacccaattccaacacaacctatatattttgtgcagaggcattatgaatcagaagaaccaagagaatactcagataaatctgttaataatgtgagtctgactatactagaaggccgctgaataaatgttttagcataagctctaaacagatggatggttgtatagtacattagtacggaatactttctccgtttcacaatgtaagtcattctagcatttttcatattcatatagatgttaatgaatctaaatagatatatatgtctagatttattaacatcaatatgaatgtgggaaatgctagaatgacttacattgtgaaacggagggagtagtaaacaatgaactgaaagatattggaaagaatgcattccgtaggtggttgtgcgcttgtgctacttgtttttttctcatctgctttgctctatcaatatattaggaagagctaatttatgttcaaaaattgaatagatactcctctaacagaataatgattagagatccacacaagtgatcatttgccatgcgtcttttcttttgtgaaatatattgagcaggtatttgaaaggtcatctaattaaggatggaagaatctatccaaggcgaagtgctccagcagcgcttggggtctatgtttatgtgtggcgggtggttccaatccccgctctacctcacgggcttgactcatgcatgaatcagccatccccagatgcccaacctagaaccaaaaattggaggcttgggtcgaaaaattagttaaaatcatgcctgcccgtgctgggttcataccgtctgcaccctggacgcgccgccgctcgccacacgctctccctcctctccggcgcgcccgtgcagcggatgatgtcgcgactcgcgaatggccgtgccgcacggagtcggatcaactcaatccgcatcgaaaaatcggaggtttgggggggagggggggggtgtccggaacctggcctgctccgtgagctcgcgcaaccgccaccgcctgcatcctcgatccggcctccccgtcctggccggcggccgctcgctctcccgcctcgccgcgccatcgtcggcaacatctccgccacttcgcccgcgccgtcggcttgcagtggcggatcgcctcctcgggtgggccgccccagtgccggctcggtgggctcttactccacggatgggctgactccggcgggcggaggcctcattgaggcccattagtccatcaacgagctttcaccgacttgggccggcctgctttgcctcacctcctgccaacacaggcccccactgatgggtttgggccataggtgctcgagatggtccgaagccgccgaatgcgcctctaccccagttaggtgttcggccgccgcccgccggagccaccggagtagagggcaccgagaccgcggcggggcggagtcgcggacctcctggggttggttcgtccgccactgcgatggcagtggtacgccgcgaggtggtggaggctttgcagccttgcagcctaggagaggaaccgctagtggatgcggcaatggatcagctagcgcttacttccccatccctgggagcgagaacacatgcctgacagagtggtggttgcaggccagaacatattttcggaagtgctacaggacaaacttcgacagcgcttgtatgctgatttgctggtagatttggaaggaaagaaatgcgcgtgttttcgaccaaagatcgagaagccctaaccagttagcagaggctatcaaagaagagatcttagtgtggaaagaagcaggctatttcgagaattgcagttcttagttttctttctgttgtgttgacgttccagttctttagtttgccgggctgtggttcctgccacagtctaattcgacacctgtcgttgcaagcgaaaactacttgtactttgattttattcctcctaatcttaataaaattggtcgccggttccttcggccgacccggcaaaaagaggaaccgctagtgctgacgcgctgttgggcaagcggcggcggcgcagccgccggcggcggctgagggggaaccgaagcagacgcgcaacctccggtcgtgacgtggtttcgccgaggaggttcaggttcaggcgtgccatttcaacgcccctcgagtgcaggtactagtactactactgattaaaacagtgatgaatcacatagatgcggattcgtattcttcgtttttttatcgcctagtgcaaattgcaaaaatgcacccaggtacccaaccttccagttccaataatttagtgaaatttgacgacgaaaggattttacctttttcttttcgtaaaacatatagggcgtgtttagttggtgaaatgaaaatttttgggtgtcacatcggacgtttgaccggatgtcggaagtggttttcggacacaaatgaaaaaactaatttcataactcgcctggaaactgtgagacgaatcttttgagcctaattaatccatcattagcacatgtgggttactgtagcacttacggctaatcatgacctaattaggctcaaaagatttgtctcgtgatttacatgtaaactatgcaattaatttttctttttatctatatttaatgctccatatatgtgtccaaagattcgatgagatgtttttgagaactaaacaaggccataatatccgaaaactgttgaatatgaatgataattcataagcccaatgacccaaagagcaatcacattttcactgggacaattttgtttcctgtaaatttcattccgtagcggttaattctataaccagctcattctgaaattaaagagggacaatcatatgatcagatcaagtgatgaattctgcaacaagttgattctgaatccaaacttctaacgcccctgtagtgtggtaaggctcatgctgtttacagatttgttggcgtcctgtctcgtcccttcggccatataattccttggcacgaaatatgcaggttgctttggagtaggacgtgctgtggtctcattctctaacatggccacaactgatgacatgaatggtctagcacttgggtcttcctggacacataacagtcctaagtggatacagagcaaaaactcgctaattgcatagctttccagaataattgagtccacaaaatcctctgcatttccatctttccacaagctccaggcctgaacaaagagaagagagtttctaattagtgcaaaactttagctgttgaaactttgtgcactatatgtcatacaacttacacgggctataaggtttggaaaatccattgtcagatgaggtgagctgatcttagagccacttataagctccaagactaaaacaccaaagctgtaggtgtcagacttgacagagaagatgccttccatcgcatattcaggtgacatgtaaccactgtttaaatcatgtcaccaactgagtgtaagtagtttgaatgcgttcaagtatatagaagtttgtattttatacacaggtagttgaagagttactcactatgtcccgactacatgcttagtgtttgcttgatgctggttgctaccaaagattctcgccataccaaaatctgatattttggggctcatctcctcatccaataaaatgttgctggctttgagatctctgtgaattattgtcatccttgagtcttggtggagataaacaagtcctctagctactcctttgattatgttgaaccgtgttcgccaatcaagcatagacttttttgaatcatctacgacggacattatgaaaggaaacttattgttgttcaggctttgggaaccctctcggcctctcccaccaaaagtgaaaaaggtaaaaagagaatatataattattacataccaaaaaggaagtaatccaggcttctgtttggtaagtattcataaataagaagcttctcttctccatgaatgcagcaaccaagaagcctgactagatttttgtgctgcaatttggcaataagaaccacttcatttgtaaaatgctctaccccctgtgtggaacctgtaccgagtcttttgacagcaacttctttgcctccttccaacttcccctgtatagtaaaattattttaacaggataaaaattataaggcttgtccactgctacaactcttagtgtaaattgttaccttataaaccttaccaaaacctcctttgccaagcatgttggaatcactgaaattgtttgttgcagtagcaacctcttcaaaattaatatttggaaattctaccttctgctcaaaaagttcgtgagaagttgtaaagtttcctaacactgttctcttcttattttcgtcatttctctgtttgcctaataagaacatcattatcggtcagtagttacaggaagactgcatagtgttagttagtattgagtattgaccctcactgtaccttttgtttgccacttcctgacaaggtatatggatgtgaatgtcagcaggcatgctataattgggactacaaccttcactacttttttgttctttttgttggcttcagaagtgtaccctatcaagaaaagtgattttttttctcagaattccatgtacaagctatctaagggtatcatcaatgtatatggcaaaagtagtctatatagatgggatccacataaataaactttacctatagcaatcctcacaatgtatatggatacaatgtgacattaggagaagagagagaagtagagatagataatattatttatgtcatatgggtagtccatatgcatatggataccttttgctattttctttatatagactagttgcacaatattactagatgactgaatggaatagtttattccctatggactacttttgtagtacattgtggatgccctaagagttatattgcaactgcaggggaaaaaaggtgggcataccaggagagtaggccaaccggaggtacaggttctgaccatcaccaaaaccagtcctccccgtgtcgactagctccccagtccaaagcaagcaccttgattggtctgccgtggtgccggctatggtcaagtttgcataagcataagccgtgcacgagcagttgcggttgcactcagccgtgcactcatcaaagcttctgtttgggacaggaatgaacttgtcagggaccttcattccggacatggtcacaaaatgattcccatctccgcatctcaactgttgctttcttcggcatcctctcgaagagttggtggtgtcaggctcgaacccatcgaggcattggcaccttgggatggctagcatggcatcacagtagccgaa

SEQ ID NO: 25516 - DNA, 41581 bp, Oryza sativa
  unsure (1)..(41581): unsure at all n locations
tggtgatgttcgttgtccaaagagttcggccttcggaatctgacaagacaaggttagagctattgctgatggcgagcatcacggatgatgaaggtgtggagatcgggttgtctcggttggcaacccaaacatatgtgcgctgcgggatgttgtggtaccatatgccaagatataagctcttgttggaggttccaggggagaagaacccgagcgcaaacaccccgctcttggagccaagcacgtcgcctgggtggagctgctttgcttgtgtcagctgatcatcgcacttgcagaaggagatgaggagcaagcagatgagaaaggggaggcatgccatattcatttggtttgttcttcacttgcctgtgactgtgaagcctgaagaaataacttgtctggtcatcacattcactgattcacaaatagctttggagtaattcccgtgagtcaacgtatggccgagactttttattcgtctacgggtctatgagtggaggtgcacgcgcaaaggaaagtgttgctacgaaatcatactaagggtttgtttagttcatgctaaaattgaaagtttgattaaaattggaacgatgtgacggaaaagttggaagtttgtgtgtgtaggaaagttttgatgtgatggaaaagttagaaatttgaagaaaaagttgggaactaaaatcaccttggagagaatgagaaaactcgtaaaagttgcgagaagtcagcgctgcatgcgtgcgtaacccgtttagttggtggcattgacgcatgatgagtgcattatgagggtggagctgctttgcttttgttagctggtcatcacagtacacttgtgtgcaaaaacttcctacaacgatttctgtacacatgattgctgaagcttaagaatagtccgaaagacctcaaggacacgagatggattttcctccgttcatcagaaacccgaatttttcagtgttgacggcgttctgacgctgggacatggggataagtacactaatcaacacaggaatagctgagaagaaggttcagggggccacaaacaacagcaaactctctctatccaatgcgatttcttgtgagctgtgacatgccgagccaagcacgagacggtcagttcaggctcggcccaggtctgtcgtgtgaggccggctctgtgtcagatactacttgtgaaactgaaggctcgcatctgctgttgatcatgggattcttgggcatggctatctgtgaactgtatttggttagcattgagacaacctgattcatggtaggcctgtcatcgggagattgctgtacgcagagaagcccaatttggatgcacctgtctagcccaagcaggagatcaggctcaggtttgatcagtcctaaatcaagaatgtcctcgatctcatgctgtttccaagactcccaggtctgccaaaaagaaaaaaactcacttacatgatagtgcccatttgcattttctaatagctatatttttcctttcaaaaaattattaactttgcctggaaattcattattttttttctaaaagagtagtactgaaaattatgaacttttatgtcatttttttgcgggtgcttagttcagtctgttggcactggcttctcaacttctgtttatgtgcttatttgctttaggcaaatcaattgtgcgacttatatgttcacttacctcacgaagaaaagttggtaatgtcctgttccttttaccactgattatctctagcaacacaactccaaagctatacacatcgcacttgagcgtcagatttccttgagctgcatattctggagctatgtagccccttcattaacaaaaaaaaaaaagcttgtcggtcagttgagacctctaaggaaaacatgcagaaaatgccagaaaaacttgaataggaacattagctgaagtaatgaagttaaaaatcatacgctgacagaactaatgttggatcagtctggtcgttgataaacagcttggcagtgccaaagtctgctaccttaggtctccgattgtcatctaggagtatgttggatggtttcagatccctgtgaataactttcacgttgtgaaggtactcgacacctatggcgatcccgcggattatgtctaatctttgcacccaattcagagaggctcgcagtctacgatcttctcctgtcagttccaaataggcccgtgtgataagcatgcagaagatcagagctttacaggaatatacagaagataattatgcatcacatttctacaaagattaacagactacagtgagtaatgaatttgtttttttggttaggaatgggtaccaaatatgtagagatccaagctcatgttctccatgtattcatagactagtatcatctcgcctccttcttggcagtaacagagcagctcaacaaggtaggcgtgccttgtgttcgacatcatctccacctctcttatgaaatcctccttgcgtttgtcagtaacaagagactgtgtgagcctctttacagcaacctttctaccactgggcagcttcccctggtgattgtaaaatcagatgtttcaatgcagactttgcatttcaagatttgtggtagtgaagtcaaatcgtaacttagtttgcgtacataaaggtgtcaaattgttgaaaaaagtgcagacctgatagacaatgccgaaaccacctctgccaatgatattgctttcagagaaattccctgtagcctccttcacactagacagattaattgaaggggcagccaaagcaggattaggacgagcatgaacagcagcagtagcagctggaacgcccgcatcatcatctggtgaatataattgcattgatttacaccttcttgtatatcaaagcactcccttcgtttcatattataaatcgttttgtttttggtaaaagtcaaactatttcaagtttaattaagtttgtagaaaaaaaagtagtaacatttttaactcaaaacaaatacattatgaaaatatgttcaattatatatttgatgaaactaatttggtgttataaatattactatatttaactacaaacttagttaaacttaaaataatttaactttaaccaaagtcagaacgacttataacctgaaacggagggagtagaaaactatggggatgattttctcctctctagacgcctcccgtttgtagcacatcgtcaaatagttattaaaaaaacaaaagaactataaaatatattacatataaagtcaaattctcgtttgtgcacgtcgactaaatagttatgaaaaaatataaaaaatagtacatgtaaagttaaattttaacctctacaaattgtagaaaacaacaaattaaagtattcatacattagaagttttttttttataatttgtagaagtttaatttgtctcatggagcaatatatcatatgttaatctatcttatcaatttttttcatgactattcagttgacgtgggagaaacgatgggtcatcatctcaaggggcaaaaaaaatcccagtaaactgaacaaaatagttatcaggaattcagactttcagagtattacgaattgttacctgatactctaggcctctgacgcctcctaatcacatataggaggaccaacaaaataatgagaagaaccccaacaactgaagcaatggatgcaccaataaccacagcagctggaggccgccgttgccgaataccatctttgcctgtcacagttttttccacaaatatatcagcactcactctcactcatttcatcagcattagccttgtcaaatcttattagatttgctcattttgaaagtttttaccaaaaaacatgcgacagttttttttagcaatttcgtaaaaaaaatacattgctacctgcttcgtacctaactcagatttcgccaacctcacgtagagatcttgtcctccatcgacgtagcgcaggtcgacgaggtcgtcggcccagatgatgcatccgctcccggcgccgcagccgccgccgcctccgatgtcggcgggggcgtaggcgacgcacgagcagttggcgaggcaccgcgcccagcactcctccaccgtgacgcgcttgtccaccgtcgcgttatgcgcgtcggggagcttcacgccgcgcaccgtcaggaagccgtccgtggcgcagcccagcgccgcgtctcgccggcacccggcggaggtgtccctcatcttcttccacggcgacggcgacgccggggtgaagccctccacgcagctgcagaacgacgtcgacgccgcgccggcgtcgcacaggccgaacgccccgcacttgccgtagtcgtcgcacaggtccctcggcccctggaagaagttcttccatgcccggctgctcggctcccacaccagccgctggacctcgccgacgcccgtcaccacgaggcgggagaacggcgcgccggcgttggcggagtagccgaaggtgatctcgccggggctcaccgtcagctggtagctgaacatgtcggagtacgtccccatctccgggatgccgctgaaccacagcccgttccacggccccgtccggtacacctcgccgtcgccgtcccagagcacgttctccggcacgcccttcgtgtccgtcctgtaccggtagttccccggcgacgggtcgccggacgaacgccacgacgagaggtaccactcggcgccggtccacaggttcttgccgatcttcatgccggggagcagcgtgtcacacgggtggtcgaacgactgccacacgacgacagcgcccgcgccgccattgccgcggtcactgacgacgaggtttcccgactcgagcagctgcgccgccatggacgcgccgcccccggtcgtcgtgttcgacgaccacacgacgtggccagagccatcgagcaagaggaggctccccgcgtcggtgatcaccagcacgccggaggtgtccgtgagagggcggtcgcggttggcgacccagcagacgacgtcgtcggagacggagaaccatatcccgaggtatctccggctggtgctcgacgacgaagacgacgccggcgagaagaagcccagcgtgaatgagccgccggcggagacgagcctctcgccgtcggtgatgttccggcccttgccaagagtgtcacctagctctgcacctgtagttgttctgccagaattagaaaggagaagcatgcatgataggatgattaggaacattgagctcatggctgattagtagagaaggtaattaaccacctggatgcttaagctagatttgcatctctgtcgtctacatatagactggagattgaaagctggtatcacttggaggttaacctaatatttatatggattggcatttggaggttaagcagctgacttggtcatcatcgatttttggcaaaagagaatatacaactgatgagtgtgattgtatatatatttgtattgtgtctcggaggataattgtaactgcagtctgcaggtagcgtctgagtcataactagcaattacattttgtagccaacctgctaatttgtttacccatgaacatttttgtcttctctgcaagcatatacttcctccgtttcatattataagtcgtttgattttcttatcaaacttttttaagtttgattaaatttatagaaaaatatggtaatattttcaatacaaaacaaacatattatcaaaatatgtttaatattaaatttaatgaaactaatttaatattatagatgctatttttttaaaaaaaatgatcaaacctaaagaattttaacttagggaaaatgtcaaataatttataatatgaaatggagagtacagattgattcaccgtttggactttggagcatgcgaatggtcagtagtcacttgcactgctgcagaatactagtagtaccataattgtcaatgagtgtaaaaatattttatttgagttgtgtgcgaggaaggcattgtcttccgagtatcttgtatattcttgacaacttgcagatttgaatggcaacattaaaatcgggagtactatataaaatgagacaaggtagttcagttcatgcctgattggcaaaggaaaaaaaaaggaaaagaaatcggcagaaacttctgtttggctcaatgattcgacacgtatagaagctagaacagcacaacccatatactccctccattcctaaatatatctgacgtcgttgaattttttaaacacgtttgaccattcattttattcgaaattttttttaaatatataaaaatatatgtatacataaaagtatatttaataataaataaatcaaatgataggaaaataattaacaattacttaaatcttttaaataagatgaacggtaaaacatgtttagtaaagtaaatggcgtagagacggagggactatatatataaccctgtacagttgtactacgtgagatcgtcgtcaatgtcggtggcgcccagcagctccgactcgcgcaacggtggcctgcttctgccgccgtgaacccctggcctcttgggacgatccacccgtgagctcttgctggtcagcatcgcgacgaccgccgacatggccggcctttcctccggcgcatcctgcacgcacaggagcccgatctgcacgcacctcgccagttcatcttccatctcggtgtgatcaggccctgagactgagagagggagaccgatcatcgcgtcaaggagggacatcaccctgccctgctcccacagctcccatgcctgcacacaaagccgatttggtgaattaatccaaatgtatatgtatatttggtgatttggtgtatatatggtgatgcttacatgtggaaggagactgtacatgggaccattcctctgtccgctaagggtttcgagaagaacgactccaaagctgtagacatcgcactttagtgtcatctcccctcgccatgcgtactccggagatgcgtatccccttcatggaaatgtaactcgaccatgtcagtgacacagtaatactacgaaacatgaccagttggctgattgttcatgagcaagagaatggagggtgtgaagtaactgacggtgaaaccacaacggtgagattggaaggctctggctggtctgctgtgaatagcttggcggtgccaaaatctgcaatcttgggtctgaaactgtcgtccaacagtacgttcggaggcttcagatccctgtggatgacgcactcgcctgatccctcgtgcaggtacgcaataccattggcgatcccatgaatgatgcccaatctttttctccagttgagcatgagtcggaggccagaatcgcctgccagtgcaaggtacatcaagttagcaaatgccatacgagaattgtataaactgtaagaatgcagccttttttttttctgtatattcgtttctctaagtaccaaatatgtagagatccaaactcctgtttgacatgtagtcgtatatcagcacacgctcgctgccttcgctgcagtaggcaaggagacgaagaaggttgccgtgtctgagcctagccatcacctccacttctcttgtgaaatccttcttgcctttcttggtgagggttgattggtgtagccgttttacagcaatcattctcccatcaggtaactggccctacagattatacaatttatattgtaagcaactgagaatacataaatttcatccacattcctccaaaaaaaaatcatccacattgactctttgacaacctcactacaaggaattttcattagaaaaatggaagcacacgagtgtcaagagttcatgaatcatgaccgagcgagtatgttctatcatgtagaaattagaaaaaggaaaggaggttaccttgtaaactatgccaaatcctccttggccaatcacatggctctgtgagaaatttccagtggccgccttcactttctgcagatcaactgaaggaactgttgtagcaggattatgaggtataccttctgcaatataaaaagaatcagtctgggtctggaacttcctgggaaatgtctaacgcttaccttaaatttgttctttctgtaagcgtaatctagaaggcaaaatttgctcagacatttgcttcaagacactcttattttatggttgttagtcagaatatgctctgactattattttaacatatcctattccaatggtgagatataactagtgcgttcgttccagtgatattgggtgagaaaacacatcgtttttcacgcgcacgctttccaaactactaaacagtgcgttttttacaaaaaatttctataagaaagttgctttaaaaaatcatattaatccatttttataatttaaaatagttaatactcaattaatcatacgctaatggcccacctcgttttgcgtatattcctaatcttctcaagtttacacttggccaccttgcaagatttaaattcaagcttttttttgaatttaaacatattttgcaaaatataaaacttattccaaattgtggaaaaacattttaaaaaacttgtttaaactcagacaatatatgttcaatttctatttttaaaatataacaattctcatttttgtagttttgaacaagttttgaattttgtaaaatatatttaaattcagctaaaatttgttcagatttaatcttctaaggtggctcaaggataaaatcatcttttgtgaagtttttatctcttcatgggaaaaaagatgtattaaaaaatggtcaaattttaccacagatttagagtatcctaaaaaaaaaccacaaaactagagtttaccgaagcaaatgttgccgatgaaaaaaaaaagtgaagcgtatacaagccattggagaatagcactttacctgagattttgtgtttccttctgcaccaaatagcaagtagcagtacgagcataataatcgtggcagatattggtgcagcaataacagttttccagagcataaacttccggctcctaccctcatctgtcatagctcaaaagttttccagagttaatcatcaatagatagccatggttaatattacatcgaacctgatccttactaaatgtgtcagctaagccaagaaatgtgcttggaaatgacgtgcagaactgaaatcactctgataaaattcagcacatacctaattcagactctgccaacctcaggaacagaccctgcccttggtcgacataccgaagatcaacgatgccgccggtccaaatgacgcagccgctaccaccgccgcctcctcggatatccgccgcggcgtaggccaagcacgagcaattggccacgcacctcgccctgcactcctccaccgtgatgcccgtgtccaccgacgcgttgtgcgtgtcggggagcttcactccctgcaccaacgcgaacccatccgtcgtcgtcgtgttgccgcagcgcagcggcacgtttcgccggcatccgccggaggcgtccttcatcgcccacgccgccggagacgtcgggctgaaccccctgaggcagccgcagaacgacgtcgacggcgcgttggcgtcgcacaggccgaacgccccgcacttggcgtaggcgtcgcacacgtccctcggcccctggaagtacgtctgccatgtccggctcgtcgcctcccacaccagccgcttcaccacgccggtgtcgagcacgacggagcgcgtcaatggcgccccaggcttggagacgtagccgtagcttatctcccccgggctgacggtcacctggaacgtgatcaggttcgtcgtgtacgtcgccgcctccgggttgccgctgaaccaccggccgttccatggccccgacctgtacctctcgacgccgtcttgccacaggacaacgtccggtatgccgctggtgtccagcacgcggcggtaggcccccggcgacgggtcgtccggcgagcgccacgacgtgaggtcccactcggccccggtccacaggttcttgcccatcttcatgcccggcaacaaggtgttcgacgggtgatcgaacgactgccacaacgtggtggtgctgccgcttgcgtcacggacgaccaggttgccggagttagacagccgcgcctccaccgaggcggcgtagggcgagttcgacgaccacgcgacatggccgccgccggagccgtcgagcaggacgaggatcccggcgtcgctgatcgccagcacgccggaggtgacgttgagagggctgtctcggttggccacccagcaaacggcatcaggggagaccgtgaaccatataccgaggtatctcttggctgacaccccgggggagaagaaccccagagtgaacgtgccgtcggccgacacgagcgtctcgccgtcggtgatgttccggccgccgcggagcgtgtcggtaacggccgcggcggcggcgaaggctctgggagcaacgaggaagaacgagaagaggatgacgtcaacgaggcagatgccagtcgttgccttcgccattaattaatcaccacgacgctaattggtttcttgctcagttcatgagctactcatttatacatgatctgcaatgcttatcagttatcaaggctaatctagtgcagtttactacagaggttacaacgcaagtatgtacagcctggtaaggtaaagtcaaattaaagttctgactttgtcatctgttcatcatttttttttgaacgaatatgttcatcgattagagagcacaaacattttgtattagtagcgtttgcatccaaggaattacttcatccgtttaacaatgtaagtcatttttatatttctcacattcatagtgatgttaatgaatctagatagatatatatgtctagattcattaacatcaatatgaatatgggaaatgctagaatgacttacattgtgaaacggagggagtaagttacaacttgtgcaggagtgtgcacctagccgcacctacacgtacaatatattttgggtttgttttttgcgttcatgcatgatcgttgagataaaaataccacagataaatggttaaagtaagtgattaaggtcaataatttgaggtcaacacgcttggcttggctcttcattttgccatgtcgatgaggtcagataacgggtcagtgaagaaaaccagcgattccttcccgcgtagaactgctagctaactttgctacactacaggatgctagcggtacagttcgattaatccacttatagttacagggggaaagatatatcactccacaaacaaacaactttaaatttaatttctacaagttgtaacaaaaataacaaatatagttgcgaatatgcgataactattttcagtttaatttgttatttttgttgtaacatgtagaagttgaatttgatcttgcatgttgtcgatgggtgatacccgtaggccggatatagaggttattggggtacgctggtacaaggatctacgtaatacgacatcaagcagacaaaagacaaagattatactggttcaggccccttgataggtaatagctctaatccagttgatgtgggattatatgatggaaaacacaggttacaaagggaacaatggaaatcgacggatccggcgagatcgtagtcgagttggttcgactagatccctagcggtttggctccttgtaggctccgacttcatatgctgtgagggttgtgttggctctgagattcgatgcctcaggccctccccggggggtcccttttatatcacaggttaggcggtttccaagtagaactcggaaacatcgaactttacacgatacattgatgacccagtcttgtccgagtatgactccttccatttgtaaactccgtgaggggtttccttaatatatgcggagagtatccgtatacgcgtgggtataccataccgatatgagacgtatatcaaagagtaaagggtatacctaacccgtaaccctgacagtagcccccgacttctgcttaaatgagctcgtgtaaccattcgcgacttcctgtgtcgagattgttgtcgttcctggtgcgaggaccgtagagacatgacgtagtcgagaacaccgtttgaaacccaatggtcacgagcgaatttaaactaaagtccaaaaaactgttgcgcgtaacggacccagaaattttcggcgggcatctctctccgttccttggaattcgcaccgtcggtagtgcgtctctttaaaggaattttggggatccattttgaagtccgcccatcgtgcagaaaacatcccgcctgcaaacgctcttagtcttctccgcttccacaagaaaccctagttcgtcgaccttagccccttctccggcgatctccgatcgacgatggatcttggcaaatcatcctccaccagcgcgtcgctgaagaagattcaggaagacggcgcccttcccggtcgtgggaccatggaaagggaagcaggaggtactaatccccagcccgtcttaggtcgcatggttgcgattgaagactacattctctgcggttttctccctccgccttccgaatttcttctcttagtcatgaacttctacggtctttctctgctccacctgaaccccaattccatcgcctttcttagcatcttttctcatctttgtgaggcctacattggggtagagccgtttctcgatctctttcgcttctactatgagctgcgttggatggagcccaacagggtgtctggatgcgtcgggttccgacttcgggatggcctgaagtcgcgttacatccccttccagtgtccctcttctcgcagcaagtggtggacgaggtggttctaccttcagatcaaagattcggaccctgtctttgttgttcctgaggaacaaccggacaagatcccgtcttggaccgcaaagccccctttgaccccttctctccaatccttcatcgacattgtcgacgatctccgagtatgaggcttgtcggggtatgaagtcgctgcagacttcattggtagacggatccagccgctctaggctcgagtccacccagcctttgactattccggaccggaggacgcgacccgggtttctcctcggggtatctttcttgcatttatcctaacatgctcgtgtccacgttcctcctgatttatcaaaatttggttctcgattcacaggactgaacagcgaaaccgtgggacgtcgtgtcagccaggtgatgatcagcggcctggcaacggcgagtaacatccccgttcccctttgtgaaaagggggcggccaaacgtgatgctgccatcaacgtaagtgttctcgataggcatcctgcgttttccttctgagatcactttatgacttgattaagcgtaggctcttcctctgactgacatcatcgggccactcgcggaccatcaggtgacggcatctctgaaagagaaggtcgccaaggaggcgtctgatgctgctgctgctaccacaagtggtggcaatgttccgacaaaggggaggaagttctcctctgtaagcggacatcgtcgcaaggcatcaaccccctcggtaagctatcctgtcatcagatcgtacaaccagaagaatttcgccttacttcgcatcgaccgtttttcaggcctcggacgcgtctctaccgcctccacgacgacaacgtcttgtgacggttggcgagaagtaagtagatgaacttaagtctccgtgattttgttcgagtgttatctgaaccatagctatctcatagggcggcacgggcgaaggcggtgcaagacgagtctggagggacttccggcgtgtctcccactgcagcctcgacggatgtcgtgcttgcgcccgggagacgcgaggcgacaccaagcggcccagtcagcaatcctgcggctggtcgtggtccaccggcggccatcctcacctgggaggagctccaggtcgagatggggcgcctcctcgaggctggtgctcgcggcattggccgtgagattgcggaggcgaggtcggcagcggcgtcggcgaacgagtgtgctgaccggcaggtacgcgagttggcggaggctcgtgaagacctcaagaagatgagggagttggtggccggcaacgagcgacaacggcaggggctcgaggaccgcatgtcgaagctcgggaacaacctgtcggaaatccgtggctcattgcgggtcacacacactggcctgcaccagcttgccggggagtgcggcattaagtctactatcccggcgaatcccgacgagttctcgcttacatcttctcttgcggagctggcggcggcgatgagggagatcccctccaagcatgcggccaggatcggggaggagacgtcgaacgggatctacaccggggcgtgccacgtcctcgcgtgtgtaaagctggcacatcctgaactcgatttgcgcgagatcttggatcagggggcggctagcaacacgcataaggaggtgatggaagaagtcggtgatctgggggaatctgttctccccctttttgaagagtaggacctcttgtactcccaagacatgctgtgtaaaactgaatcttaatcgcctttgtgcgtgcaattattgttctagcttactcttgtatgttgatcttgagaacttttgtcccttgtagagatgttgatgacgaggatgtccagcagcgcgggcagcccgagtcaccagcgattattccggttcttgcgtttgaaccacatgcgtcgcccgacaatgtagaccagacccttgctacggggacggagatggcgacgacatccttaggttagtagcccattcatccctttctgctcttccgactagatcaactatgttctcgaaagaggcgtgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaggctgtggaaacgctccggggtcatgaggtgtggttcaactcgtacttgaagagttgctgcacatccatggccaaggtctgtagagaacttcgagtgccccatggagatcccgaggagtcggcggccggatacatctcatggctgaacggagcatgtgctcaactcgatggcgtcggcaagcgtatcgacgaggccttgaagcaggagtgtcgtcgatcgagccgatatgccggagggcacgtgttggcttgcctacgagatcatcgcccgcacctggacctcgattttctccgtgagggttttgctcattctcggaggactccggcggagatagaccacctggcgaggtcgatggcgccgttggcggagaagatcttccagtctatggactggcgttggccttcttggtagtcttcgtaccctgtgatagatatctcaggaaaaaggtgtaatatagctttggatttgtgttaaaactgtaagaagtattttgtgaaatagagaagagatctatctttaacaaatctttcttactccggatgtcgtgtgtaagagtatgttctcagttcacgactttagtcagtcgtttgagtcgaacactctccctagcccccagccttgtcgtcggaggaattttctcggaggataaggctcttggacctttgatctgccttggttgaataagctctgatcctagctcccagccgtgaagttggaaagttaatttccgatttcgcggcttggttaatacgcacggtgagaactcttacacgaccagatcttacatggtctttcgtctctacaggatctgacaaggccttatcggctctgggcgtccccagccgaagatcccttaggttcctcggaggccttgtcaagacggcgtaaagggacatgaggataggtttcaacgctaggtgtcatcagggtaagggatcatcgggcggaaatactttgattgtaatatgggcctaagaataggctttattgatactgtaaggtgccttacaggtacggatggtattgactcatacatagaatttacgtagttggtcaatgttctaagaatttgctaactcgcgaccatcgccgtctgcgattttgaatgcgcctggctgcaagacttgtgtgatcgtgtaaggtccttcccatttgggtgagagtttgtttcgccctgcttggctttgaacccgtcggaggacgtagtcgccgatcgaaagtatgcatgcttggatgcgcttctcgtggtaacggcggagggtctattgatagctggctgctcgaacggcaactcgttcgtgatgttcctcgagtagatttacatcgacgtttcgctgctcctcctggtcctcgtcggaatgcttctgtactagtgtactctgatgtcgtagctcgctggggagcatggcctcgaagccgtacacgaggaagaagggtgtttccttgttagacattgtcggtgtggtgcgtacggcccatagtactgatgggagttcttcgacccattttttgtcatgtgacatgagcctgtcgtagacgcgggttttgatcccttgtagtaatatgtcgtttgccctctcgacttgtccgttactttaagggtgggagaccgaggcgaagcatatcttgactcccagcccgatgcagtaatcctggaaatcagcgctgatgaactgggagccgttgtcggttatgatgcggtgcggtagtccgtatctgcaaaatatacccttgatgaatttgatggcgttgtcggccttgatttctcccgtgggtactgcttcgatccatttagtgaatttgtcgatcgccacgaataggaacctgtagccgccctgtcctcgtgggaatggcccgagtatatctagcccccagcacgagaacggccaagtaagagggatagtctggagcgcttgcgcggatagctttgtgtgtttactgtggaattgacaggcttcacatcgctggaccatgtcgcatgcatctttaagggcggttggccagaaaaacccttgtcgaaaagctttcccgaccaatgtccgaccggtggcgtgtgacccacaaatgccttcatgtatatcaaggaggaggtgtctaccgtcgtcggacgagacacatttgagaagtaccccgtttggcgctttcttgtatagattgttgggccactgtatcgtcctcgggcaactcctcgctgttgatgaatttgattagtgggatgcgccagtcgtctgtggtctcgatatcggcaacggcgtgttctgcctttgtggcctccgagctaatgtcgggggtgaccgggctaacttcaccgctaacctcttttactgatggcttcgttaggatgtccagaaaggtgccgggctcgagcggttctcgtctagacgcatgtcgtgctaggtcatctggctcgatgttgtctttgcggtagacgtgtcggacttcgatcccatcgaaccttttctctagcttcctgacttctgcgagatacttggataactcagggttagagcatttataatctttgtgcacctggttcgcgactagttcgaagtccccttttacgattagtcgcttgaccccaagtgcagctgcagctcttgtcccggctagtagtccctcgtattcggctgtgttattggtcgccctgaagttgaggtggattgcgtgcttgaattgatctacggagggagacgtcaagataaaccctgcccctgctccttggctgttgagtgcaccatcgaacgccattgtccacgtttcgttgtcgacttggttgtctgatttgttatcaggcatagtccaatcggctacgaagtcggcgagtacctgggatttgatggctgttcgtggcgcaaagtggacatcaaactggctcagctcgactacccattttgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtactttctctctctcgacaatgatgacggtgctaacggaatatggcgtggcggcaatatagaggaataattcttcattaggttggggggcaacaagtacaggggggtttgataggtagcgcttgagtgcaacgaatgcctcttcggcttcctgtgtccatacaaatttgtcttgcttcttcagcaaagcgaaaaaaggttgccctcgttctcccatcctagcgatgaacctgctcaatgctgccatgcatccggttagcttctgtacttctttgagtcttgtgggcgacttcatgttctcgattgccttgatcttctcgggatttgcttctattcctctgccagagacaaggagtcctactcgcgaacacatattcctccgcgtccttttcgaccacgcgtactcgtttgcctttttcagatgcaatgtgcttctcgagcgattttttgaaaacaaggcaatcttccaaagaatgtctgtccgtcttgtgtatggggcaccatgctttctttgtgtcgctactttgtgggtctgggtgcttgggagggttcgcgtattctgctgcgaggacctccgcttgagctttccttttcccatttttgcgattcttcttcttgcttgactcaggtgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgggtagtatagcgatctctgacaccggatttgaaggcgcgaattacagaagcatcggtgatttcggggattgtatttttgcactcgttgaagcactgaacatattccctcaaggattcacccgagttctgtgtcaacgcgtgtaggtcgtcttcgatcgcgtggcgcttgtaggttccttggaagttggcgacgaactgttgccacaggtctgcccacgaagagattgagtagggcggaagatgcatcagccatgaacgtgcagagccttttaacgcagttggcaaataattcgccaatgcgttgtcgtctgctccggcagcatagagtactgtggagtagacttgaaggaactcttctgggtcggtgctcccatcgtacttttctattgctccgggtcagaatctctcaagccatcggacatcacgtagggaacgactgaaagccctacacccagcgctgggggcggtgggttgtcggcgatcgtgtgtccttcgtggatgtctgtctgatgatgaggaagacgaggatgatgacgatgacgatgggtcgcttggttccggcgtacgaatacgaggatgtcggcctggatctcgagaatcttgtcgtcatctcccgctgttgtctcggcgccggtctccatcattgtcatcgttatggcgacgtcctcgaccagtatcgtctggcacccgccgttcgtgatcgttgtgatcgtggcggttgtggcggttatcatggcctcggtcttcgtttgagcggtctcctcgatcttcgttattatggcgccgtgaagagacatgacgccgggaacgattctcattgtctcgtgcgcgtcgtgcctctcggcagccgttgaggtgatctcggagatcgctagtgccgcgaggtggaggggtggctcgatgaggcgattccctccgttcagggtcttcaccattggcatcgccagttggtggttgctccgggtgcgctgcggcggcggcctcttcggacgcgttgctgaggttggtcactgattcccgtagtcgttctgtccaatgcgtgatatcgtcgttcaaaacaggatcgtagggggtttccctcagtatagcgttgacggctctgatgtgctgggccggggtggccaattgattctccgcttctgcattggtgcgcgctgacgtgccgacatcatcgatagccaatacctcccgcggcgtgctcgttgttgatgatccatagtcttcgagaaggtgcaagactgatggttcgtgaggatcgatatcgattaccccaacaaatcgatctgaagttggcgtcgctcctcgttccttgtctttatccctgatggggatgtgtgactgttggaccttaggagatggcgctttcatggtgctgagaaagaccttgcaacttgagaggtcgtgattctttgtcttgtgaataggacaatagacatcacgagttggagaaatacgctgaattccacgctctttgcaggcgcgaatttcagcgcggatgttgaggaaaactcagcaggcttgcaaagtgtcacgcccgaaaattcactagtaatttccgaacttatttgtgcataaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcgggctagggtttcggtggaccgggcgcacgggcggcggttcacgcgaacggacggccgagatcgaaccaatccaagatggacggccgagatcgatcgggtccacggcggtttacggcggacggcctggatgacgtcagcgatgacgtcaccaccggcggcggcggctcggcggctcgggctcgcatgctcgccggcgaacgacggcgcggcgacgcgaacggagagcaccaggacgtagagcgcgacgcggcgaactcaccggtgaccaaagaagcggcggagaagcaacggacggcgacggcgacgaggaggaagcggcggaaaccttcgggttgacgacggcgatgaagctccggcggtctccggcgacggcgaaggggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggctacgggtagaggagagctcgggggtccttaaataggtgcaaggaggcggcggcgaaggcccacggcggcggagacggcgaaggaaagctcggcttggagagaggaaaaccgatccaattcgaactcgaatccatcgatttccaaaccgatttaggcgaagcttccaaagaagaaaagtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcgggccccacctgtcagcggctgagagagagaggagagcggcggctcggcggactgggccggctgggccgaggagggagagaagagaggttttgggccgactttcggcccaaagccaaaagaagacttttaaaacctttttcaatttaaattatttcttaaatgcaattccatttactaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctctttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcaggatgtgacacaaagtgtgtttcctggttttgtggataggacaccaggaccttgtcacttcggaagtcatcttcgtcagctcgcggttcatgtcggaacgacaaggtttggccgcattagaatccttctcgagctcggatgtcgtcgatgttccgttctccgcctcggcgggaggatctttcgacatggagtcgtcttggtttgtagccattgcgttctcgtttctagtcattggcggaccggttgagatcggcattgtggtgtaaaccgggaagacgatttcgccgacttgagtccacaccagcatcgttgaagcagggaatacttggctgaggttggtgttgacgctattgtcgacgaggctggatgacatagtagtggaaccttgagtaccaagtccccctacctggcgcgccactgtcgacgggtgatacccgtagaccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccagcgagatcatagtcgagttggttcgactagatccctagcggtttggctccttgcaggctccgacttcgtaggctgtgagggttgtgttggctctgagattcgatgcctcaggccctccccagggggtcccttttatatcacaggttaggcggtttccaagtagaactcggaaacatcgaaccttacacgatacattgacgacccagtcttgtccgagtagaactccttccatttgtaaactccgtgaggggtttccttaatatatgcggagagtatccgtatacgcgtgggtataccataccgatatgagacgtatatcaaagggtaaagggtatacctaacccgtaaccctgacacatgtttgtggagtgatatatttcatattaatctatgttgttatttttttcaaatatatttataactatttaaatgatttacaaataacaggggatgtcctctcgtgggatgaaaatcatgtgttacatgagacaaaacgtatgcacatgtataaaattggcccattaccatcgtgactttggaatgggccgggccggattacccgtgacgtgctttacggcacgccaacttccgggttgttgattaccgttgagaagttaggtggtgtttggatccagggacttaactttaatctctgtatttagacactaatttagagtattaaatatagactacttacaaaactaattacataaataaaagctaattcacgagacaaattttttaagcctaattaatctataattagagaatgtttactgtagcatcacatagggtattcatggattaattatactcaatagatttgtctcgtgaattagtccaagattatggatgagttttattaatagtttacgtttaatatttataattaatatccaagcatccaatgtgatagcgacttaaaagttttagtcccatctaaacagggtcttaacgtcttttgctgcttgtcaacaagttaaccaaaaaaaaggaaaatggttccagttaactgctcctcatatcatgttaatctgtagttagaatcatgaatacatcagccattcaatggaatatctgcaaaaaaagatgaccacacaatgacacaagtcacaagcagccaagcagaagagacatctacaaagagaaactaagtcaacacagacatgcatacaattacaagcagagaaaagaaaatccttctcttctactacacctgagcacggccaatccaggcagtctgcatgcattaggtgagatcggttgtggttgagccttggacatcactctgacgaagcggacgcatggcggctctgctgtcaagtgtcggtctcttgggctgctccatctgcgacgtcctgctcgtcagcatggcgacgatttcggacatggtcggcctatcgtccgccatgtcctggatgcaaagaagcccgatgtggatgcaccgttctagatcgtacaggagctctgcatcgtcgggtgcaggcctcgccattgccgggtcaaggaggtccatgaggttgccctgttcccacaacctccatgcctgtatgcacgaaagaggtctaactgaaggatccaaatgccattgtcttgcaatgaagatttgatgtgttcagtgcactgcttgattacctgtggaagaagcgtctgcattgagccgttgcgaacgccgctgagcgtctccaggaggacgactccgaagctgtagacgtcgcacttgagcgtcatctcgtctcgtaacgcgtactccggagatgcataacctcttcaattcacgaattcaattcaaggcttcaaatcaaaacttgagcaacattgctactaggaacagccattagtttacttactgtgagaccacgagggtctggcctgactgatcggcgacgaacagcttggcggtgccaaagtctgcaatcttaggcttcaattcgtcgtctagaagaatgttgctcagcttgagatccctgtggattacactcccgtctggtccttcgtgaagatacgcgacacctttcgcgatggcctgaattatgtcgagtcttcttctccagtgcagattagctcgacgcggcaacgggcctgaaatgaagaagaacatggaaggtgacattatttattcatgtcatggtgaatttatgatcaggtcagtgatgtagcttaataagctgaattcagatagaacagggtgggtaccgaaaatgtggttgtccaagctcttgttcttcatgtaggcgtataccagtatacgctcattgccttcgttgcagtaagctaggaggcggagaaggctaccgtgatggagcccggccatcactgccacttctctggcgaaatccttcttgcctttgttcgtcagagctgactgctttagcctcttcacggctaccattctcccgtcagattgtactccctggtcatttccaaatttcaggtgattgcaattgcatttttggcatttgccagtgtacggtattaagtatttgcaacttatgtttaatttcttttttcatgaggattagtgcaactttcatgttacatgtgtctatcttctgaagagagaggctcaccttataaacggtgctaaatccaccttcaccaatcaagcaattttctgagaaattttcagtaatagactttatagtagctagattgactgaagcaacgcccatagaagggttatctggaataacatctgtggtattagcaatttagcatacagtttgttagcttagaacttcataataaatatccttaagattaaaagcctggatttacctaaaattccgtgattctttttgcaccaaatagcccaaaccccaaaagcgatcaaaagaatagcaatggtagcagctacaggtgggacaactagtacaatcagagaccttttggtctcaactgttactcagacaaaaaaaaaaagacatagagagagatcagttcatgctcagaattactcccttcgctgacttttctagttaaaacttctttagattaaatcaaatttatataaaaaattaaaagagattgcgacatcaattaggttcattaaatataatattaaaatattttgataatatgtttatttgtattgaaaatattgttatatttttctataaactaaattaaacttaaaaaagtttgaataggaaaaagaaaaggtgagagtgacttatattcgagagagtatcatatgtcggcatttcttttacggtgacatcaggatcgttactttgttaaaaaaaagaactgttactttgacatttctttcgctaatcttttatctggggtcattttcattcaaaatataggctcggattgaaacccattttcattattgttttagaacataatctttcaagataaaattgaaaataaagcaatgcacataccaaattcagacttagccaatctcaggtacaaatcctgcccgcggtcaacgtagcgaagatcgacgatgtcgtccgtccaaatgacgcagccgccgccgttgatgtcggcggcggcgtaggccacgcacgagcagtttcccaggcacctccgctcgcactccgccgccgtggcgcccatgtccaccgacgcgttgcgcgtgtctggcagcttcaccccccgcaccaccttgaacttgtccgtcgtcctgctcccgccgccgccgccggcgcagtccagcgccacgcctcgccggcacccaccggaggtgttccgcaacgcccacgccgacggcgacgcggcggtgaacccatccacgcagccgcagaacgacgtcgccgcggcgtcggcgtcgcacaggccgaacggcccgcaccgcgcgtagctgtcgcaggggtccctcgggccctggaagaatcgctgccatgcccggctgctcgcgtcccacacgaggcgctcgaccacgccggtgtagttcaccacgacgcgcgtcaatggcgcggcgccggccgtggcgaccgatccgtagccgtaggtcacctccctcgcgctggacgtcacctgcagcgggaacttgtcggagtagttggacgcctccgggacgccgttgaagaacctgccgttccacgggcccgtgcggtacaccttggtggcgccgccgccgccgccgcctcgccacaggacgagctccggtaggccgtccgtggccagcgtgcggcggtagtcgcccggcgacgggtcgtcagcggagcgccacgccgtgatgaaccactcctgcccgctccacaggctcttgcccatcttcatgccgggcagcagcgtgtccgacggctggtcgaacgactgccacaggtaggcgtcgccgccgctgccattgcgcacgacgaggttgccggagtcgagaagctgaaccaccgcggcagaggcggccaagaagctcgcggaccacaccgtccggcgagagccgccgtcgagcaggacgagctggctgccatcgtcgttgagcagcagcacgccggacttgccgtcgagggggcggtcacggttggctacccagtagacggtgtcgccggacacggtgaaccatatgccgaggtatctcttggtcgacttcccgggagagaagaaccccagagtgtacgagccgccgccggacgagacgagcgtctggccgtcggtgaggttctggcccttgtcgagcttgtcggcgacgcccgcggcggcggcggccgacgtttggccggagaggaggaagaagaaggcgaccaggcggagtaggttagacgattgcctggttgacctcatgacaaggtcaaaatgtctctagctcttgttgcatgcagaaaggctagctcatgcagcagatggccatgaaggatggtcatgtatactgatcataggcatttctggatatttggattggaatattggatgataaactagttaattcaggtagtccggatctgtctatttagaatttgaaagaggtacatcaaatcccatacgacaatatctaaattctctcaaagtcgtactccaactaattggctgaatttattaatttgcactcaattgggtgtgaaaaaattgcttaaaaagtgcaggtcaatgtgactgcttcgttccaaagatttcttcgtcttagcacgacctgtggctacacgtaaccatgtagcagagctttacattcttttggcctgaaaaaggaaatggagaagcacaatatgcatcctagttatccaatgggttaacacaaggcaaaagtctcccgtgcacgatgtctcacaaatgactttttacagacactcaaatcctactcaaaatagcaaacagatttgataaccggtcactagggcctgtttggttgctaccctgaaaaaaatttacctgacctgagactagcctgactcgttctaggctctgtttggttgctagcctgacactcttttactcaacacggagacgcgtgattagcctgagtcaaatcggtggcctgagcctcaggcgcagcgaggacagaagattaccatcataatctgtttcggcagccagcagaatgaagctgccctcccgtgaagctctgatgccgccactgcgtgaagcccttgcctggctgcctccgccgccgtagctatcgccgccgagtgaagtccatgccaccgtcgccttcgtctacgcgaaagcccctgctgccgtcgccggcgtgcgacaccagatttatcccgtcgtctttcgcggcggctgtcgattcttcggatcccgtcgttgttgcaacatcttggcgcgaagcttcagccaatgctgtgattcttttcgctcctgtcgttgttgccgattgaagcttgccgactgctgcttggatttggggatatttttaatccttgtactcctttggtttccctttttttatgtatgtgattaattgctattggaaagctacgatttcagttggaactgtcaagcaatctcgccgaaatttgcgtcttcttgtttagcacttaacttactagtgaattatcagacccaaatcactttttcccttctcaggcagcggcggcaaaccaaacaagcaaaagttcaggccgcctggccaggtaacattcaagaacttctcagaagcatggtgctcagggcatcaaccaaacaggcccacaacaggaggataaatttcctggtgttgcataccctgatacccagatgtataaacaaacggcattccaattcccaaatacgcttacagttccacatattacaagcaaacctatatacaaaaataataacaggtttattactaggttaacaacaaacaaacagggaaaatgagagacaccaacttcagtaatccaggttggcaagttgaacaagagattcagaggcactgacaaggagctatctgccttgcaattgagtatacgtcaactgattccccgatccagtattgttatcatccagaggaacccttccgacgaaaaatgcagcttgcttcggagcaggaagtgtaacatccccactgagcatcctgagcaccaggggcatgcttggcctatcacctggtaattcctgcacgcacagaagaccaacctggatgcatctgcatacttcatcgtaagagcatatggtgcccatgagtggatcgatcagctccgagacactgccttccttccacagtgtccacgcctgaaatgggtacagtgaattagaagatgccaatcataaaacgtgtattgattaccatatagtttgccatttaactggaaaatgacaaggggaagaagatagtatcatcttacgtaacccaagagattcattgaccattcttcatcaacaaatgagctgttccttcgtccgctcacaatctctaggatcaacacgccgaaactgaagatgtctgatttctcagagaatttgccctccattgcgtactctggagagatgtagccactgcatctcacagattttagcacatttagtttgccttctaggacatctcgtaatgtcaactagcaggtggattttgttatgatctaaataatgtagtaaaatcatagagttaatgatgcaagaagaaagcagtagtttagtgaggcaggtcagtacagttaagagttggatcgtagaatttttgttcaattttactctagtgaacaaaagtgaaaaagagccttactaggttccaacaattcggtgggtaagggcttgaagttggtgttcaccaaatattctagccataccaaagtcagatatcttggggttgaaatcatcatcaagcagaatattgctcgctttgagatccctgtgaataattttgagcctggaatcctgatgaaggtacaataatcctctcccaattccctgaataatcttgtatcgcaatttccatccaaatattagcctcttactttcatctaataagattcacatgaaagcaccaaattagcagacaagttcagttactggcttacatctaaacaaaatcagaacgtcaggatttgcaggaatcaaactaaacgttaccaaaaataaatgagtcaaggctcttgttgggcatgtattcatacagcaacatcttctcttctccatgaacacaacaaccaaagagcctaaccaaattccggtgttgcagtttggatagaactatcacctcgttcttgaactcttccaatccctgactggatctgtttgacagcctcttgacagcaatctcctggccatcaggtagtaccccctagaagtaatatcaactatgttggttcaggtattgatcttatagcattacgattttgaattccaggtcagaacaaagatagtaaaaacaacaatttcattcatattaacaagataggataaaatgataaaatgtttaaatgaccataccttgtaaacaaaaccaaatccgcctccaccaagcttgttgctaaaattatttgttgctgaataaatcgtgctaaactcaactagtggtgagcttagaactgcggatttcactgaatcacttctgaatatagcttcatctgcaggtggtccagcttcttttgtgatcagccgtggtgcttgtattctccttatgcctgcagattagtaaaaatattagatataaacctaccagacagctgttaacgcaaactgaactatatcagcaatctctaagactaagagataactgtcatgaaattatgtttggccgtagaatattatgaagtcttagccttgtatattcataatctgaacaatggcatgtatcatacaaattattcctctaaatcatacaacagaaagaaacactaatgacatcgtagaaggaatccaaatacatgtgaagaagtcagtaataaaaatattacccatttgctttatgacaaatttcttcaggcatccaaacacacagaaatgcatgagcatgatgccgataaggaagatggcagtatcagcgctcactaagacaattgagcatttatgctttgcctagaggaatgcatgtcaacatcgaaatttcgtggatttgcaagataatatgttgtcaatgctccgttcttatcaaacagaacaactggtcaacaagattggtagaatgacaaataaaaactgataaatttataagacaatggaacgtgatgtattagacactgttatccttcgcttgaccacttcaaccattccatgttcttgacaagttcagtatttgttgacgagatcatgaataaacaatcttaggatgtcactatctgaccatgccacctcctagctttgcttaggagttaggacaggagcgaagaaggcaatgcatttttttcatagagcaatgcttttcgttggcaagtggcaacaaattaacagcagccggagaaatctcgggacagtctagcatggaccaagtgctgaaaaaaaaatgaaaattgagacgcggaaatgtacgtccttgcagattatcagattagtcaacatatgcggcgaataactaaaatttctaactatcttcccgatccctaactcacaatccctgtagattgtctatacgggtataggtgggaacaggatggaactgggattaaatttttgcgggacctaacaacccagaaatttcttcattcatgcaggcaggatgacatttcgtgcattcctataccaaaaatatcgcttaaaatctgaggtgaaataagggaggagtagtacgtagttactgattctgggtcgcctttccgagcaagggaaacgcagatcgccgaggataagatggggagatcttcacggtggagaggatctgggcggccgacccatcgcgcctacggccggcgggtccccccccccccttccatcgccggccagaccgccggcggcttcggcctcgtcgcctccgccgtcgccgcggcacaccacctcgccggcagcgaatcccctcccctggaggccagtccgactaatgggctttgccgttagcggcctataccgtaagcaggccagatctagttgtcacatgcggaaagaataaattcactttaggtccctctatttgtcgtacagtctgatttttgtctctgaagtgtaaaaccggatacaacatatcccccaacttataaaaccagcgcacataaggtcaggtcctaaggtggtttggatagcagttttggctgacgtggcgcctacgtggctggtttgactaggtctccgtcccacgtggcattgacgtggcacttacgtagcaattatatctcaaaaaataataaaaacagcgggcccacatgtcaactacacaaaaaaaattaatttagaaatggtggggcccacggtggcccacatgtcaactacacaacaaaataaatatggtggggcccacgtggaccccgtatgtaggctgtagcaatttctttctcctctctatacccttctcccctaccttcccatatcagccattgccgtcgacgaagaagcttcgcgtgggtggtagagcggggcggagtgaggggcggcggcgcggcggatcctcgcgaccacgtacggcttcgtcttgacggcaccgacgacgcggaaccggtcgccgccgacgtaccccacctcgccggccgccaccccgccccccactccgccgcggcgccgccgcccgccggagtacacgacgccgatcctggagccacgtgtgcaccatggtccggttcctgaactcgaacgcctggagctgcaccgtcgcgccgggaagaccactgacgggaacagcacgatggggatctccgccgcttgctcctgccgcggcgccctcgtccacgcagccgtgcaggttgctgccgcccctgcatgtttcccatcaaacgtgtactagcaactacaaccagcaacaccatggattgttagttgagatgatcacatcttccatatatatcatatcagttatccccagctcctaggttttttctccagctatgatcaatgattcaaacgagtacactttgtccgatccacaggtctgaatattccatccgcagagaattctgagacgacgacgacgaagaagctagatggaacttgcagagtcttgagcgccgtggtctcctcctcctcctccgcggcagcggcggcgggctgcctcgagctcccgtccacgtgcggctgcgactcggcgggcggcggagccaagcggagggcgccagcctcgtcgtcgtcgtcttccggcacgaagccggcggggcggggcggagcggggggcggatggcagcgcgaagccgacgggatggactggggcagcgacgggcggacgcgcgggcggagtcttcttgaggtcgtcgtccccggcgccgccgtgaccgtggccggagaggggagatggggagaggggaggaagaagaggtaggggtgagtgacatgcggggcccacgtgggccccaccattttttattactttatgtctaaaactgacatgtgggtcccatggggtttaatattttttcatatcaagttgccacgtcaccaccatgtcaatgccacgtgagacaaggagctagtcaaagggagccacgtaggtgccacatcatttaaaaccgggcacaatactgccgagggactttttctgcatggttttgtaagttgagagatgagttgtatctggttttgcgaccaaaggatagaaataggactggacgacagataaagggacccaagtgaacttattcccatgcggaacaacctacaatccggcttcatttagaatgggcctcaattcaagcccatttatctgtatgggctagaatttaagttcaaatcctcatccttttcacgcttgattgggctgggattaaggcccatttatacacggccaccatgcttctttttaccaacgaacgaactgtcgcattcaaaagaagagaaaacacccccccttcttctttctccttgacgtcatgtcagtgaacttgttttcctttccctccttcaaaaaccatgtaagcaaatccaggagagaaaaaaataaagatctagacatcggacggcactatccaagtttaccacatcctgcgggcagagctcgcgtcactgccgtcacaccgtagggagtttaacgcgcctaagcatccacacccctcgccgggcgtccgcatcaacgctgctgctcccgtcgccgtgccacccactccaccatcagtccatcacatattctctcgtcctatctctgatggcgctgtccacatgcgccaccgtggcacgcgccgcgccgcgccgcgtcaggcgtccgtcagcgggtggaaacccaccggtaatgagaacgaacgccaccgcgaccacacacagaacccgctcggaaacacaaacatcggcgttgaacgcgcgacgaattccaacgcgagaacgcgcccaaaaccgcaaagcagccgagcttctctcgcgcgcgcaccaaccgccgcccgtgcccggtgctccccccactcacggcactacaacaggaatacccctccaccaacgtataggctgcaacggaagtgataatcgttgttaagcatccgctttcaaccactcggccacgcccagcgacccaagtcaacagaaacgcaaccaaccattatcttttcctgaaaaacctcccctcacaatcctcgcccgatcgaaaaggatcgtgatcccagatcgctgccgtgtcaatgctgcgccgccccggcccgagcaccgccgcctcgtccctgccctgaccccgccgcatcctccagttctgccgtcgacgctgcgccgcctcgacccgcatgtcgccgctttatcctctcccgtgctgcgccgacggctgaccggcacgccgccgcctcattgccccgatcgcgatggcccctgaatcccctgaccctgttgcctggaccgccacatcgtgctccatctcgtccgctgctgttctcagctgatctggtatgtgattgcggcttctaatgtacgaattatcattattccctgacgtggactgttgtgtgctctagatacttcgttaattttgcaagaaacacacctaaatcctgtagagctttatatctgcgataggcaagtaatgatgccctctttctctgcaggttgatccctagtgacttagttattagttattgatcatgccccaagtttctcgatggaattgcaatgtaagctaagtgattagtgaatcttgtggctatttttctgctctggtatgtggtaatgacatgaaccatgccttttttattaactttatcattatacagtgcagagtaaccataaaaagatataaagttcatagctcagattgtcgactttttttaattagtttaagttatgttttgccaattactacctgctaccagatacataaatttaacatgtggacagttgtttgttgctgttctatcatctaaaagatgagtgtattcatgccacagaaatattctgcttttcttatgtccaagttccatttatttcagtgtgaagaattattagcagagaattcttaaccagggatggttccaaagatgcttggcacaaaaatttagccattggtgaaagcaaataatttgatccaaagagtaactctggctgttaagtgacaaattgagatctcattctgctacatgaacaatggtaagatttactaggaatatgtcattgcagtttaattgtcgtggtgtataagttatccctttgtgttcttatctgagctatataaactaatagaaacattggcatttaattagaaatacctggaatcatttccaattgtgtatagcagttttgggctatcttgttgatagtttgtgcaattttttgacagggaaagccaacccatacttcggattttttccaagctgtaatgggatgttaaatgttcatttccattacatatcttttcctgtaatccagtgacatctattttatggtgaagtgttgccttgaggatgatgggatagaggaagaagaaattgctaaggagaagatattgttgttgctgccaagtgcccaagttacagaaactaatgttgatctggtcacagagaaaattcaagatgatgttttttttttttgcaagattcaacatatgtttgtactacactcactaatatgctgtggtgtatacacaagttgtacttataagagatttgtgaattaatatattgtgatttttttcttatagtacttatgagtttttcttgtccaaatggaacctatataagatcgtagtgtaaattattaattacaaattggcaagtaagtaatatgtatttggtaaatgtgaacagtatcttccagttgcatcctattgctcacttacaacagttatttatgtcgttaccaacgcttatgtatgtatggctatagatcgtagcaacgtatagaccttagcaacgccggcataggcaacacatagtcaatgtgttgctattggaccttacaacgcttatttagacctttagccacacatatattcgctgctagaggggggttcctcttgtagtgttccggcgaaaagaaaatctacagaagcacagattctcgcgtcgcctagcgactagcgagactgctaagctagagtggttggccttaatcaaatactgctactgtccaacttgcggttcggctcatgtgattggtcgtcgcgtgttcattcgcgcacgagttcaatacttgtattactgcactgatcagttctagatgcatacatggttggtatttggcatctctgaaaattggacttaggattggatttacgttagacttgtgagggcattgaattgaacatgtagagacagacgagaggaaggagtagttgcgttggcgcctaatccgtttgtcgacagaaggaaataagcagcaaatatatagaatgttcaaatgcaggttctaacgcttgggaaacttctgtgtttggtcaactcgtctttcttaatgggtgatggaaaatatcttaaccgtgtcagcaacacggcaacttctctagaatctagattcccatgcaaaaatgaactattttttctactctaaacaaatctgaagccctcgaccacataaacaggtctgaataatataaccttaaatctgatgaaatcgatctttgctcactgtaatctgctcactaacctgaatacagtgatgcacgcaaaggcaaaaaagtataaataaaaagccagaaaagtcagaagcatctgtcatcatggcctcatgggtgccaatggatgatgcagatctgggacagatgagacgacaattgggcaataatgcccaactccaactccatgtagagaaggaaatttcgaacggaggtcgctttctatatttctcttgtcctcttcttctccccttcgtcctcgctaccatcgccctattaatattcctcaaaatccaaatttgagacaacccgaattcagtcctcagcgagtcggaaacgcgccgaaagacgaactggaggcgcccccccaaatcttgagatcgcaggtaatgtccataggcgccgagcttcatgagtcctcctgcgagggatcttgtcttgaggtttcttgcatattggcctgtgcattttgagttttgatgtgcttgctgctgatccgaattccatctccgttgttgccgtaagattctgaatcgaattcatgcatttgtacggcagattttttttcccccgctagatccgtatggtgtggttatttgggcgatgatagtatgggtccaagaaacgcggttttccctgtgaattgaggatctccaatttgcttctttggcttcggtccatggcagttgtgttctccaatcccatggttcatgctagacgcttcctgcagacaggactagacattttcagttttggtaactgtgaagattatggcattgttttaccaagagaaactgctgcattgtgatatgtaaaaaattaccctttttttccttctcttttagtagaattattacggaacatgcttcgcttggcgtctgtatcgatctacgttctttattctaaaaggctgtgcttttttgtgagcattgtcatccttttttttttcctttcaactccttctgttcatttaatgaacaattccgttctttctggtgttgatactgccacgttttactgattttccattattttattaattcctacttgacaagattcttatcgaacaattattgtgaatcttttagtaagaatctcgtanaagcgcagtgtcgcattttcctttgaggatctgatttttcccatcaagcaatggtgggatagccagtagtaaaatttaagctttcaggctcagtccagatcagaaaattttctacttacatactatcgtttgtagaacatcggggaagttaatgccctggctcaaaaaaaaaaaaggaccattcgtggaaggggaaaaagggttccgtgaagcgcatagatcaataatgtctaatctcttttcactcataaaaatgttttgcaggatggatggacatacaaatggcactaatggttcctgctctaagccttgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcaggtacctaatctagtagtttgggaagatggaatgctgaaaagattcccttgagccatagtaggacttcatatcattctctcatattatctcatatttggatccacaatttttacaggtttttgatttatcagaagaggctcctgaaaaggtgcttcacagattgtattgcaactttgagaagctcaagtctaatggcgaccctattgcttttcaaattcagagcaacctaagactaattgtgagtagcctaactagaaaacataaagaatgatctttttgctttaggatatgtcctcttaactaatgatctttgaaataggttgctggtggtgatggcacagcaagttggctgcttggtgtagttagtgaccttaagctctctcacccacctcctattgcaactgtgcctctgggaactggaaacaaccttccattctcatttggatgggtatgtctatgactattgttttgttccaacacatatattctcttcagttgtgataatctcctccctttagataattcacgcttgttgtgaatttgtgatcatatacgagctgtttttgttgttgagctgtttgacaacataagaaggtttagcattaagaaacatgcatttttgaattaatagtgaaatagtgatcatacgcttgatacctaaattttatgtcttattgactgtgagctgtgaggggtgcatgatttttcattctaaagtagaagattactgaatctgagattttcttgttagtttgatctggattccttggccgtctttttacctagtctgcataatctgcagccatgatctctgaatcttccctggcatctagttttatacctctattaaatttaatttgactgcaggggaagaagaacccaaccactgaccaagaggcggtgaaatcatttcttggacaagttaaaaaagcaagagaaatgaatattgataggtaatatctcaagcacacaatgttatatttggttctgctttttctgtcatgcttgtgaaaagtacaagtcctgcccaataattcactgcgacagctctttcatatatgttgtgtaccagtcatttttagttttaaacatgagtaaaatgtaatcccttatatattctgcatatgaaagaaaacactcatttgaatgtacttttttaagttggcatatcatcatgaggatgcgagctccacaggaaggtccatgtgaacctattgctccgttagagctgcctcactcattgcatgcattccaccg

SEQ ID NO: 25517 - DNA, 57035 bp, Oryza sativa
tccaccggtgacaccccaatactccaccgccagctaaacctctgccgacacgtgggcatcactgcacccgcccccctgccgaccagtctccgcaagccgccaccggtcacgccttgtcacctcacgcagcgtcgtcctctacctccatcgaccgcgtcgcaacggcaacctcgccggcctaccaccagtaccgcgcctcctcgcgccacggccaccttgcccggtcaccaccactgtcggccgcaactcccgccactgatgtcgtcggccacctgccgacgccaccagccagctgccgacgtactgcaaccaccaaccgccgtcgggcacttgctgccgccgcccgggccgtgggctccgcgctgccatcgccgtgaggtccgcgccgccgtcccgcaagctccgaactgccgccgcgacagtcctcgctcgatctggccgccggggggccagatccgcctccggtcgccggaaccacctccggcgctgctggatccgccaccctgacaccaatccatcgccgttgccaggggatttagatttgtcctgaaaaccttccgttttgcccacgagacgggtagctatatagaatcggctccgctagccgatttagttatcaaaacccatcttagtctagtttttactagattgaggtggttggcgactctaggatcaccgcaaggcatttaggtgctgcgatcgtgcttggcaatttgtcacaaaaagttgccaacacaaggtaatacgtgtgtgtgtgtgtgagttctaaacccagccaagcacccaatcccagtcccgaactgtctagcgaggcacggtggtgacacgcttgacggtgggccagttaagcattgggctgctggtaaagataactagaacttacggcgcgcttcgcggcgccctagcgttcgctttgaaagaagaaaataactaaggagaatggtgggagcatattttagttgagctgatagtgtagggtttgtttcagaagacaggttgacaataaaatgcatattggagctataacaggcagagaaacattaatcaattgttcacatattcggtaagcattgaaagaatatagttggaaagactaagtgtcacaacatttacatcatttacaccgtttatattacatatagttcttctgaaggtcttcgttccaacataggctaatacaacttgaattctgaagtttgtgaccatcacataacctgaaatcttacatctatgtgacgataaaaaaaaaagtggttgaattctgcgagataaaatcagctaagtgtaaatccagaagccatgagaacttattatgcttcatagagcaattaacagcatatatatatagaaagaaactaaatgatcagccaagatacaggtgtagagaaagaaacatccctgctatttgcccggctaccatatagaagttcaattctttgatgaactataaaatgtcattgaaattggtaaaccacctgtgatttcttcctcctgtcaattaatttatagggaaagcctgacaataaacaaaataaaaggatgagataatctaattcgtgcaccaagttcttatgtcagttgatttgttattatgttggcaactatgtagcgatacccgcgctatatttacaaacatgcatttgtcatggaattcaaagaaaacttaaagctaactggcaattctcacatttccaaagattgattaaactcacttgtcaacgcacaacactaaagcattacttcatatcaaccaactccatgctctccttcttgctagaatagttcatatgaaatcacatataatttagctaggttactgtagacgtgtttgttaggactgtacttcatatcaataagttagatggagaaaggagtaagtttctttcaaccatcacacataaaacataatctcattttatgttgattcaattggataagcatacttcgccattatctaggtcacaaagatttgaatctgggaaacatacacctatatttatatagactgaatcgctaccctgatttagtttgcaggtggtgcgatggcagcatcattttttcactaaataagaacatgattagatagtattggagtaatcaccaacaaacagtggaaaatgaaactttgccaaacacagatccaacagtgatagaaaattagaataggagtttccatcatttgacaaaattatagaagggcacaaattttaattgctagctagataacctaacaaaatagcaaggaataaatggtagaatgattgaggacagaaaacctgaagagatcaaatagtgttgcttgggcaacgaagtgaattcgtcaacccaaaatccaatatctcctattctctgcacaaacagagttgcaaaatttcccttatgcagaacttagcacgccacaaccagtgtctaactctcaaagctgctcaaccaggctagcaccttgtgaggtgggttttcaagcacaacctagtactcaatgcagccatttattcatgagattgaatgaaatgaccagcataattccaaagcacttagcaagatagcagttcagtagtgtccaaaattcagggatgaaatgattcactaaatgaagtggcgattaatccaaagcaccttacagtccagtaaggtccaagaagtcctaataccagttctgaaagatagcttttagataatgagttctgaaacatagttgatcgctttaataatgcagatactgcaacttcaaatgttgtctatcataaaatggtcggtaccaaaaaataaattcagttgtgcacctcctgcggcacagccgtggtgcagtctttggtcgaattagaatgaattatcaggttagtcaaatcaattcaagaacatttattctagaaaggttcatccagaaaatgggcttagataagcggtaaaattttctattccaaaattgcgtcagaaaagttggaagattaacagacagatatatgagtagggaaaaccaaatcgaagagaaggaaaggtaaatacctgcacgactgcacaatggacaccatacgctcgcatccatcgatcactcttatcgatcatggcacgactgctcgggaagtggctccttcgcagccgctgtggcggtcatcccaagcctcctcgcattgcaggcagaacatgcatgacagcgtaggaatacaggggaaaaggagatctagcagcttaggctcaagaactgatggcttacatgggattcttcgtaatcagcattggagcttagcactgatggctcatgcccttccaatggaagcgtcggcggtccatgggtaccagagctcgacggtcgtaggcgtcgccgccgcaggtccatgaaccatctcccgcctccatcgccactccagctaggctatcaccaccaactacggcggcgcaatggtagagtcacctccccaggtagagagaaataggggaaaaagagaaaacaataagaacggaggcggcgactggttcgtgagtctaggaggcgtgggttctctctcctttgcttgactcggaagagggtgaaggggagaggggtgggcaggagatgggggacggcggggagaccgcgaggggaagccgtcggcggcgaggagaagtaggggaagggaagacgatgtggcgccgtcgctcaagggaggggagagagcgagagaacggtggggaacagtggcggctagggtttctgggaagggaggggataatagtggtttctttttcataaaacccccttactttctctttttcagagcgcgatcctatatttagaatttcgcctccttcacatagaatatatcaggatgtcgagggcctttacgtaagaatacacaacacacaacctctattaccaaataaatagaggatttttttgcaaaaacgccacttccagctccaggcgacgtggacatcacgggaagcgaacacgccagccaaaaaaccagaatcgaaaacgccacttccagcgccgggtgacatggacatcatgggaagcgaacacgccagccaaaaaaccgcagaatcgctgtggtgcgagcattctacggtcctctttaatctctccgatgctggtggttgcattgagcctgtgtttatatgttctggttttgtttatttatagtggtcatatgattgctgtgctatgcaggatgaatcaggttcgctgacttcgcatgacccatccatcaggtgtttattggagatcttgcatttggtgttgctcgctttgtatacatgcaagtgttacaatgtaggctttattgtaaaatagcattggtggcacctactgtattctgaaaggagaagaatagtcaggctttcagcattgatcacctccatacaaaagaatttcacatttgcgatcattagctatttagctgtgccattccagagcctgaatgatgcaaatgttagaatcagctggcaaaaacttggcaagtaacaacaggatttattattttgagcagttatttcgaaacccagcctgcaccttgtctgcaaattcttttgctcccattggcattttagaattagatcacttcgtacaaaatcttaaactattatgtaacacttgcacattgtgagtatcctaagaagatgagtctttgcacattgtgatgcatcgtagcagaggaatgcattttaccttcatcatcatgattccaactggtgctccgagttctccagccttagcgaataatgacctcccaacctcatttgtcatccataattttaaggcattttgtgttctgacttgtgaagtctaaatcatttacgataatcaacattcaagagcacatgaagtttatatagcacagctacccctacaaaccttttaacttgacggccataagctggggttgaaccggacagacgatacttttcctagtgagaaacaaaggaatcatacatcagaatgtaggttgaaccagtttttaggtttgggatagttccaaggtatgtacctatataattagatgttcaagctgtttaatgccgcttccatcatctgcaggattagcaagacagcagccaatgaatttggatgggcatttcttcaacacactacaacaaaaacaaaatcaacaaatatttgtttacttaaacaccgtgggaatgctggaaagttaggggtgccaccttagatgtcacttttgcaaaaaggcccctgcatttctgttaattacgcattggtccccgctgatatccaccataaaccgttggatctcgatatagggtagatctggccgtacacgtgtccaactgtgccgacccttccgcaaccgtgaaatcgttggatctggaacggacggtgtggatttcgccggcctgcaccaaaccctagccccgtcgccccccaccctcgcacgcgcactcgccctcctccctctgcgcgccgccacgctctcctcctcggctcctcccctcacatgcgctgtcgccgccgccgccttgctgtcctcctgccctcacgcgcctctcctcgccatcctcctccacttgcacgcatcgttgccatcgcagactcgccatcttcctccactcgcgcacgtcgtcgtcatcgcaatctcgccctcctccagccatcgtcgccgacccaccgctgcctctccctcccagtgaggtctagaggtcaggtccgccagatccgccgcgccgccgctcgcgtgttctctgtccgctggcgtttgacatgttggttttgcatcatcgatctgctgcagctgtgaaaggtcgacgccatcagtcaaggtgtcgctcccctccctcctgttctaattcctgtccttgcgccgaccagccgaccattagcacagaggccgcaatgtaagtccgttctacctcatcattgattatttcccatgcattcacttgaggttttataggatccaccatcttgccttggtcccattgagttactcatgggttaggatgtatagcagattaaggagaggattggcttccattgctgctgtttgcatccgctttcaggttaagccatccattaagttttatcctcgttgttatggctgcttgcaaggctgcaagattcagatgatgtcctcactgttaaggatggccgcagctctgcaatattcaaatggtaacattcttgctaaaattgccacaaatgatgagataaactgaaatccaattatttcctttaattttaattgcattcgctatggtgcaatgtggtaagaaatccatgcactatagcaatgaagcctgttggggtcatgtatgtatggtcttctcagttgtcgtatttaacgattgctgcttattcttgttataaccaaaacctcgagagatagatcatgatcaaatgatgacatcgccacccatcatcgtactaacgcaatgtatagttacgaatttatgggtaaaataatgataaatgggaatatgacagcacccctttgtgcaggatctttgagctatggatgctaaacgataaaggtggctcacattgaactacaactgctaaaggcttaaaggctaaaggtatggatcttttaaatagaaaatgcagaaggagccttcccctgctgttttcgagggaaaaaaaaaggctaaaggtgtgaatagaacataaaaaactgaaccaatcaaatgacaatttctggtctgttgactattcagtattgcatgaggtttctatttgtgaattagacatgttcataatcaaattgaactacaagaaaaaaaactgagataattttattaagtacacatttggtatgcctgaaatttctgatataatcaaatttaatcgtcattaataacaatttatttggttaaatttgacattactttgcattaatacaaatataaaatgatatacataactcaaaataagaaatcaaagaaatgtggggtaaaataagatatatctatatctatactaatataaaaaagagttgcccctctccaatcctaccggccaaatcatccggatcaatctctactgtccatctgccctctcatgtaatctcatccgtccagttattccaccgatttcgcccccatgtggacacggtgactccgccgggcaaaaccccgctgcgatgactccgccgcgcgtgtcctctctcgcttgtcgcgatcgatggaccagcgcaccgccgcaacgccggaccaacgccgaccaccaccgcacccgtgcccaccgacggaccagcgccgccgctgttacgcctctaccgccagaccaccgcacaccaatgcatccctcatccgcaggagccccgcccgggactgcccccgacggcgccgcggtggttccccctactgccggagccgctgcggcgctcaaccagcgccgacggaccaccatagcgccggagctccctcatcctcgcgacggaccagcgttgccgctgctgcgcctccaccgccggaccatcgcgcaccaccgcatcccccttccgccggagcggagccacgcacgggactacccccgacaacgccgcggttgttccccctactgccggagccgctgcggcgctcgactagcgacgccggaccagcgcaccgccggactagcaccgacggaccactgcagcgccaagccaccaccgcggtcccatgttccgctaattcccatctcgggggttttcgtgttcgcctcgccttgccctggctcacttcggggcggaggtggcgtcgctgtccccgatcgaattctgccgatgcgcccctggctttcaagatctaagtgcatgcgcgccctcgccgcatgccgcccggcgctccggcagtccgggtggccggacgcgatcggctccgaggtatgttgcccatgcgcgcgcttgctctcctttgcgatggttttggtttggccaccgtttgattgagaggagttctgggaggtacgcgttgtcgtaatttgggggttccgttgcttgcgatggggaatgctcaatgatctgcttgtgcagtttggtttggtggctgctgttctcatacgaacattatattctacatttagtatctgtttgtgccatcctcttatgatatgagcaggttgtgttgttggcattggagtgtttaggttgataatggtcctatttggaagacatatggattgctgctttattagctgataaaaatgttgttttaaatgatcttttgcgatttatgtgggttgagatgattctacaggtggttttgatcatacacagatttgcctaatattggaacttcatcgaagagtagttgggttttcctggctgaggagtattagttgattggtgaactaaaatgcagaaggaatcattcaggaataaatgttgcatcttatcattggaaactgttataaaaaatagtgtcttcaacaacttaatttgtcatagagagaaagattgtaggcaaattcaggttttccgtcatacctccatctcctcacgattcacgtgattagcgagttgccatggatgagccagcaagacgtgcatgcaatcatcagaaacggcatcgcaacagcacagcaccaagcacatgcctattcgccagaccagatctatcatcgcataaaaccaagcatataaccaacaacacgggataatgtaagctcactaaataaatgattaactgttcaatagatcctaaacccaaaatgaaacagggtaatcaccaaacatataagggtggatcccacaatgatgttatgatgcatcccctcgacgagcgacgccgcacaaataatctctgcctgcaaaagcaactaaagcacaacgctcctgcaggccatcctgagactaaatcaaatacaacaatttatgagcaataataattatcgatatttgatctgagcctttgaacaatgaacaaagacctttactttttcatcctacctaaatgcatattccaattctcatcctaattaaatttaccatttaacactatgggttaactaataaaaatacatgaatttttttctattttcccagtggctataagagccacgacaaaacaatatgaaattataaccaccagcaagagcccctgcgtcgctctcccccagaggcgactcgggtggcgaacctagccgccccctcctccccccgaccaccttcctcctccgcctcgccgccaccacaaggacagcggcggcggggcttcacgcctcttcctacgctggcggccaagggaacctccggtgggtggcgatggcgaccgccagatccgccccgccgtggccggatctggcggggtggcggctgacggcgggggtggagacggcgatggtaggggcgagggggtgtgggcgacggtggtcggaatggcgacgatggaggcggcggcggggatggcgacgacggtggggttggcaacggcgatggattggcgtcagggtggcggatccggcagcgccggaggtggttccggcgaccggaggcggatctggccccccggcggccagatcgagcgaggactgtcgcggcggcagttcggagcttgcgggacggcggcgcggacctcacggcgatggcagcgcggagcccacggcccgggcggcggcagcaagtgcccgacggcggttggtggttgcagtacgtcggcagctggctggtggcgtcggcaggtggccgacgacatcagtggcgggagttgcggccggcagtggtggtgaccgggcaaggtggccgtggcgcgaggaggcgcggtactggtggtaggccggcgaggttgccgttgcgacgcggtcgatggaggtagaggacgacgctgcgtgaggtgacaaggcgtgaccggtggcggcttgcggagactggtcggcaggggggcgggtgcagtgatgcccacgtgtcggcagaggtttagctggcggtggagtattggggtgtcaacggtggataggcaggcggtggatggcgggtgaaaacccagcccgacctcgctgggccggcaacggtggcgcgcgagcgtcattcccctcttgagggcgttgtcgtgccgtctcacctcctctagtggtgttgccgggcgaaagcccagtcgaggttcttctgacctcgacggtcggcggcggcggttctttcgttgcttctctccctagagacgttggcttggcagcacccttgtcgaaacctcccaatcaactgctacaagttcgttctagagtctcttcctcttgtatcagcgtcctagtttgtacaagttggccacgtcggggggcctaggggggagagcggttccatcttctctctcaccctctctccctgaatccctgagatgtggatagagcggggttttgtgtcggttgtatagattgttttgggcgatcccagttgtagctcctttgttggccttgcggtgggcggtcacgcttagcggtggccggtccggtgcaggccttctcctgggtgagtgcttggtgttgtcggtgtgtgggaggtggtataccttttcttttcatggttacggcctcccagggttgtatccttgtatttttttctgctctatcaatatgaacttcacactgtcttatgcgagtcgttaaaaaaaaaaccaccagcaaaatatgcaagctatattctttcaagatctttttaaaaaaccctgaacatcagtgtcctcacatgcaccatctcctgaatgacgtgggaaccctacagaactgcatttcctccaagaaccacctagactacggctgaatccttactacatttcctgaacatgaaactatctttatttaactgtacatggcaaactgaatcccctggaatgcaactgtctcaaggggaaaaaaagaacttttgaaaggtacgtacatttacatctgaaaaacttgttaggcatgggagcaaaaggatcataaaatggcataatttactccagaaagagccaaaactactaaggtcacttcacttcacaagcatcgaaggcccaagttgatttggagtaccatacaaaactactataaattcaagacctagccttaatcatcgtacatactcagcaacataaaaagctgtaatatataaagtaagaagaatataacaataaagcctatgccatggctaaaaacaaaatctaatctcagtgcctgacaagctgtaataaatatgcccatgatatagagaaatagcagccatagaagacgatatcattcataagggcacctataaaccatgacccacacaggaaatgcctctaaacatattaattaatcgtaggatgaagcgatagagggacctacagcagcacaacgaaaatccgttctgacatgatatttgtaaagaccagaaaaatcaattaaccaatgaaaatgactatttccctttgagaagcctaaataagttataagaaaccctgtacctctcatgccatccagtagctaataaaagaaccacgcatgtatacaaagcgagcaacaccaaatgcaagatctccaacaaacacctgatggatgggtcatgcgaagtcagcgaacctgattcatcctgcatagcacagcaatcatatgaccactataaataaacaaaaccagaacatataaacacaggttcaatgcaaccaccagcattatctttaccagcagccccatgcttaactggcccaccgtcaagcgtgacaccaccgtgcctcgctagacagttcgggactgggattgggtgcttggctgggtttagaactcacacacacacacacacacgcattaccttgtattggcaactttttgtgacaaattaccaagcacgatcgcagcacctaaatgccttgcggtgatcctagagtcgccaaccacctcaatctagcaaaaactagactaagatgggttttgataactaaatcggctagcggagccgattctatatagctacccgtctcgtgggcaaaacggaaggtattcaggacaaacctacaaagaggtgccgcactctcgcagcggcggcggacgatttacggcgcaaatcgacaaagatagacaaactaagagtaaactaaaagcaatatgaaaaacgattcgattgattgattgtagattgatctttacaatgaaccggccttactcccttatataggggttggtcttgccctctacaggctctcctccatgtccaattcgggatagaatccaaaggaaacccgaaacatgtcttcccgagcaaggaaacttcgagacccggcgaaacagacccggactcggactctgccggtcagactggctacataccgccggtcagaccagccacataccgcccggtctgactggccgacaaacggcggtcagaccagcccactctggaggaaaccggcagaacttcaaactttggcaatttttcctatttcgatcctaggtgccaaatttaggtgtaaacaccttgagcccttgagcggttgattgaagattggaaggcctaaagtacgggctcctcagcaagcatcggctcgcggtcactatttgacgaggcaatacagatcaatagggagtggggatggaaagagaatcgctagaaacaacggtgactggaggaagcataccggtgcatgaaacttcatcctcctcagcgccacccaatctgtcaccgccgagcccagtgccactaaatcaagcgaccaggagctcgccatcaaccgatccgatgaccgaaatctcattctcgtccaaatccggtcagcaaccagttgaagcgggcgaggtcgaggtcattaccatcgtcgctgtggtggtcgaggtcgtcgttgttgccaccgccgtggtcgaggtcatcgttgccaccagtcatcgccgccgccacaatagttgagatcattgccgccgcattcttcttcttccatgccggtggtcgcagccggggaaaaggagaggagcgctcgcctcctcactttctccgcgtccaccggcgaagcccgcgctcggcgagggcgaaggcgcgagagggaggtggagacggcaaggcgacagtggcagcaccggcggctgtcacatcctgatttttgtttcaggatttataaattatttaataaattattatttgaatttatatcaaatgatctttaatttacaagtgaagttaaatgtgggaaataaaatttcctaaatataaagcatggatggatttaatttttattaaattccccatgattaagtcaactctctgagattttctcggatttttcagagctcaattccttaaatgatacaaagaacagttcagtaattatttgatcaataatgatctaattatatttgttaagagtttttttttgtttaaaaatccttaaattataaattgttgtttaaaaggaataattagaaatgatcttaaaagcttaaaagagaagatctaattttaatttgttaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaatgtcttcttttggctttgggccgaaagtcggcccaaaacccctctctttctctctctccccggcccagtcagcccagtccgagccgccgctctcctctctctctctcgatgtcgctgacaggtgggccccacctgtcagggttgtcgtcaacctccagccgccgccgcccgaaaccctagccgagccgcgtccgagccgccgccgtctccttccaaatccggtcgattctttccttctccggtgaaatcttttgaggggaaatgatcttctcgatctcctcttccttttctcttttggaatcatcgtcttaatcgctttggaagttcatggattcgaggtcgaatcggatcggtttctttcctccgaaccccaagctttccatcccgccgccggtcgccgtgggcctttgccgccgccttccaacccctttaaaaggacccccggtgtctcctctacccgccgcctccctcgccttcgtctctcgccgtcggaagcgccctagcgccgtgtgacctaccgccgccgtcgtcgccgccgctccagccgtgcgccgccgccgttccggtcgtcgtcgtcgctcggggaggtcgccatcgtggtcgccaagtcgccgccgtccccgtccaccccttcgccgtcgccgaagaccgccagagcaccgtcgccgccgtcgacccgatcttcgccgccgcttcttcctcgtcgccggcgccgtccgttgcttttccgccgtggttttggtcaccggtgagttcgtcgcgtcgccttctacccgttggtgccttccgtttgcgtcgtcgtgccgtcgttcgccggcgagcatgcgccgcccgagctgccgagccgccaagccgccgccggtgctgacgtcatcgctgacgtcaccgctgacgtcatcgtcgtcgttcatccgtgagccgcggtggatccgttcgatctcggccgtccgttttggatatgatcgatctcggccgtccgttcccgtgaaccgttgccgtgcgcccggtacaccgcaaaccctagccgctgacgcaataattctcttttccttttcaaaaataattcattattgcgtcataattcaattaaaatccatataagtgttttaatccgatttaatctttaaaaattcataactaattcattgtaactcagtttaatgtggttcaagttgcaaaaattgtataaaataaagatctacatattaaaattgtccatgaattgaattaaatttatttaattctttttaaatgggctttaattagatttaatcttataaaattcataataaattcttttgaagtcagaatgaggccgttcaagtctcataattcatctaaaattatgatctacatgtttgtttactttttatgtattgtttatttggtttttattagtctttttcttcgttttgcgtgttagcttgtcgttttcgtcgttgcgaaggttcgcgagtgcgccggaagtattcaagaagattaattgaagaccgattattgcaaggcaagtcacacagatcctaaacacaatcctttgagcatgttgatcctatatttaaaattctctatttatttcaactatgcatttattttagaatgtcaccgggtggtgtgaacttattcctttgttatggccaatttgcattgattactttatttcttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcaggatggttgggcctgtacagcatgggtgtgctgttcagtgttgattaaaatttctgattaattactcttaactcttaaccaggagctcgccatcaaccgatccgatgaccgaaatctcattctcgtccaaatccggtcagcaaccagttgaagcgggtgaggtcgaggtcattaccatcgtcgctgtggtggtcgaggtcgtcgttgttgccaccgccgtggtcgaggtcatcgttgccaccagtcatcgccgccgccacaatggttgagatcattgccgccgcgttcttcttcttccatgccggtggtcgcagccggggaaaaggagaggagcgctcgcctcctcactttctccgcgtccgccggcgaaacccgcgctcggcgagggcgacggcgcaagagggaggtggagacggcaaggcgacagcggcagcaccggcggcggaggtgtaggcggcgacgcgaggggaaggcagaggcggtgcgaggtgacggggacgacgcgaggcggaggcggggcccgtcagcggcggcaggagagggacagggttggggggcgagtaggaggaggggagacgggcggcggtggctaacatgaaatattttttaaaaaaaattaaagacaaatagagttgtaccgtagtgtttagcatgggcatattactagtaggactgtagtgggtgaattatagggcagaagatagattggatctacatgtcatttgactgagggaggtcaagtgtaccttctcgttcggcgggacatttgacgccgtcgtaggccggcccataatttaccagtgtgggccaagctcattctaagagaggcccacggacagaagcagaaatgcgggaaccctaaaaggaaggggaagccggagcccccatcccaatctcgattcgccactcccatccccgccggccgccgctggcccctttccccttctccgaccggaccgcgctcctcaggtcagcagctgtgcatctgctgcaccttgatatcatgtttgatcgaaagccgattccttttatttcgtttaatctttgcatatatattgttttctcggtgatgtttgttaggttttcgtgatttcatctttgcatttgaaggtctgaacactctttgatagatccatcgcagggcagggcaggacgcgcaatccactgcggtcgcatctgtttgctggaggtactcttccttccttgctcgtatctgctagatttagggtcgctagttttttttgtctttgtcttttaactaaaaactaagattcccctttcttctctgtttctaatttaccccttgattttctccccctccctccctggcatggcagacccaaacttttaggcgtcgagactccatcccagtctgacttcctgctccgaccgcgcgcctcaaggttaatcgcttgtttacttgtgcttcgacttcatcctgtatgatcgaaagtcagtttccttttcttctgcttacatttgctatctgcgttattcattaggaagctttatctcggctcggctggctacatcttctgtttgctgctgctgcttattggaggtactcttccttccttcatcctaactcctgcaaacaatacaccctttcttgtactacctcttatctgcaactaatttcccattctctttttcatcctttgacggcccggtcgcttcagctggaacttgggagttgctgatcgactctgaagatgggcctgtcgcgtcgggctaagaatctcatcgtcgacgtccccttccaaggcgccaaatggctacgctgcgtcgatctggcaggccagctgttcggtaacaccgctacaccaccaccaccaacaacaatcgcacatggatcagagtcagcagctgtgcaagaagactacacctctcagacactggtgtccgactcctgtaatcccaagaagaaggcagcaggcttaaagatggagaggattcggcttcccagacccatcctcaagttccgacctgctctaaacgaggcatgtaggattgattgcttcccttttgtggatcacaagatgttctgggtggatcacttggggcgccctttcctctttgaagcagagacacggctgatggacatgttgccctgtctccacaagcccaagtcgatgcccttttctgtgtttgtacccaacgccgatgctgacaatgactatgaacaccaccgccctggcagcagtctttttgttatggagaggattcccaagccagaggtcaactcaagcacacagtggagcgatcagtttgaggcctttgtctactgcaagcacaagcggacatcgaccaacttctccaagacctggcagtggcaactcctcccgccgccgccgtacgttcgtgaacctaagtactggcacagctgcagccgcccagagatcagctcctacacatcgctcaccgtcaatggtgacccccacatttgcatctccatcgatggtgttggcacctactgcctgaacacggcaagccacacatggataaaagtcggtaattggaccctacccttccatggcagggttgagtatgtgcctgagttcaacctctggtttggcttcagctccgatgagtcaccgcactacttggctgcttctaacctctctgccatggactcccagccacagttagtgggtcgttgggaggagctttacctgccagaggatttgaaggaatgcaaaaaccctcaacttgtcaacctcggctctggcaggttctgcatcacaaggttcttccactctaggagtcacaacagtgactctcggggtgatgttgaccagaatgttgctgtctttaccggtgtggaggtgaagccatgtttccaggatgccaatggcggcagtgggaaagtggaactccaaatgatcccacacaaatcattatttcacaagtctaatcacactaccatcgatgctgtgttctgaacatttttgacgcactattttgaaaactccctgttttattgctataattttggttgttacttctgggtctgaaaaatatataattttggtcgttggcagtgtaggaggtaactcagcgtcttcgtctaatatgtagtgtagtgttgtatccgaagttatgtcgccttctcttgggcttatttggagagctactccttgtttacattaagcagcatcgtaaactgttaagcgatctattttttaagaaaactttatatttagaaatttctttaaataatcaaatagatctcattttcatctttttgtgtttgcaatagctaatacttaattaattatgtgctaatgctaatgatctttcttgttttggcgtctggcttatgaagttatgagcttactctaaacttcaattcaagctgagcttaaaattaactccttgatttgttcataactttgatatgatctatgttttggatccgtgcttgtcatttagcctggggatcagtcttaactgttgtcatgttctgttaccatttgtttggtacaatatcttcatcgaaaatgtattatggcctgtttagttcccacaaaaaaatttacacactgccacatcgaacgtttgaacacatacctaaagtattaaatataagctaaaaaattaactaattacacagattgcgactaatttacgagatgaatctttgactaattgcttcatgaattgacaatgtagtgttatagtaaatatgttaagtgacagattttgtaattagtttttggggcaattgtatccatgcccccacttttaaatccaattgttgttttacccatattttttttaggatttgcagttttacctctatgttttgaaattgaaccagccggctaccccagtcctaacagccagtttgatggtgttagttgtaaagtaaagggacacttatacccttggtggttattgcatttttgcccgcatttttacccctttttttttcagtttgtgtgattttgcctctattttcgcttgcctcgtcgcctgcctgggagcagccgccgcctggctaccatcggagcggcgcgtctgccagcccacccgccctcaccgccgcgtggaagcctcgtggtcgtcactgctgccgcgcacacgctctcgcggccgctgtcagcaaaccctcgccgcagccgcctgcacaccctagccgcggccacccgcacgccctcaccgcggccaccaccgccgcatgcccgcccttgccacggctgccgccgccgcgtgcacgcccttgccacggctgccgccagcagccgtccgcagtccctctgtaacagccctaaaattgacaactttttaaaattgatttagaaattgacaactttttaaaattgatttagcttgctttggttcactaaaaatataactgtcgagttagacatttatttaaaatattattttcccatgtttatttttgatgtttcttttctggtttaattttgttgcaaagtgcatcttacctttcaaataattcctttgaatccaaattaaattctatcccaaatgtcgggccatctaaattccacaccaattcaaatcctatttattttaatttccccaatattttctttttctctatttttaccttaattctctttttccatatatttttttctttcttttctattatttctttttttttcttttctctctctcttcttttccttcttcttctcttctcggctaggccgagcccagcttgtgctgcctcgcaccaaacccgtgccgccttgcgcccagctcgtgccagcccacgcatgccacacgctcgcatgcgcacgcacgaggccgatcgaccgacgaatgcccggacgacacctccagcttcccgcctccataactccttcgttcttccactagaaggctcaacaccggaggcaaaaggaccgcaatttcgacctctttcacctcctcaaatccgcccccaactcccgctgactcaatcgtcgtcaccggaggaaaaaatccccgaaaccctagtccggcgccattcacaggagctccaaaattcgtcgtatacgtcgctaatcctctgaaatttaaggtaaaaatggattcttcatgccaagtactccctttcccctctctttccccatccaatccgtccccagaacgtcgccggggccgcctcctgccgtcactgctctgttcggccgccgccggctgcacggcgcgccgtcgctccagaccgccctagcttctgccgtcgccaccctaggactcctctcgcctcagtgaacctcatcaggccaccgcccttcccggagttcgccggagtcgctgccgccatggccgcctccgcctcctgtttctgcccgccaccgccagcctcgccgccgaccacaaaaaggaatcgcctcgacccctagatcgcaaaaccggcgcctccccactcaaaaccggcctcctctgcaaccggcgtcatgggattacggccagttcctgtgcacataacgagaagaacaggaaatcctattttcctgttgaaaaataaatcagaaaaatcttttttcttattctatcaggttgaccatccgtttgacctcacaatcaaaatccgagacctattccaaactcctagaattattccaaatccatccatgtcagtttcgttgcaatccgagcacccgctgtcgcgaccctaattttagccctatggttcgccgtacaccgaaatttcaaaaatccctaaaattatttctttaaaatcctttccacccattgtttcactttgtgatactatttgttttggttatctttttttttatgttatttattgttgtgatgattgttgcgtaaatagaaaacgttggcgttggcccggtagtcggagcgagtgaaatgtccgcgccaggaggagacggtttgtacgactacatcgagcctgaaggttgcaagacatgcacccttctttgaacaaccagtagttagagagttattttggtagcgtacttgtcctttggagtacgatagactgcacgacttttttaaattaattatattgctattattgtattatatattctgttgctgttatggacaccttaaagagccttagattctaacaagcttaggataaaatttgagaaacacttaaagataggttatatgggctttttgggcttgcaatatggtagtattaatagtctaatatacatcatcggggctccgcaggtcacccgcgggtggatgtcctcccccgcccccgtccccgcccatggccggggccccgaccccgactccccgcgggtcgaaatcagtacccacccccacccccgtaggggcaggtccacggccccacgagggaaattgccatccctaagcatagccgatagggcaaacccagctagtatcggctagtattccataccaccttataccgagatatcagcatagatgaaatatataaaattgaaactaatctaacgagcaatgtgaactagcagattgataggaagcttaatatactttaaacggatgagatcttgatataaggggcagatttagatgatccagaaccaaataaggaaacaagacgactaaatcaagtaagatcggctaaaactccgatgctatctctgttagcaatcaaagaaagagctagataaaacgattaaagatagtacttaatagatcgaacctaaccgatgcagcattaagcgtgagaagaaacataagatctaatcaaatcgatgaaaactcattcaagatggtagatacaccgcatagtctagcttgatatcgaagcctaaacctgcctctcgatgatagaggctagccgatgaagtttagatgacgaaaccaatctagactatgcggtatatatgataactcggcggtttacatagacaggattagagtgtcatgaagatgcaagcactaatcccgagaacgcaaacctccataacaagctttacctcttcattggagatcgaacccgatgcagcccaactcgaaagcaataacttgtcgaaacaatgaaaataaaaaagggtgacgatgcgccaaagtattattgaaccgtcgtcccttgattacatggtgtgggtcatatttatattcgaagtacataatatgtccttgctggacatgactcttatctctaacgaaatttaaaatacgaatgagtcccttcaggtggactcttaccaacatatctctaaggaaactgaaaattgtcctaattaatagatacaattgctccgttttaggactccaatcattgcgtggcaatggctatgaagtgcttcgaccaatcccaatgatggacatgggaccatctttcccgagattggttgcatcggcttgactccgtcagatctagcgcttagccgatatgtggcagccgataccgcctatagccgattcatgtggtagccgatgctacttgtaactgatgcgtattctgctttctcgaacggaatttctccaaatcggcttcgactctaactttgaatccggcccatggcattaccaaatttggtcgttaacaaccgcttgtgagcgggtggtacacatgatggagttcatgtgtttggttttatggacctgtttatggtcgtaatggatatatggatatatttatggttatttcttatttaaaattgatataataatcaaccctcttgtgccaataagaatgacatagtttcgcccatccacacgatcgatttgtcgaacctggccgtatattgctccaattgattgaacttatgcaggcctttcgatgtattggccattagctttcaagtgtgtgaagcaaagtgacatggtttatgtttatgtgatttatatatgtgggctcgatgggcccgagagttcagaactgccctatgggcccatcaagttctgggctacccatcgagtaacgaacaatggtaagtggatgcggaggtaggttggtacacacctcggaccggatcactccgagcaatgacccgagcatcctttaacttactaggcagaagggagagatatggagcaatattacgccttgttacttttcagcccggctagctgtgagtatcgtgtgggtaaagctaggcagacgctgcagagtcgtagagtattcgaatacgccgtgctcccaattaatggtgatgtgtctatggatgattccagattatgggcacaagttaaactaaatggttattaattaatatggttaatttatttattgcttgatgttttattcaagttatttataagtgacatttatattaattttatgctcgttattatcgtttaaattaaatattcaatagtgttgtttatatcaaatgtttattaagataggctctatgaaataaatgttaaggttagagtttaaaccttccggctcttaataatgcatgttttatattgcaattattgtatttgctatcataggcatgtcttgctgagtacctgttgtactcataaatgggttcagatcatgaggaggaagatgattgtggagatcctgttgacccgttagagtgggacaattatggtttctaggtcattctatgcccaagcaattcctgtggtggagtctagcagttaataaggctttataggtcatttatgtaatggtttgtatttatgttgtgttgtgaactaagtgacttaagtaatgtataaccgaagcttatgcttttatatcatttcatgcgtaactgaacatcttggacagttacgtattcgtgggggcaccatgactttatcgggtgtccccacaccctcaccgcggtcgccgcgtgcccaccctcgctaccgtcgccagcacgctctcgctgattccaattcacactagcacgggttgggaggtgaggaccagaccctatccattcactcagggatactaaggtaaattcatatttcctaaaaccttttttttattttcttttgtatttctttaacacaaaatgcaggacccaccaaacggctgttagaagtagaggtagacgctgcttcaattttaaaaagtggggtaaaactgcaaaccctaaaaagtgggactaaaacaacaattgggtttgaaagcgggggcatagatgcaattgacccttagtttttttattagtatccgaacaccccatgcgatacctatataatacccgatatgacacgccaaaacttcacacccttagatctaaacaccctctatatgtaaccaatgagatttcccacctgattagaagattttggaggaagatttaaagaacacgaattaggtcccgaacatgaaacttgtcccctagctaaatctcgaagagggagcactcactttcctgctagattttggttagttgcatgattttgttttttctaagggggaccacaaggtttcactattggttagttgcatgatatttttccaatccattggtcaatattttggacgcttcaggggggtctcaacattcatatagcactgtttggaatagacgaaaacctaacttgtgtctttctatgtttagataccggggtgtaaagttttggcgtgtcacatcgaatatacgaataagcatttaaagtattaaacgtagtctaataataaaacaaattacataatccacttgtaaacgccgagatgaatttatcgtagcaccatattgtcaaatcatggtgcaattaggcttaaaagattcgtctcgcaatttacacgtaatctgtgtaattagttatttcttcatacatgtgttcaaacatttgagttattttttcatctatgatgtggtagggtgtaaaattttatcatgggatctaaacagggcctaaatccagaagtatgtgatttgtgggatttgaacgcaatacgtttctctccacacatgtattacattaccatcttagtatgaagcacttaatgtcaatatttaaaatgctatcgttttgatttccattgtcgaaacttaaaatacttatttgcctctctaagacgtgttgggcaccccttattcccaacccttctccctcgttttccacgcgcacgcttttcaaactgctaaatggtgtttttttttaaagtttgtatacgaaagttgtttaaaaaatcaaattaatctatttttttaaaaaaatagctaatacttaattaatcacgtgctaatggatcgcttcgtttttcgtgcgcactattcatgttggggactaggcgtggcgaacacagcctaaatgattttaaataaaaaaaatcatgaattacaaagttgtagatctagctctacaactttgacacatatcatgtgtccatcggaggttatttgaatcgtatatatgaaattctgtgaaatagatcttaaatcttataacaaatattttaaaccctaaatgatctcaaatagaaaattattcagcttaaaaagttttagttctcattgagatatactccctctgtaaaaaaaacaatcatagacatggatgggacattacataggacaacaaatctctggagatgctcagattcattgttctatgtaatgtcccatctatgtataggttgacatttttttttggacggagttagtacaagtttggtataaatttaattagcagactttttatgaaaaagttaggtacaaatacatatttttctaaaatcgatcctcactgtttatatcgtccgtcagtaaagataatgtgttctctcatagatgtcttaagcgcgcttatatcttctgcaagtaaaaataaatgtgatttttactcacggtattatttttagtccatttgaaaaaataaaagaaaagtgtgaaaaattgtgttttttagtgtcggctcactgggaatggtaaacgagttgagcttaggccctgttcttctcatattatcacctcattatttgctctacccttgaaaacaatgttttgcttataccgcttgttttaagctagtattatttaaatctgttttatgaaaatatttaatttatctcaatagttaaatagataatccttcgcaataacccgttgaataatctgaatctaacatggcctaaaaattattgctcgttaggcataacaagccgaaggaaagagtacaccgaaggtccctcgacttgtcattgaattacaaaatcatccttaaaccacaaaacggatacaacgcgtccctcaacttgcaaaaccagtgtagactaggtccctcggcggttttgactccggttttgtccgatgtggcagctgactcagcgtgggtcccacatgtcagcctcttcttccccttctctctctccacctctcttcctctctcatccctaaaccggcgggggaggagtggggagcgaccagcgagggcggagatgggcgcggccggcagccgcctggggaggaactggacgcggcggttgtcgtcgtcgtcggatctggggaggtggatggtgggaggtcccttatcttgccgtcgtcgacagaggaggaggcagtgcggtaggccgaccacgacgtcggtgtcatcgtcgttgatccgctctagctgccggggccgatagatgggagaggagacgacagcggcggaggcggaggcggaggcggatggggaaacggggctcgacgagggagagggcgcaggcataggcgaggagcgcatcccgcctccgctcgagggaggaggggttcgggagcgatggctgctcgacgtcggtgcgcaggtcgtacaccaccgtgaggtcgtcatcggccgcggctgcctcctgctccgagtaggcggaggtgatgtagaggcggagcggacggcctcgtcgcccgtcgccgccgccgcctcatcgcccgttgtcacggtggccgccttgtcgcccgtcacccgtcgcctcgtctcccatcgccactgccggactcccgcttgccgaactgagcagcaaagagagagaaagaaaagaagagggagaaagagaggggaggggaagaaggggctaacatgtgggacccacctgggtcccacgctgagtcagctgccacgtcggacaaaactggagtcaaaaccaccgagggacctagtctacactggttttgtaagttgggggatgtgttgtatccggttttgctgtttaaggacgattttgtaattcgatgacaagttgagggaccttcggtgtactttttcccaagccgaatgatccagggaaactaggaattttttttatttatacatttttttattaacatatttacaaaaataattttttgtttcgaaaatttacaaatctaattgcctgccgcccttaagaagggcgatttttaaaaatcgccctctcaaagggcggcaagggacctaaatacaaaatttttatttgtgttcaaacccttcccaccggttttaattgcttaaaaactaataatgcttattcgatactccaaatgattttaaatggaaaagtgataaactacaaagttatagatctcatcaagatctacaactttatataaagtttatctccatccaatgtcgtttgaaatgtagatctgagattttttaaaatgtgttttatattttgtaacgaatatttggatatctaaaacatcttaaatgaaaaagttattaactacaaagttgtagatctccttgagctctacaattttgatataaagttttatttcatctgactttatataatataattttaaattgtaaaattatagagctaacaagttatgctggaaaatttacatttaggtcccttgccgccctgtggaagggcgatttttaaaaatcgccctcccaaagggcggcaggcgattagatttgtaaattttcgaaacaacaaattatttttgtaaatattttaataaaaaaagtataaataaaaaaaattcgggaaactagcagcccagcagtccacgactacagcccaacatggcccaactgcttccacttctccccaagaccccaacgccattccattccattcgcatcccacggcacattgccgccacacactcttcttccacctcgcatatacgatagcagactataaatcagctataagctgatattaataagataagagagaaaaaaacagactacagacttatagccagctataacacggactctaaaacgttatgtgtatgagaaatgagaccatatgttaatatgttaatgatgtagtaccaatttagtaactactatataaatgggctattagattgactacatatgatttagagctagtagtttgctacactattaaatttgctctaaataatcgctagtcgtagtggttagatcgttgcacgccaacactcgtcaactcacccctcctcctgttgcgtgtgccatgccaacaccgcctaccgactatggcacacgtatgtgccatagtctacgcgtgtcagtctatcgtccacctttcaaatcgaaagcattggtgaaacctgatcgactcatgaacacacttatctacattataaatgagtccgtgggtcgatccacctgcacccttagcacgggggattgagctactctaccccgttgagctcaaggtccacgacttgctctcttcctatgagtaggtgaccggccaattgtttatcgtgcaaggcacaaccccctctcttccccacaccgctcgtctttgctcgccgcaccactcgtcgttgatcacgagctaaacaagccgaatgaagcaagcaaacaagttgaggtgtgccgtattttttagcttgttaggatgaagatgtgaggtagaataagccagactaagccgatatccctatacactattaataattgtccctcatatcgattctcacttccatcactttgtctcataattattttttttctaatacaatgaatattcaaatgtcatattagagttaaaaacatcgtatatttaaaaatgggggtaacactgtaagaaaatctcacattttcacaagtaagaacaaatatatttgaaacaaaaacaaaagtgcgtggaattatcgaaagccattacttattttaatttccaaatttaataagataaatatggccgtgatcgtcagtgttggctattgcaaccgttcatagttgcgcactccctccttccataaaaaaccaatctacggatgtgacacatcctaatactatgaatttgaatatatataggagttattaaaattcttattactaagatgtgtcacatcatagatttgtttttttatagaggaagtaagcttgtatttattttgaaatgctcattgctggaacaaggtttgttgagcatgtcctagttttggatatctgaactattggtaaactgatgagtatctgctaaagtggagtacttaaaaaacaaaatcacacattttaaaaaaataactggaaatattaatcgaaatgatgcaaagttttgaacttaacattaaatggactgttggcgagaatcttgcctagggttcttccggttaaccgacctgggttcgaaactttattccttttatttaaaaaaaaaatctacttaacggcgtcccgtagcggtgcggtagtcacgggacaaatttaatactccctctgtttcgttttatttgacgctgttgactttttagcatatgtttgaccgttcgtcttattcaaaaaaatttgtgaaatatgtaaaactatatgtatacataaaagtatatttaacaatgaatcaaatgatatgaaaaaaattaataaatatttaaattttttaaataaaacgagcggtcaaacatatgttaaaaagtcaacggtgtcaaataaaacgaaacggagggagtatgtccgaaacgttacgccactttccctttcctccacttatctgtcctcaacctttttcccctctactcacagctcgccagcgtccctccactcacagcttgccggcgtgcgccgccgctcccctcgcttcctccaccttcgcacgccggcgctgctgcgccgccgctcccctccattcctccgcctccccatgccggcgctgctgcgccgtcgctcccctccctccctccgcctcccccatgacgacggtgccgcaccgctgctcccatcccttcctccgattctgtccacaggtaccacttagcagcaaccccctctcatgcagcagactcaaaccataggtatgtgattcatcttaatttctaagtttcatttcctatgtcttctcgcatcccaacttttcaacttggctaattcagcttctatctacatttctgttctagggtctacatcaaagttcagtagattttctgattttttatagacgaggccaagggaagccgtgatgggggtggcaagaaaattatatcccgtgatggggtagtcgtatttgatacttgacctgttaaaattaacaggttggttactcctctcatgaaactttttgtttgtggttggaatctattttgtgacatcgagtagtctatatgaaacagacgagttacttgtttttgtgttattcatgcgtagatgagattgtacactgttaacacacatacatcgtgtttccagcaatttttactaggagtaatatctacttttatttttactaggtatcagctagattacagaaggacaataggttctgatggaattgtcgaaatctgccaccaatgtgttttgatttttctggttgatacaggggagggagatgagatgcataaactgcatcttgtcactgtttactagtactggttcaccaaaatttatctgacacaccaatatttttcccagtttacatggcactggggatactagtgtagtataaacatatattttgcacacaacatatacaactctgaagcattgcacaagaggaagctgttaaaatgaagcgataattgtacattatataactttatgtatcgataaatatatattttctggttgataccatgggaggagtggcatctactgattttttttaactaattttgtaacatgtatcactataatctgacattacagtaacaatgattgaaagcggactaattgtcatgttttcctttttttgtttttcgcacacagagtcgatatggctacatgttcagataattcagattctgtacattttgtgcctagtggtccaaggcgctcaccaagggtcaagaaatccaaccaatgtaatgctgaagagcaaaggaggaaatgtgcctcgaaaccttgtaccaagcttaaattcctaccagataaatcaaatgccatttgtggcaacaagaaaaggaagaagatggaaactgaaacgaaggtatcatatttttcaactgtcttctttctatttaagctttttttttactattcctattttcatctaatagtttgctgacaatactaaagaaaattaaattaggtttcagtgcacaatcagaagcaggtcattaccttcagctgctactcgagccgcatgtgcaaaatagcatctcaactttcacctgttcagactcagtttgtgcataatgcttgttttgagaatttactgtcaatgcaagtttgtagtatgtccaaaagcatgacaccgtggcttgtcaatacaatgagaaccaggccaactatgtagtggtaccatcattttttttgtttttaaccatgtgaatatgtgaacaaatgtcaccatgtaatggctactgccatgtcaccatgtgaaatacatcccagcttacctttcgtttgcagcactcaactttttttatgcatgtttgtgtggtacatttttttaaaaaaaatataccacgttttaaaccatgaaatcgaaatgtctataagtatccaggggctggtaccctaaagtgattttttcctcgcatttgaaaggtatcaagggaaaaccaaggtatcaggtctgaacccaactaccaaacatggtacctcacaacataggggtatcagccacacaaatataggtaccagggtctgaatataggtaccagggtctggtgcctggtagcaatccaggtaccaggtctggtacctggtagtacctggcactaggtaccaaaattggtaccggtatcaattctaaagccaggtaccagacatggtacctcacagtatagaggtatccgcctcacaaatataggtactaggtctggtacctcccagaaaacccaggtaccaggtcttaacccagacaccagaccttatacattacaatacattgtcgctataggtttcatgactggcaccacacagtacaggtattagcctcacagtacatctcacatcaaggtaccatgaccacctcaaaagtataagtatcaaacaaaattcaggtatcaggtacattttttctcggcaagtgcaaccacatttgacattttctgaccatacatcacaactgttcggaagctttcaatttagtatcaagcaacatggttcaccaatcagccaaaaagaggaattattacatgaacaagtctcatttagcaaatgtaaaaaaaaaatgaaatgttgtatttttccctcagtgctatctttctcccacaccccttagtgctatatttcttccacacccctgcaaaatgaatgatgaatcaatgaatttacccctcctcatgccgagctgaaacaaatgagaaaaaaaattataagagaccatcttttcacctcatatcaataggtctgggcgcttggtgacattgctttttttttctagcttgtgcgcttggagtagcaagcaatctcatatatgttgtactccttggtgacattggttttttgcataacgattgtagtaatcttgagcctatttttctgaaaagaactccgtaccaacatcagggactgcaggttgagattggaccccctcatcttcagtttctccatcttcatgtccaaactcatcttgtatttcaaactcatcacctgcatcaatttgatcaatgctcatggcacctgtaaacaacccagtttcaagcagtgcttccctcaacacatcatcatcatgacttgatacttgttccattgctctttcaacacaaacatcatccttgtcactatgttgctctttcatacttctttcactaaggacaacattcccctcatttgctacctcttccatcattcttccagcagatccaaccgaggaattcattctcttttctttcagccataaaaaactttttaactaaaattgcatgaataatccacacatttttctagttagtttttcaccccacacataacaagcagaacacaaaccattataccttgaaaaatagagataagctgatacctaactagagaaaaaaaatgatacctaaaaactagagaagctgataccctaaaaactacttgaatagatacctgagtgaggtacgcaaaaggaaatccggcgatggaggtcggcacctgagatggatttttgctgaggactactgcgactaggtgcacgcgctgttgccagcaaggtatcgcgcgcggaggcactggatttaggggaaggagcactcctgcttgttgtagttgaaggcgccgccggcgatgtatcgcgtgcagaggcgcgcgataccgagccgggttttggttgcgggaaggatccttctcgcgctctgcgccgggttctggctggtagttgctgcggcgctccgcgcccccgccgacgaggtatctacgcggaggcggcgagtaggggaatcgcgtgcacaacgttgggctcgatcagaaaaggaatcggtattaaatctgttgggtgctaattttatcccgtgactatcgtgcagtaacggaattccgtggggtagctgccctcttttatttaggctgtgtttagatccaagggtgtaaagttttggcgtgtcacatcggatatacggacacacatttaaagtattaaacgtagactaataaaaaaactaattacagaatccgacagtaaaccgcgagacgaatttattaagactaattaatctatcattagcaaatgtttattgtaccactacattgtcaaattatggagcaaaaaggctcaaaaaatttgtctcgcaaattagttgcaatctgtgcaattagttattttttaacccatatttaatacttcatatatgtgcttaaacgttcgatgtgacaataaaaaattttgggtgggatttaaacaggcccaacgttaaatgggccgttggttgtaaaagattggaaatagagagcggcgtccaatgcagtgactagccgttagggggaccagtctggcaacacgcaggccgtcccgttccgtttcgtttcccctgcccgagagagagagagagagagagatttcaaaattcgaattccctctgctcggctcgtccaaaaaaagcagacggcgtcagtgtggtcgtcggtcgcccccaccctctatataaagcgtcccaccccaactgccccaaccctaacactccactaacgcctcccgacgccgccgccgcctcctcctcttgtttcgccaccgccgccgccgcctacgaggaagaagaaagaagaggaaggagaagatgagggagatcctccacatccagggtgggcaatgcgggaaccagatcggcgccaagttctgggaggtggtgtgcgcggagcacgggatcgacgccaccgggcgctacgacggcgactccgacctgcagctggagcgcgtcaacgtgtactacaatgaggcctcctgcgggcgcttcgtcccgcgcgccgtgctcatggacctggagccgggcaccatggactccgtccgctccggcccctacggccacatcttccgcccggacaacttcgtcttcggccagtccggcgccggcaacaactgggccaagggacactacaccgagggcgccgagctcatcgacgccgtcctcgacgtcgtacgaaaggaggccgagaactgcgactgcctccaaggtaactagtaccctaactatctcagatctgcctctcctcaaatcaaatctgagttcaaatgctgctgctgctgcagggttccaggtttgccactcgcttggcggcggcacggggtccggcatgggcacgctcctcatctccaagatccgggaggagtaccccgaccggatgatgctcaccttctccgtcttcccctcgcccaaggtctccgacaccgtggtggagccctacaacgccaccctctccgtccaccagctcgtcgagaacgccgacgagtgcatggtgctcgacaacgaggccctctacgacatctgcttccgcaccctcaagctcaccaccccaagcttcggcgacctcaaccacctcatctccgccaccatgagcggcgtcacctgctgcctccgcttccccggccagctcaactccgacctccgcaagctcgccgtcaacctcatccccttccctcgcctccacttcttcatggtcggcttcgccccgctcacctcccgcggctcgcagcagtaccgcgccctcaccgtcccggagctcacccagcagatgtgggacgccaagaacatgatgtgcgccgccgacccccgccacggccgctacctcaccgcctccgccatgttccgcggcaagatgtccaccaaggaggtggacgagcagatgctcaacgtccagaacaagaactcctcctacttcgtcgagtggatccccaacaatgtcaagtccaccgtctgcgacatcccccccaccggcctcaagatggcctccaccttcatcggcaactccacctccatccaggagatgttccgccgcgtcagcgagcagttcaccgccatgttccgcaggaaggccttcttgcactggtacacgggcgagggcatggacgagatggagttcaccgaggctgagagcaacatgaacgacctcgtctccgagtaccagcagtaccaggacgccaccgccgacgacgagggtgaatacgaggatgaggaagaagaggctgatctccaggactaattactactctactgcaatatcaatgtccaatctaatggggttcggttcacttcttgtgttgcttaggctatcttctcaagtgttgtcgttcttaattattactcctagctgctactctactctacttgatgtattattattactcagctttgattgatgataggcacaataccctgttgccttgtactcgtaggagtatgtgctgttactgtctaactgatctgtatgaattatcatcctatttttgttaatctatcttctagtaaaatgcagagttgctgcttagagtactctacttggtgtcaactcaacttgtgtttgtttcattccagtgttgcagaatggctgttcatcagtggagagtgctttgtatgtttctttgatactcacacttctctgccactgaccactgggattgtacaggtgagagaactggcatcagggttgtttaacttgttggtatatgctgcttgttacagtacttgttgcaagtgcaaatgctgcattgaggttgaggtcgcctgttccttgtgtccaagactgcgtgtgtgcaagttagatgatgattccagtctgtgtgatcgatcatacagccacttgatcactagtattgtttacttctagtcaaagtaatttggattggctggatggtctgatcggatcttctattcctctgcaagttgaaacagttgatgatgaaaaaatgtttacacaagaggaggacaagccatgcttgcattgcacaccctgggatgcatatgccttgctcaagatctactactactatactacttttcctttttgtgaagtgaagggcaggcatgagggccagcattgcattagcattactgtcacagcttgccttgccggatcatattcatatgactgcatgtgcagcacagtcgatatgcaagttgcccttgcatttcttgggcctgtggatcaatatattcttgctcctgctcctgcagctgcacagttaaaccgtccatcaagctccagcttggagtcgcacaatacaagctgtcatatatgtttgtttgactggtcttatctcaagggattgagatccagtgcggttgctactatcactgcaactttagcagttgcaaggtagctgatggatcaaaaaccagcggctcagatcatcagaaaatactgttcacgaatcactgtagcaattttctactgtagcgtatactgtacagagggtggcagagcaaatccaagctgttggctgcatcgatccaacggtcataatatgctatcactgctaaagttgcagtagttattacaactgcattagatctcaattctatctggagattctaaagtgacacttgattaccttgttcttctttacggtgagccatgtgctcagcacgatcacttgtacagtagtagttgtgatacctagtcctagtttatgctgcatatttttttgagttgcatactttactagtgttttccttaggttatccaatgcgcctctggttactgtcttcaaggatcatccaggttatcaagattcttcattggtaaatgccattttagttttcctctctgcccacccgcctattaaaacattcatccgaatatgacgcgatttagagctctggaaaatgtgttctcactgatataaccaggtttgaagtcctgctttatggaaacaactagggccgagtttagttctaaaatttttcttcaaacttttaacttttccatcacatcaaaactttcctacatacacaaactttcaacttttccgccatatcgttccaattttaaccaatctttcaattttggcgtgaactaaacacaccctaggttgagtagttgtacgtgagtcacacaattgggtcatatgcaatgtaattttcttgttcgagaggtcccataaatagggaagaagagtactctgctcacctgaaaacctgcctgtcttatggtgatacaccatcagcattcaaccatatttacatgttcggatagtcggatacccacatccatccatcagttggccaaggccaagccaaatcccacacttctgcttcggcttgtatgtactactagtagcttaacttcacctttgcaatcctccactgcttttcacctttccttcctgtgcagttcaatcggcgcaagcgagcatgtttcagttcacaagacaggatagagagttgagaactgttttgatctggctttctagacggttttgcctgccacaagctatacactggcattcactgaaactgcaagatagtattagtatctcttaaccccacaaactagcctgattcttcaatcaatgggctgctcaaagtcgacagcgccggtcactggagcggcccatctatttcctatcaactttgccgttgcctgcgtacatcccgttggatatgtattggccaggttcatcccattttctgaaaaaaaaaagggatcaactttgccgcaatggcatgtgtgtccagaaggtagaaaccagccatatgaagtactacttgcgagcaaacacctggctgcatttgcaacccattatatttctgcgtggagtacaaaaattgcatctctccctgctgattggtagtacaaaattgaacaggctcgaaaataacaacgaatatctcttgttagttgtaactcccatcttacaccatgtaacttcaaaggcacgatgccaccttttgaagcatggatagcatcatgaggttagcaatacatatttacacatgagacatttgcaaaatgtaaaccacatatagaaagccgagcaaattccttctgagatcagtttactgtaaccagctgtaccttgccaatcttattgtgatattttcaagttcccaccaaacctgccagccacatcatgtaaggtcaagattcagctcaagagcacacaccctttggcttcactcaaaattaccagttcatcagagcaccattagcactgaagctatatgcccgccgcccacatgaatttcaacaatgaaaatccaagagtacaatgttccatctataaagaactgcttttcaactaagccacaaagtcacgactacttgatggttcacgaaatctgagctatctgatgcattttctctaaaaatatgtcaaacatctcttccattgagttaaattacctacaaggatgctaagttaagcatcccgagtgagggcttgacatcaacctcacttgattcatgtcgatccaatgatgctaagttaagcatcccgagtgagggcttaacatcaacctcacttgattcatgttgatccactgcagtgtaagatacatatcctggattgacatgctcactagacagagtgctgccattcctgatggtagactgggaattagggtaaggtgcaatgatcttaggtgtcctgtttggccagtatacatcgctgtaaaagcttgcaacaactacctggaagagtataaaaatgtatgtgaattgtggcctgttgttaccatgatatgtggtactaaaaactgattgagcatatccctgtctcaaaaatttgaagatacctggacaggtgttgcagctttgagaggtccagtgataacaccaccaatcacagaactatcgccagaagcaagggttacacgcaagcatccttggtcatttggtgtcaaaatggatccgaacaaacgaattatttccaaaggaccctgcaaaaattgaatgagagttttggtatcaactttgtcacagtaacttagctaaataagcaacaacgttattcgtttgattggttacagattatttaattttaagtttgatgttgtacttatgtaactctgtaactttatctgtttgcttttataaaagtaactgacctggcagtaagtttaataatacaaaaagctcaatttgaggaaaaacatccttctacatttgcggttttttattttagtttggaacacatgccagcaattccacccctgcacatggatgggatcaaattcaaggccgccatctcaaacactggcactcctacattccaccctttgagttaatccaggccaagaactggaatgccccctcaccgcttcgataattatttaaaaatcacttgaacatacacttgacatttatatatttggaatactatgttatctaaatggggggagggggagtgttaaactttgagcagtgtttccctccccatatgccatatggaaataaaagctgaaccttgtgatatgaagtaacaccggatgataggagcagagttgcttcctgaacagctccaagcactgaaagaacacagatcaccctcccatttgactttgacagtgccgtaatcttcggtatgatttcctgcatggtcatttcagaagaataaaatcgcttgccacattttgattagagaaaacatagtaagtagccatacatcatctgcaccaaaagaagcattatgcatacaccactctgccttttttatgatcagttctgcagttgcatatttgagaaaactataaacaaaaaaaaaatctcttcttggagcggcatgaaaaatgttgtgaaagtttgcatatggatcttttagcaaagaatgtggtgggcagaaacactaaaagaagttttctattttctgcttcagtgaattttctacagatatgggtcgatttggtggtggacaaaatccacacttttttgcaggatatgtagagctattcccaatctgttgaaaccatgtttttgtgacatccctatcgaattgcagttaaggtttgaaacaccggttttcactgaaattatcaatcatatctaaatacgaaatcaaatgtaatttagaaggcagtcaccgggtgtatttgtagtacgttgatcctaatcctagtcggtgatccttaattcctaagctgtgggtcgttgagcgagcaaaaagagggggccaaccatgaacagcagcggtagcagaggcacatcacaatctatatagcagagagagagaaatagatacctctcctgcatcaatttggagaaggtggggctggaggccaccgaattgcccctgccctgtccacaccacacaagaagcaaaaaaatcagcacatgcacaagtgaagagttagagttggaaagtacgggattgagcaccgtgaggcgcaggcagcgtggggggttgaggttgcggtggcggtggcggcggcagcggggcgaagaagcccggcggcgcagtgaggcggtcgcagttgcggggacgaccccggcgtcgcttctcgggtggtggtaggaggggcggtaggagcgagggaggaaccggcggggaggggaggcggaggcggatcggagagctgcggcggcggggcgaggcgggttttcatggccaacacaaagggcgacgggccccgcaggttgcggtaggcggtcgactcgtccattgccttcgcccttcgcccccccggtcggtcggaaccctagctcactgcggcggcggcggcggcgatggtgaggtgaaaaatgaaatgaaatgtggcagcagatgggaaggaagggctgcgctcatttcctttcccattttgtttgggaactccattttgtactggactgagttagtgactggatcactataattataattatattttaattaattaattaccaccagttgcttgctgctacagcacctaccttttgctactgctgcttcttctgggcaaaaccagcatcatcactagttttagtgcagtaccagtactaagattttattttaacctgacaaatataaaaagaaagaggactactggttacaaagaaagaatgcattcatcacttcacttcactgaggatgaagaggaggagcaactagtgtgaagaccagtccgaagcaaaaaaacgatttattagtacttaattaattaaagtgttcgaaacaacacactatttagaatccggggaacatgctcatagaagagagccctatatgttaatggagcataagcataactagataaaagcgtagataaatgcaaaacaagttgagattcgagtggagcctaagcataacacacaggaatgttccttcaacaactaaagattgtgccagctttggtttaacgccaaattcaattcatgatgaaccagaaataacccctcgcaatgtagaggccaggctttaatttcttttttttaaaaaaaaaaaggaaaaaacacttcactgacggccaaggtccattatctttctcagaatgatgctgcagcatatgcattgagcacccaaaaccacaatctcccaactcctagtctctaccattttctcctgtacgtcctaaatttggaaccagaattacaatacgccattggtatactgtccagttcttcctcaccaaccattcaatcagaacctcctctttccaaaaacaagcatagcctcccccattcatcacaaaatatataaagaaaatggaacatgcactattagcccgataagagtaaaacagaaacatctagtagtacggactagtagtgtctttctacttaaaaagcctaaaatttgcacttgcagtcaacccataggattctgcaatgcaacaaacataaatgaacagccaagatcctgacaaaaagttcagcactgacttaactcgtagctagtgtggcctaatgccctaatccatccatccccaccaccaccatttgatcggagtatccattgatgcaccaagctcaaactcaagaattataatatgttggctacttagtagtacacaaacaaaaccagcactatacataattggcactggcacatcattccacaatgcctaaagagtactccactccactagattactccataaaactgccagttccaacgcgcttcatcagttcaaaacttcaaaatgcaatggcatctgcaacgacaatatagcattcaaaactgcaatgcacaatcacaacaaactccaaagatgaaagcaggctaaaattttcaagtggccagctgtttccctttatttatgtcctctctcatggaacctgccattgccctctactactaactacagaattccttccttctatctggcaattcaacaatgatatattgccttgctactgatctgctaaaagctacaaagagataagaaaaaaccctacacgcaccttccatctttatgaacagcataaaagtgcttcttttatcacaacaaaaaatatggacatgaaacccaaatatgactcataatgttgcacaccatgaccatgagaacacagttgttcacaatacctacactcttcccatgggagagaagggtgggtcgagcacaactggtctgggtggcttctcacttctcttctttgttttcctcttctcttctgccgtgactgcctcgatcagctggctcacttcctcctcgagcagcatcttaagtgaactggagtagagcttgtgcttgcccttctcaatacttacggctgtcgaagcttccgaacagtgcagcagagaaatgcaggttgagaaggcttgcattgctgataaccgcgcgtgaaaatgcaccaataactgtcctttctcgttgcccttaatggaaagggcagggagctcttctttgccaccctgttcgaagaatatgacaacttgttcatttttggactaagatcaatacatggatgaaaacagagatgaatcgtcgatatactgaataagcctagatacgtcactgacaatggttttaagggtcaaatgtctgtcttgtttccttgatcttcaaaataagcctcaaggctatcgattttcttcctataaactcataggcattactaaagcgagccatatggttaacatatatgattttatagctcacaacgaaaacaaaagattactacactaaagaaaaagtgggtctaagggcagttctctaggaggagcaaatctaacacttggaaaatttgatcaatctttcttaaaagaagttctcgatcagccttgggttatctttggagagttagcaggaaggcaaccaagtatcttagaaaccagagcatgcatagcccaaagtgatttcacacaaaaaataaagataggagaagtgaagtgtaccagaacaaagagttccataggattctcgccttcctttgtgacagaattggcccagttattatcatatgcattgccaaggacagcaatgggacaagccatgtcccatccaccgcagtcgcagcctccaccgtacctccatctatccagcaaaggtgatggactggtttcatcatcgtttggtaacccatgcagcccactcggtgtaatcacttttacagtaccaggtgacaaaccactcttaagttctttggacttgcttctattaaatggaacttggatgaccgttgctgcaatctccaaatgaggataaagatcttcttcagaccacggacaagatgttgatacatcagagttatttcttgcactgttttgctggtccatcagattaatcctctggggacagtcaccagaggctgatttctcgacggcacttgacaatgtcgattgagtagtctctgtacattgagttttctcctcagcagaaaagctctgtcttgcatgagcgatatcatacaaaacaaactcagtgatgacagagttagtcagaacaccatcttttccaacttcagagcacaagtacgaagaagcttgcatctggcctacaatcggcggtgaacaccaacgtccatctttggaggcccttccagtagcacttgctcgttttccaccactgtggaaagtgtaaatccagttcaagtcattccctgttttccaactcctagcagaaatggattcttcagggcccttgacacagaactcaaaaactggaataccattcttggtatccaatttaagaaccgcctgaagatgagcaggtgatagagcattagttgtatgctgcctttctccattcagctggcaattaattgattggctttgttcactccttgataaatcactcagcaatgatttgcgggatacacaatttttcctgttaaccggcatagtaacatggttggagtcttccatgagagatggacttctaatagatttggacttcataatagggtccagaatcttcttgaaggggcttgatcgaactttagtgctgttctctatgccatgacgaacactttctgatggacgggtgccatcagagatgctcaccttggccgacatggactcaggcaaactgtttgttgaattcctctctctctgactacaattattctcactgggacatacactgatcttgttttgcaggcagtttgcttctgtacctttacttgactctccacctatcaactgaggagctgcatttctgcagggacctttggtcatctcttcctcaagtgagatctccaagaaaccatcgcctgcatcatttttcaacagggtgcaatccatgcgtggacggtccagcctacaattctcatcaggaagctcacggaatgaaagatccaggaagtccctcgatgctcgatgaattctacgagattccacagaagacttagcttctgagcggcgattctgatgcgagaaaaggtaagctccacttgtgctaggctgggaggatgaatcaacaatctcaaatgacagaaatgcatccccgtcaagtgcagaatctattttcttcctcctgccttcgtggagttttcttatcatgctaatttcactagagctctggtacatagaaccacgctttcccacaatactatcctccgcattggtcttgcggcttcttgtgggcaagctcttgcagtggaaatttgggatgctctctacgcgtagctctcccaggttgccatctgagcatttcaactggtggtgtcttgtgtcccgatagccattttctccgatggtgcggcgaggggatcgcatgatttcaggagctgctcctgaccgagaacggctgtcgcatttggaggcaacatcttgcctcattgctgaaacctaacatgtggacacaaggtgaaagattaagctccacaatttgtactagtcgaacagaataaatggaacgaaatgcactgcaactagatgaacaaaaggacgcaaatggtgttaaatcctctaaaatcctgacctcacaagaagaaacataagtcaggtatgtgcatcttaagtcaaaaagaagaggagaatgggaaaaagaaaaagaaaaggcgatctgaattggggaaaaaaatagatgagaagcacatgtcacatcgctttgttctcgtgggaggcaaaagagaataccataccaacaaagggaaaggaaaagcgaactaagaagatgatgagcccctaccaactctagatgcttccattctatatgctccagataggaaatttttatatctccgttcagaataacaaacgaggcaaatggataacagatctcaagaaacaaacaagagaaatagttggcaacctaaaatggtgaaaattgaacaagacacctaaaagcaaggggttttggttgttgaggcaaactggagaaattattcagccggaaatgaagaatcttttgtttctgcaacaagcgaagattcttcgccgtagacgaactagccacattcattcagcccgaaaaaatcgcatcttaagataccgaaacagtagcattaccgcatcagccgccaacccaaggtgaatccaaaggtaggatcaagaagatgaacttacctttacctgcagggcggaagtcggctggaagcggagagggtgagagagagtgggagatcaagaggctttttcccaggaagtggaaggggagcaagaggaggaggaggaggacattgaattgggggagcaggaggttccctcacactcaatactcctccactaaaatgctcttggcggctacttgtatcatcactaatctaatgtatgcatgcttgtctctcactctttcttgcttgtgttgtgtgcgcttttggtcgaggaggaagccaaagcgaaatgagggagaactggagaagggacaggcaactaaagaggaaaagactagtactagtaggagtaaattataataacaatagtagtaaataataataaacagtaaaaaagtagtcgtaggtggcggtaggggttaattaggtcctaatcccctactgtctcgagggatctctacctcccgctgctaatctattagtactaatcatcattaatcaaatgcgttctctgttcttggccttgccactcgcagcacgtatttaccctgttttttttgagtgattgtgaggatgagagtaaggtaattggggtgatttaccatgtaattctccattacaagatacaaaaacttttagattttgaatatacagtactaattcttaccaatttttttatatctctattcataatcacatatgttgaaggctaaaatttattatattttagagtaggtataatagcaggttataagccagctgcaaacatattttaagaagataaataaggagagagaagagcagcgagttatagatttgtagccagctgtagcacggactccaaggcgcggtatgtgtatgactggcgggaccaggtattaatagtgtagtatgtaactattgtatggataagctattagattggctatagatgaattagagctagtagttggctatactattaaacttgctcttaggggctcatcttttcgcttatacttatcagccaaaatataatttttcaacattaaatttggagctgattctgaggtttttcatcgaaatttatttttcaatctttgtttttaaatcaataagaacatgtatataaaagttctttttataaattatttttcgtttgtaaatatgccatttcgcaaataagggaagcgatggctctgttagaatgaagcgacggagggagtagtgtttgaatggtcatttgaagcaatctgaatcatttactgcctccgtccccaaatataacaacttgtagccattaggatttgttccaaaatataacaacttctccaccaacattcttttcccaaccaatcacaaccctccaccattcactttttccacctaccttcactattcatcccatcacaaccctccaccacttacttctacctactatcttaataaccgtgtccaactctaaaacttcttatattttgggacggagggagtaccattttaccccgcatgccctgttggagtaatgggttgccgacgcgacaacgagggagaagatgaaggaagggaccgctactgagggtgtgttcgctgctgatggatgggaacctatcacccaagcacggaaaaaggagtagttcattagcgcgtgattaattaattattatctaattttttttcaaaaatggatcaatatgattttttaagcaactttcatatagtaactttttataaaaacgcaccgtttagcagtttcaaaaacatacgcgcgaaatacgatggagaagggttggaaacccttggtaccgaacacaccctcgttgttggttgccttcccttcattcatcttctccttgttggtcgctacagtgcggtgccgggccccgggtcgaaatgaatggggttgccatatgacatattgacatgcatgctttgtgtagtcctgttggttgcaacttcaaacttgatggctcacgtacccatcaccaacaataataataatgctgggcctaactaaggttagttataagtactactactactactccagttcagatggaaatgaggaaatctccatctcttttgtcaataataatactgggcctaactaagctcaccagcaaggttctgtctgtcagactctgtttgccaacacaacatcagcaccagcatagtactacaagtactagtacttaattaaactgaacagggtaagggtaatggcatggcaggtgtcctatacttctaatactcctgctggcttctatactttcttctgctcatctgtctcttgctgatgtactcctactacgagtccaatcttttcactactggagtagtagctgcatcaaacaaacaaaggaacgccgtgaccaccccgacagcgatgatcgattcacattcagggcgccactgcttacgtttcgttacctaaattttggtcactacaccacgtcgggttgccaatcatttctctccccttttcccctgcatcaccacacatctctaattattaggcctgcctgcctgcctgcccgcctaatcttcttgttactaggagtaagtaatgaaaaccatcttgtccatcagtgattatagtattattatcagaagatctgtcatgttgttgtcgttgtttagcgttggcaacctgctctctttcatgaaaaagatgcagtgctataagcatcgagagcctagggcagtagcagtacgctaccaaattttgccaaacctcatataccacctagataaaaaaaaagagtaaatttcactttggtctagttcttttgatccaagtttcacaaagaaccagggctaacacaaagttttcacttaacaccatatgtttttgcatttgattgcactttggactaggctagcaatttgaactggcccatctacacaagcaggcagaactgcagctgctagccatcttcttgccttggttgtgcgctgtcgtcgcctccgccaaagccaagccacagccatcgccaaggctacggtacctcaacccagccaccacatcacgtccttgttggatcaatgacccagctaccaccatcaacatctctttgtctggatccaacgtctccacgtccgcgacccattcaagaccgtcgccgatctctctgttctgtgaccggtgaccccaacaatctccaagcacattcttgtcgtccgagatcattgcttctcccacttgccgcaccttctcggctgtgatgcacgtgcagagctcacccacatccttgttacttggcggtggccggatcagcaatgctggtgcccaagaagagaggttgttgcctgctaacgtggatgggccacagccaacatcctatcccaaatcaccaacccctagtccaaagtgcaatctagtgcaaaattatatggtgttaagtgaaaacctaatgttaggcctggtccattgtgaaactctggtaaaaagaactggtccaaagcgaaatttactcttaaaaaaatggtgttagatacatgctctattggagatcctaccaatctctctcctccactctctctcatctctatgttttccctgatagaggaagcgaggcaactcgttcggcgagcccgagcggagcggtgatggtgccagcgtcgggaagggctccacctctcctcctccaaccggcggccttcatcccttggcaggttcggtggctagtgggagcagggcatagcacaaacaggagctcggcgacatgcgaacggggggcggatttggtggtgcggccctctccatcaagctgccgctgctatggtctgaggtggaatggaacaacgatgaaaacaaggttagttgccagatctattgcgccctatgccaccatcgcttcctcgtcgagctcgctagatctggcctcgggtttgtcggatctggcgaacgacatcgctttgggggcaacaaagatgctcagggtggtagcttcattaacgaccgccaggccttgcacggggtgtgggggtgtcgcacggggccataccctctcccaacgcgccactcacatcgcgccttaccccacacctaccaaattctgacaaagaatgcttagcttagtttggctctgtggtctttagttggaaaacagcagacgtgtgcgtggcgacagatctacgacattgatggtcaaggctgaatgccacctccgcgcactgtgaacacccttacactatctccatcaatttgtacaaccatgtccaaaatataactacctcttatagatgttttggattttaaatagatttatgcatatatatggtttatatatgtgtgttcatatttatatatacggtagtacggtggggtaaaaagaccaaaacatcttataatatgaaatgaagatcttataatataaaatggagagagtacctaataaataatatctcatcatgtatgagatagctaatccctccgtttcaggttataagatgtcttgactttgatcaaagtcaaactgctttaactttgatcaagtttatagaaaaaagtagtaacattatcagcccaagacaaatttattatgaaaatatattcaattattgaattgatggcactaatttagtattataaatattactatattttcctataaacttagtcaaacttaaaacagtttgactttaaccaaagtcaaaatgtcttataacctaaatcggagggagtatattttaggaccataaaagaggaaggactaaacgacaactctcttcatgtcaaagcccttccaccagctactgtattctgtttggcaataacaacataacagtacgtaatgtcaaatctttacatacgggctgatacggctcgtcaaaatcttttctacatatatacacacatctaggaactattcaccatatctctctacatccgtaacacgcatgcttcctccagcaaactaggctacgtaaggtcaccgcatctgatcgcttaatcaattttacattggatgatgaaatcctagctctcgtactggagtacatccatgtaccaaaatggacctgcgaatgggatggcaaatatgcagccagggtacatatgcacaccatcgatttataccttgcttgatattgaaccaacaaggcctttattgctttgcaatgacatgtactagtatagccttcataattccgcacctttgctcaatcaatttttgcttgttcgcttttggagctaggccacccgttgtctgaacatcgcatgctgccactgtcttggtcctttgtcttggcggctagtcgattgtgaaccaaattttgcaccgacatcacatcctgcgtgctgtcatggagctgcttgcacagctcgtctagagctagcatggggaatggctcctcaataagaacaccaacctgaaatgtgagtatgtgctactgggttagtggtagtacaatacaggtagggaatggggaaatgggaacagctgctgaagcaagattatcaagtttctggtgaaacacaatgaagaaaaacagactacattctttaagaatcctctcctctcaagcatcaaagctaaacaagtaccctaaacattttgacacaataaagtagtaagaaacatattcactaagatctcgtgtggttgaagacaagcagaggttggctaattgctgagcaatatacactgagtttcccaaaattaggacaacccgattctcaaccacctgcagctgcctttccatgttactccaaagacaaaccacatatgtgtagttatgactaattttagactgataaaaagacgagcataagcaaaaccaggcaagactatattgataaatgcatcctaaaaccacactaaaactaatcctgtaaccaggttctagaaggggcagccatcactgttttgaaatgcaccaatgtcttcaaaaccatggccaattgctgcctgcagctggtagctaccaaggcacaattttgaacagttttaaatggaagcacaacttggggttgaaaaataagttgagacttacttcctcaatgcagaatagagaggcagcactgataaaagtagctggaacgactatccatttacattcatcccagagtatcactggaagcgtgagatgccacagaacaagaaatctggaagtgagtctagtgtatgagagaggaataggaatcccaatgagctgctcacaaacactaattccttcaagaaaacaagatagtttagactcctacaatcaagaaaagtaaacagcattagattgtaccattatggattactagacttgaagtaagtctagcgtttgcagatcaacgggtggtaactctcacaagacaatgaagataacaataagtaaatacacctaaagtaagattgaacattggatcaatgcacaatggatggtatcagtggcccaagacaaaaaaaaaatgatgttgagttatgttacaggtaattggcaagacaagaaatctgcaggtagagatagaagagttaccaacttaccatgatattccgcttattttcatcgaaatccaacatatagaggctctgtgaaatgaactcaataatacagcgaggacgatgttttgatctgagaacaacattcaagtcatcttctgagagcaaaccctgaaggtccctttttatgtccgaatggcagattatatgacactgaggcaagaacacgaatgatatcatcagttgccgcgctagtgagtgaaagctaactaaatcaggcataattgcatgaaaacaaacgctggtctatgttttcagagactagtgaaaggtaactgcatgaaatataatttcagagagtgaagttaccaaattgaatcactggtagtatacagtagaaaaataaataaataaatacagaattaaatatataaaaaaaaaacatatgcaagagcaaaaccttgagcgcgagcgggaaggcgagaatgtagttgaggagggcgcgcgtggcaggggggttgtggtggcgcatggccatcccggcgaggtcggcggcggcggcgatgacgcgcatccatgccttgcgtccctcgtcgaagcgggcgtaggaggcctcggtgcggaagacgaggaggagggcgagggcgggggcggtgagctggtaggggagggaggaggcggtgagggcgtaggcggggaggagggtgttgtaggtggcaatggcggcggcgaaggcggtgaaggcggaaacggggggcgcgagggagaggatgacgcgggaggtgagggaggagaggaggtggcgcaggtggcggcgggagctgcggtgctcccgccagtcggcgtgggtgtagagcgggcggcggtcgcggatgcggcgctcggagacggcgtcggcccagtcgggcacggcggagaggagggagaggagcgggttggtgttgctgttggtgtcgggggctttgggcgggtcgcggaagcagcgggcgacgtgggtggtggttggcttgggcggttgccggtggatggagggtatgggcctgggcggcgccgccatggccggcctcctcggcgtcggcgaaagacggcggcgcgcgcggtggttggtcaagccattaattggcgtttggtttgtggcggaggaacggatggggctttcgccaatttgccttcctttttcttcttttaccggagccatctggatgactgacacgtggaggcactttccagggcacatgtaacaagcgattgtttcgcttttttagacccaacaaaaaattaaagacgtaatacaagtttaaaaagaaaacactattatttctttttttggtctagttttggtacattagtaatacagaaaattcgagatcccatcccacactagctgatttttatatattcttcgttcattcgtcccttttctggcaatcatatactcccaaatcatattttctatcttttcaaataaattggatataaagaaaagcttcaactcaaggattttccgacgtgccagagaagatataacattacaaatatctcaagtactgtccttccgttgataattttagtatcagtttttgcacgagtttgtttcatacaaaagtttgaacaaaatatggctgaaatagccatcacaaatgcatatgaatcatagcataggcgcatacatataagtctataccagagaaagtctcatgaaatccataagatgcaacttaacgtatgactatatacatgttccttcaacaatttagacctacctatatgtatgtaggtctttttatcctcagattactgacaaaacgtgagatattttttttaagaaaaattagtttcaggtttggggaattccaaatcaccctttttgaggctttttttttaggaaagtaagtttaagattttccgcagctacagctacaacagttgcgtgatttggaaaatggggaattccacagggtttctgagacattcgtcgccgccgcgcgcattggcgaggcggagagagagtgagagtgaggaggagtttgggtgatctctcccccgtcgctagggcattcgcttcctccctccttaagcacgcacggtgagtcgatcgctcctcttctactcgcagtccgatttccgtttgatatttcgattcgatgcgacagttatctgggcgtctaaactaatcgaacgaccccaacgcgtgggagattccaagcagcttgatttgtttggtccctccctgtggatcttgttgtatcgcactgcccaataaacattatctgtcacggttttacatcatgcgattagctgtgttgccatcctttcatgtgtctattttcaggtatatgtatttttctgctccacatatacttcaggatttgttttttaattacccttgtttttatacatcaggagttcaggactatgtagtaccagtggtaatactagtaatcataactcaagaaccctgtaggccatgttcggttaatccccatgagaaaaggattggaggggatttgttccacacctattgtagaatggaattattcactctcaatcccctccaatcctcttcaatcccttccgaaccgaacaaggccttagtgtcagaatcttctcttctttgccaactcctatttacatcttctttgccaactcctatttacatgatcatttcagccaagctgtccattatctaatatttagtcagcaaaatcaaaacaagttaggaacagagtatagaacatttatcagcacaccaattggggtagtcagctcaacagttcaactgacatcactttgatgcgtaagatcatatgctgaatattgatgaactttatgttggtcagataaacaagcaataaatttttggcacctaactatcttcaagaacaccactttgtttattttgtctgtagtgcagtagtcttttaaaaggataaaaataaagtctaagcttaaactcttagcaccagtgttttctggggcacatttctgggacaatcagtaactcgaattacaaagatatcctagtggatcaggatgattcaaagaccagaagtaaaattgtatacctgcattcgccatatgtcaatctatcactatggttgctcaagcaggaaaaaaaaactaagttccatctgaaatatcacattctttcattctttgattagttatatatgctaagaggacacatgcgcgcctttctgaaaacgtatccttcgatttttcacacacaactgtacactgttacacacttatacacacaataacaagaattcacacaa

SEQ ID NO: 25518 - DNA, 1829 bp, Oryza sativa
ggctcccaacatgtatcaatcaaactaacaagcagtaaaatcacacaatacttgtctggtccactggtcctcttgattctgtcatgcggacagcttactgtcatcaacataacttctacttatgagtcatgactctacccattctatatccattctacaaatagcagagaaaaataccagcagtgactaaattgaagcttcaaatcaacaaatcattagcgacctcttctaatagttcatctagtatgaactcccatgtatcaacaataatctcttcactttccaattgaagattcatccaagtgccatcttccagatctatgttaactagctggttcaatgttcttggaaattgattatggagatgtctctcgatatgcttatttatttcttggatgaggttctctcccattggaggtggctgtatcttgtgcatgagaaaagataagcaaggagggtttctaaaatatgtctcctggattattgttatagcttcacagatacaatcaaaagggagctttagatcatctgtttgattgccttggtgtagttcttcaatcatgcaagggctgatcaattcatcttctagataccacacctctagattttggtatgtgcatagttctgatagctccagcattgcctttatgtaacttagcctggcatcctcgtcctcccagaagacccattggtctgatatagcatctggtatgtggggcctcatcatatcttgatgcatctcacctgtggataattgcaagaccaaaatacatcacctttagattagaacacatattttcttaaggtcaaaaggaaatgtaattttgatatgtttagatgagaagatacattttatcatagtttcatggtcaggactgtcaacatcttcacagaagaatggatcaaggacagatacagggctgggttgctcttgcttttcgtggttcccttcgggtgaaatttgtgatataagttcaagtgatgcacttgatctgggagtttttggctcttggtgttctaggctctcaaccacattctcaggatagctcagcaacatccctgcatgctctctgccaggttcggctccttcaatcagttcctgcagtgtagataaacacattataactcaaaacaacaatggagaccagatggaatatcactaagtattggtgtgaacatactagtgatgaggtacatgtacactgctcttttagggtgatcccttcactgcaaatcgtttcggagcaagccggcttgtcgatttcttcaatatgcataatgtcacctgcaaatattcctttgtgcttagagaagagccacgtaatatttgataattttaatgactatggtattatgtactcaccatcttgtgcagtttcttgtttcatggagtgtctatcctgatcagccttaccatctagtacttcactattaccacatgcaacactccctgaatcttcgtcagacagatctctttcttttgcatattctgtcctctcatcctgttgaatggcagaaatatttatctcttcgggtgaaaggtcaatgcggccttttaacctggggctactcctaggtgatgatgcgttgcgttgagggagggaaagcattcctatcaaggactttgaggtatgaactgttggatgcttggttgtatgactgttatactctagaatgtctgtcagatgtttcttcgcctcttcatagaagatggatgtatcctttgatgtaattatgtctccgttaatttcacctagtccatcattcctttgcttttgcttaccactggtcaaaggtctcaaattgtccttatctgactgtttagaatc

SEQ ID NO: 25519 - DNA, 1587 bp, Oryza sativa
ccttggctctaacttggtcactacctgtctgttttgattattttgggtgttctccttctccaaagtatgcggactcggtttctgaagtgtcttcaagaaaagttccttctctgggcttagcatatctggtgcatctactagtttgttagattgataagatctgctgttacaaatatatttttcatagaaatgctccctttgcccccagtctggagattcctcataagcacgttgacagggcacactcttcaactcactaagctttgtatggatatgtgacttcaattctggacacagttcactcttatttttgcaatcatcatggtacccatagagttctcccacaaaatctgctaaagaaagttcaagatcatcttcttctgcctgtttcatggatttggaaccacttggatccagcaaaccagacggagaagccatggctgtgcttgtgctgtgacttttggctctgttttgtttggtgctctgcattgaacttttttccagacagacatcatgtcccaggtcagctaatattctttgaacctcttccttgggaatctttttcacctgttttaccttacccagctcgtcctccatgagtcttttgacggtttgtttccttgtgtcgcattcctctatgttctgagaaatataagaacaatacacttattccaagaagtaatctttaacatgcatcaaaagaaataggtagtactgtctacatgataaacataagcttgatggaaagctatatcagttaaaactatttgatgtttaccatgccaacatacacttgaagcaaatctggttttagaactcacccaacagattacaatgtaaagattgctagtactgtctactcaaattttttcttctctgctggttaatgcagaatgcttgaatcaagtccctttcatcaaagaaggaataatggttgctaaatccaagcctacacatgataagtaggcaaaaagaagtatatgtgggatcattttgtcatgcttttttttttaagtttattgttccacaacttgcattaagctaaactttcccgtgcatgttttcgaagcagtaccaagttcatatgttgcatttggattttggacgacttcttttctccatacttgctctagatatgttctggctctgaagaaaacacttagcatgaaggaattgactgccattaacatcaatatggcactttcagttccattcatcaaaattattttgttacacaagtaactgaatagtcaagtatggttaggatcactagacttctgttgcatattcgtggtgttaacaaaagcagacaacagcaaccaccagcatgagcatctatgctttttaccattaaaattacatacttactaaaataacttacatcctccccatattcatctgtttcttcaaagtccctggatttctttcttgagtgcctcctacctgcgaccatgcagagttgtaagaagatatacaaattatgataactaaatatttttcttgaatgccttcatatttgccagatgattccgaaatgtagattagagggatttattgacagtctatgacatcagaaaaatgtttact

SEQ ID NO: 25520 - DNA, 20809 bp, Oryza sativa
acctgaaagcccaccgaaagtgtgccttctgcttccttgcttcctgtccaacagaaacttagcgtcacgtcggaaatagagcatgccgatgaggccccacatgcagcctatgttctcctgacgcctagccagtctttgacttctcttccccatgttagttggcttgttcctctacactttgcaattgaaatatgcctgatgttctctgcagtttagttcattgagctaatcctcttgcagcaggtttggttcctgagagaaactctgcagttagctgatgaacacttaggattcatcccgatgaaccatgcaagccaagaatgaaagaacaaaagaaatgagattttgcaggagcaagagaagatgaaatgcagcaaactggcagcataaaaccaacaggttccagtgttctgttattaatttgtgtactgtcaaaaccaagcaaaattatcaaaggaagatatgctaaaaactcctcaaatccacagatattgcttcatgcgaaacttacgtgataaccgagagatcgagggaacttcaccactctgaagtctgaaccaagaaaccagatgaagacgagcattaaaattcttcaggacatgttgttggccatgtgaagagatgctaggacctgagctgtgccttcttttggcaacgatgacggaaggaatcagaagcctttcttgcacaagcctcggtcagttctagtagcttttcctctctcccctcttctgttttctgttactcctacttctcttctcgccctgctgtgaagagtggactggagcgaaggccacactaactaactaggtaaggtagctaatggcgctgtagcagcccacaccacatggcttgcacaagcaaaatggactttcggccagtgtcccacgcaccacttttccccactcgcacaaaaagtaattgctagctgcaggcaaaagctgaagcgagcccttgataaattctgtgttgagcctgtagcaatgatataatctcgtgggtcttgaggtgtttgtagttgtaggtgcccagatatgaaagtatcataggagtatacgagtataaagagattggttttgcattgagggtgattgatatctaccgttttgtttgttctgttctgctagtgagagcccaaaaagggctccatcttgtcaagtagtaatattgagatggtgatggcatggagattttcttagctacggatagagttgtccaccaacatctaaccatggcatatcaggtttttgtcgatttgtttacaagagtgcaaaaacaattgagagtgcttgccatttccaatacgtatcttctcagttttcagttcaattgagagtggattacttcagtaattgattatggctaatttagttcagaaatggattagggcgagaagagttggtccaacataaatgagtggtggacctagcaatttcagtggcgtataaagtcacttgcctggggtgcactgcactagagcctgcaggagtacaaagatggaaaatggatatgcatatttccgcaattaaactaacctcccttgtgttctacggaagggtgctatgatgtggattgcgatgctgggtttggatatcttatcagcgagtcgatagaattagatggattgttttcttacacacatctaacctcaatctggttggtcctccccgccaaatcttcattgttatttaagaccgaatcagcaactgaattgtctagcacatcttgacttgcaaacctactctactcatgccatgtgtgttgcgtctgatactttgctgtattggataatgtgttcttttctcttgaagataaagaagatgaagattaagtttttttacgtaaaatgaggtggtattaacgtatgattgattgggttttaattattacaaatttgaaaaatagattaatatgatattttagagcaactttcatatagaaaatttttgcacaaaacacaccgtttagcagtttaaaaaacatattttgaaaatcttaattttcttccaactcttattctcttctatctgatcatttggtcttacccagatgcaatactatagtagtactagtatatgagtattcatgtcttaaaatgatgtctccagaaggaaacacgtgcggtgcttaatttcttcaaattttacactatgcacgaccagggttattggccgctaattaaattgcagccctgattgcctgaaggacactgagtagccaaagacaagtgagcccaacgaatcgcccgtggctcattatcaatttatcagcaattgctaaactgctaattacaagtatgtgccttcacattctgcgagtcagtgatttgctttaataatctcttgcaaagttaatgcaccttaatccttaggccttacttggcagttgtaataatgataaaagaaggcgtgggctttgatcctcagaaatgtgtcggcgaggcctgtccattctcccatctgatctaacctccctttttcttaagaaggggttttttttttacccggcctctaaatccaaccggatatatgcaacacttttaagctagaaacttggcctatcaaatatagaatttagtcctcaaataatccaatctgaaattcgctcctatgaagatttgaactcagaaccttggggtactactcaggtcactgtaactactaggctgcatgtccattctcccatctgatctaacctccctaccagccatagccacccctccctccatcattgcttcatctttcttgttaaacctggccaggcaaattggttggaaaacctaataactaggtttggcaagatatctaatcaaacaagatagtgctgctcgctctgtaaaatttaaagaggcaactccaataaaaatccctttgcttattattcctgatgcacacataccggttattagactagtgatgatgaagtacgctagtactgtccaacgaacttttcctgacacaacaaacactgtgtcgctgtattatactcctaacctttttttttgttttgtatagagttgtcatgtgtctcattaacttcagtttacaagtggggaggacaaacatacttcagtgagatgctatactaatgaagacgtcagtgtagcgacatcatttcattaacagggagactctgtccaagtactaaacaacagaatagtcgtaccgatgagcattttagaggagatgatggtgcaacggttgcactaactacctactacagcaggggtatctatctatgattaatccgataccatctgtcgctctctctctctctctctctctctctctctctctcctgaatcctgatatgtagcattattgttgatggagtttatatatccttttcagtttccaaacacattcaatggctgctagggagatggatattgggacagcttgttattgcgtcagtcatgagccgcaaatgctgtagcaatgcgtgctgcgcttgtcgcaatctcaagcaggcgacgttaatttactaatactccgtattatactatctgagatttggtgagcactagcaaacgatactcccaatctgcactggactggaatactggatcccgcatatgcatctttctctatctgaactgaaatgccagcgaaaaggctggcaggcacctgctgctttttacctttagcctcccccaattcacagggcatatgaaaatcaaggacattttcgagacgaacaagcagcaaacacacataatatgcaggaggacatcacagagaacgtacgtgcaggtgcagcgactggtttgtcggtgccgggcatcatcgcttctccttcacttccatgacaactcaactgaactgtaccgaaccgaaccggcatgacatgaatgccagcataggatgctactccagcctgctgtctgcctgttctatagccaggtgcgaaagtggacagatatataggaatggcatcagctggttgctctacagtatgtgcgaaaagtggtgtctgtttgtgatgcggtacagcattcggcagcatggtaagttagttgtccactcgacctcccaacaacaaccgcaacaataacaacagcagcactggacagcaggttctagctctctagtttagtggttgatttaccttttaatttcgtcttgtcgtaatctttatctctttcctttgtttggctttatgttaaaacaatcagtcaatcttgagatgatgatgacgatgcatgcggcgttaccattaattagctaggatgcgagcacgatggactgcatctctctcctcctcctcttcctcgccctccgcaggatctccaggccctcttcggtgccttgctttgtcactttccactccttgctacctgcaccatatgttcacatgtgcaccaacccgtaaatactagcagtagcagtagaagggtaatcaaacgcaaactgtaagtaaattctagatgattgaaactctactctattacgcaatcactcgccatgacagccggcaaagcagattcagtgattgaaagcatcgtttttaattgttggttgcatggaattcagctctcttatcccctagatctcccgctgggtttcatccatcgaaaagaatgcaccctggcttttcgaggggaagttcaacggttgatagctacctgtttctgtcttcaaaatcacgcaggacgcacgtccttcactgtcatcatccgactcgatgattatgctgactggtgcctgcattttgcattcacaagcaagcaaacatgatcacgagttgaacataaggcgaccacctactatctttattaaacctgcgtgatacaaagctatgccactttggtacattcagtgatattgattttagaacattaccaattagagcaagagatgcttcttgttaacaaattggccttgtaaacatgttctttcgttactgatacagaaaggagcagggctgcatggcttaccttctttgctggcacttgtatattgacctttctaatcgctacctcttcctgtttaggtgccaccctgtagtagctcgaagcaaacggcttttgtggagctgcttttacctttccctgctccacctttggcttcagatctgtcacctttgcaggataaaccaaatgtgcagaaagcctgacattaacaaacaatcctcgtcagaatagaaaatccaacaaagatccgaagaagaacagttggtagcttaagtcttgctagtaacacaactcgaaggaatgcaccgacacaattccttccaataaaatgagataatgttccattatacaaaatttagaataattactatctagtagatttaaactggcagtatttaaccagcttcgtaacgaaaccaatggaatattaatcattcttttgaattgcttctaacacttgattttaaataggatctcaaggatttaaaaccgatttgaatttgattccatcaagaggtctttcagttcaattctccatactatagtagtgataaatacatagctaatgactgaactatgtaaggagccaagagcagaaaattacacttttgtttcaggtaattggttcatccgggaccttccagctgctactggtgctcggttcattggagaccttccagctgctactggtgtctggttaatctgggtccatccatttgaaactggtacttggtaactctggtccttcagccaagaccaaaaagaagttagagaaagatactggaagacttatggctaaaattacttgagtcatgaatttacatactgccatcatttgcattgcagcaggcctactattgacagacctgatagctctaacaaccccctgcgcaaacaggcaaaacacaatcaaatatagacaaaaacatcacattggttgccttcactatgcgaattgatgaggtttgagcatgacaaatttaagttcacgcagacttgtgcctgctccttcagacatcatcagactcataaaaaccgaaaactgaaagatatcatatactgaatatattggaccttaggttctcaagtatcatgaataattgaatatagaagaaaactttaggtaactatgcttatatggaaacttaactgtcatatttggatataccagaaaaaaaatcacatgctcatacacaagaatgataatcatttatatgcaaatgatagttttcagaataatttgtagacacttggacagttggacttatcagagttgtatcaaaactggaagtacctccatctcttttgtaaaaactctgaagacgtcacaccgcagttgtcttatatctgcttgcatttgtgtctgcagggttgcaagagtcgaggatatctcattcgatttgctggcattagaattcagaacagttgtctgatcaccctgcagttgtcttgcttgcatttgtgtctgcaaggttgcaagggtcgaggatatctcattcaatttgctgcctagagaattcagaacacttgtctgatcaggattgtgttttgtgctgcttccaaagagtgctttgagatcgtcttgtcccttaagctgtgataacacggtagtatgttaactctgacgttgcacaaaagaaaaggaaagagggaaagtggagaaaatgctgaaccatcaattatccttacaatttgctgaagtgagctttcaaggacagcaatcttttgccgtatgctaccagctaaacataaaaaaataattgctttcagttccagttgctgaacaaggacagaaatagagtgcagaaattcatagacaaaacagaagttgcacaataactctttatgactgaaagttaggggcttacaatctaatgatgcctccttcatggctctgtttaactgcattacgtcactttggactgagtctaccaccatccccatcttatgtactgagcttgccagatgctgaaatttgcgctcaacatcctcattagtaacctgacctgctgatatacccatctgtcagttatactgatgagaaaatactatggcagtacaacaacttagtgatttggagtccagataaagaatgatttcaattgaactttctattataaaagcatgcagcgatcatcttacattctatgcagaatagaaaaacagaacccagttggaaaaaacaaagtgtgcctggaactcaggtgaaatgctgctattctggtataaacgaaatgaaggatatatgagatgtagtgcgtgggtcttgagagtttacatctagtatctgcaatggaggggttccagcggtgcactgggttgcttggtaattttgccagttgcagctgagactcttctcgcgcgcaagaagctgaactggctggtaaagaggacatcctcttggatgagtcatcatgcaagccaaatctctgtacaacaatgaagacatgaatgaatgttaatgggcaagatacaaaacactacacatgccatttctaactagtcaagctgtaattagatgcacaggtacagaaatctcagtttgtgatgcaccaatgatgcttccatgaataatgcaaaagtaatttatgaggaacaggcattcatgtaatgaaatcgtgtaactgcatgtataagggtgggtgtcaattgcaaacagttttacaggacagacaaaaacggagttcaattccctgatttatcagtgcaagcgtgcagcaaggtggtgggcagcagagtgagcaatttgtaccactagtaatcaaaacaaatctgaaattgcaggaacagcctactcatagtaattggaccttgcactatctattagtcgttctgcagcatacatttttttttttgcaactgcgaccagagataaaaaaaactgacaaatgctgtatcaatactgaatctgatatggattttcaccaaaaatccacaaggcaattcagcggaagactctgataaacaccgaacaacacacagggacaggagtgagtggaatccccaatcagtaaggcaccgaaaaataccaaaatccattgggcggcagaaacaagagcgagggggagaaggagaggagaggagaggagaggagaggtgaggtgaggtgagacctgatcgcgggtgggggaagggaggagggtgaggaggttgtcgtcgagggagacctgcgagaactgcgactgcgagtgcaagagcgaggcggaggcgccctgcgagaaggactgctgcgactgcgagagcggctgcgaccgcggctgagacgccaccgccaccgccacggaaccggaagccgacgcgccgctgctccctccggtcctcctgaacacaccacaccaccccaccatgagcaaaaacacagcatgcatgagcattgagcagaaggggattaccggggagggaggacggagatggaggcgatgtcgcaggccttgttcatcttaagcttcatgccgccgatcgccgccgatcgccgtagccttctccttcgccgtcgccttcgccggggagagagagagaatattcgcaaatttgaatttcttcctgctctgcttgctttctggtgggtccctgttctccgccttttataggcaccacagctccccgtgtgggcccgcccttgcgcatggcagctctgaggctgacacatggggcccgagttttgaataattgcggctatgtcatgtatgggtgtgtttagttcaccgaaacataattttaattttagagtgtcatatcggacattttgataggatgtcggaagaggttttcggatacgaataaaaaaactaatttcataactcacctggaaactgcgatacgaatttattaaacctaattaatccgtcgttgtcacatgtgggttactgtagcaatggctaatcatggactaattagactcaaaagattcgtcttgcgatttcgatacaaactgtgcaattatttttttctttttttatctatatttaatgctccatgcatatttccaaagattttctaggaaaaaaaatcctgggaactaaacaaggcctatacaaaattaacattcaaattgcggcagagaagaaattaggagtgctctgctatgcaactgcaaacacaactcaaaacaggaatacatctcttgcacagattcaaaacaaataaggtccagtctttttttatttgagattttcttgatactagtattttgtgataacaggatacattagcacactgttcttgtgatcagaacttcaggagcacaggactaatagtatatggggaatttgttctgaccataaaaagaacaacattttttattattttgcattattatcggatcaatgcgccaaatacccccaacgtatacagcgagaagggaggtacatgatcactggtttagttccacagtccagcccatacaatcgtccacatgacccatctggaggcttgtaagtgaagtatacagctgctgacacaccacgcccactccttggttgccatattccaccctgcaaggttagcagtacaattttcggatcttatatgtcttgtcataactatctcaagaacaaacttagcatagttaaatatctcattttaatgcgtgcggcagcacgactccaattgctctacaattatcatgggcaaccaatcccgaaagatctcaagtttatagctaactgaccacctgcgcgtgtaatactacattccatatcatgttgcatttcggtttttctaaaaacagagaaaatgttgactctcagaccaaacgctggtaaagcaattggtggtgtttgtaacaggatgacatgatcatgccaggtaaatgttgaggtaataattacaaaaaaaaaccctaagaaatgatcacaagtgagaaaatcatatcagcatggtgaaaagttaaggaaaacctagcctatgaaacacgtagctaatccaaggtcttcttcaccaggttttatttttaccgaggtagtaccatttgttttggtgctatttctagtagagtagtaactaactaatccagtcttatcccgaaactgctgtgatatgtgttctaaagacattagctgcaaatttttactgcatcaaatagccatattgcacagcaagtaagctttcaagcaaagcagaagtttcacctttgccccagataagttatgctccccacaggggacaccacaacagctgttcccgtgcagaaaacttcatcagcttcaagaagctcatccactgacacaaggcgctcctcaaccttacagtaagttaacattaattaaagctacataacattaacaaaagcatttaaataacatattttttcttcctgtaatcaatgaggaaataaccctatgatgggccaacaacagctcttccaggccactaggaaaataggatctggctaatcatttaagtaaacttgagctactggtgaaaacaagaatttaatttggtattgtggaatggtaactataaaaagcttatctcaaattcacaggtaaaatgcactaggcagtcatttctttcctggtctccatgatgctgatgagtaatttaccatgaagccttttctctgagcaacttcaagaatacttttccttgttataccaggcagtatggttccttttattgctggagtagaaataacattgccctgatgcgggaaaataacatgattacgacgataaaaaaaaaagaacctaaacgatttacacatcctaagggaacttgtgccatttcactgcataaaacctaaataagcattggccaaatgggaacgcctaatcatgcaacaacaaaaaaatatcgattaggttgtaattgactaagtagtataacatcatgcgcttcgctgaggaaaaactacttctgactccagctactgaaaatatttgctaaaataagcataggtataagagaaggatcatactttcacaataaagatattgcacgaagacacttcttccagatatttcttgtgaacggcatctagatagaggacatctgaatatcctttctgttttgcaatcctctgtgcttttaatacctacatggtggcaacaaatatggaaactgagaaaccataagattaaaactaaaacagtgtgagtaatagcacataatgtatgtatatatgctagaatatcagtattcagtaaacaaatcatcactgactgactctaacttccatttcaggctaattttaccacaacatcacttcctcacaaatcacaacgagtgagatttccatttccggttatttgtctcaaggggaaaaaaattaaaataagccgtgagctgaccatttgaaactaaataatatgaaatccacatagatatccaacataatagcttcataggaacaaaaatgtttacattttaagtttcgaattcaattactcttgaaacaatagagaagcctaactgcgtaagcaatagaatttagagggtacatagttacatgctgtacatatagcagaataagcaatagccaataggtaagtacatagttgcaaatataactaactagatgatggccacagaagctgtaaattaaatagttgtagctttcatagatgcagtgccagaagttaccgaggcatagtttccaatggttttcactccgccagttccaccaggggcagcacggtgaaagttttcttctataatcaagttaataggggctaaaccttcctgtaaatcaaagataacaaatttaatcagcatgtatggtagtttacaaagataacaggggatgaatttctattcttggtggaatcaggaatcgtgatagcaaatctgcttgtggtgtaattccaattccactatcctataatcactgcaaaaggaatattatttccctaggatacatggttctttacatattggatgagttgctcgagtatctggtggaagttaagttaaaaacttaacacaaaccttgaaatagttcccaacaggggagacaaaaatcataaaggtatactcaggagcaggtgcaagaccaaggacagctccacttcccataagcagcggccttatatacagggagcctttaccggttgggggcacctacaaatatagtacattaaagagagtgacaggattatgaagacaaaagattgttgaatgcagaacttaatccaagagcataggaaaacataaaatttcttacccatcttttatttgccaaaacggtttgctttactgcatccacaaattgttcaagagttggtgcaggcatacacatcctctctgcaccatttctcatccttatggcattctcctccggacgaaacagcagaatgtatccatctgtttttctatatgcctttaagccctcaaacaagccctatgtacgaaaataatcactgtttaagcgcagtaaattcatttaggacttcaaagagtacctatttcacatgttaccaatgtttgaagttcccaatccactgtagaaactccctactaacctgtccataatttaagactccagcagatgggctcagttctataggtccaaatggtaccatttctcctttggaaaagttcccatctggcccgcattttgcaatatacataaaatctgtctggacaaggccaaaaccgaggttctcccagtccaaatcagccaccgcagaggtttccctgcaagttatacgatcaggacaatatttatcacttgtggacttgattgaaacgtaacccatggcagtgagacttgtcatatacagttcatatttacatacatgtagttagttgctagagaagcttggcatcctatcgcgcagtgagccttggagaaaggaggtggcactgaataagtgtgattcttgatctgcagtagcaagaagaggtgggggaaaaaagatattcttctatcagatcaaaaggccatcgaaagttgaaaatatttaaacccggatgcatctttgctagtagtaggaaatacaatatgacaataaatcagacgaggcttgaatctatgcatgggatgggaccagtagggccaatcaagcacaaatttcactcaaaaggaccagagagatggcatctactctacagcactagagtctagagtagccactaccacacgccaatgaatgatacagtagacaacttagttgtgcctgattcatttatttaggaattcagatgataacagtccagaacaaggaaaatagggaaaacgaacagctttgttatggtaatggtcatttagcctaaacctttacaagtaaccaacaattagagctaaacgccacgtcttaatcccttcatgtatgattagacgctcgaatcgctgggcaacaactagttaggagattcactgtttaaaaaaaagaagagggagaaaaagaagaaaaggttcgctccccattctagttcaaaagtatccactcacgcaggcaggcagcaagtagtagaaacgcatggtatttgcaaagcgaagacgagaaaaataggtggggagggaggcgagtttgagattgagaagagagtaccggaagcgacggcgtggagagagagaggtgaggacgccgctggccggcgagcggcggagacagcgggagggcgccgcgggaggtgaggtggagctccattcggtttgctctccgatgggtttgagcaggcggcggcggggggcgaagacaatggcaatgcggcggtggcggcggcggaaaccgtcgtcgtccgaataaaatagcggcggccgcgagcgcaaaacacacacaaggctaactagttggtcccaccggtcattgactcgcgggaccagctgccgcagccatgccttgagctcggccagatccggcgcctcgtggccagctccgccagccacgacctcgccggcggccagctctggtgagaggttcaccggcgagtgcgggctccacgccgagaattccggccgctgcctcctctggtgagtcctttctttttctgttttttttttgaacggtacttttctttttctgttgtttgtctatgtgatgcgtttttcaaatctaatcacataaatttaaatttgagtaaattgtacgtgcggtccttaaacttgtaggggtgtgttatctgggtccctagactctcaaaatacatatccaagctccagaacttatcataatgtgtcatctagattctaaatcgccacaacctcttcaggatcttacgtgacgttaatgtggtatatgacacaactttacaagtttaagaactgtcaatgcactttacgcattaaattttgagtaaattccaccaactatattagataaaactatggcaaactataaaatttattaaagattttgtatcacaaaattataaatttaatgtaaaaaaatattttaaaaaattatatatgtttttaagatggttttgtgaaatttattaccattattagatttttgtacatgcctagctttccaatagctgattttttttatatgggtgtgtttgataaatgggttataagaggtaggtttgaaaagataagagatgcgaagaatggatggttaagataaaatattatcctttaaagggtgaaataatatttttctatccgccaaataattagatatgcgagtgatttttaacaggtggtcaaaattaaacaattagaacgagctaatacttcctctatgctttttctaagttgggttagctcgaatatttgggaaagaaggtattagacaggtagcatccataaggttgtcttcacctctcttttttctctttatctcacttatttatttaatatatttattttaaagtatatgtagggttaattcttatatattaaaaattataagttaatacttattatttttctctcttatttatactatcagagcagatatatagtattattgatggagatcaaagcccgggccacagattgagaaggagaacttgggtacccaatggagatcaatatgcatgggaacataatacctctgttgtaggtgtagcagcagctggacaaccattgtgcgccatatatatctgcaaattaattaagctctctctctctctctctctctctatctctctgggtgccttaattttacctaactatgagtacgtatttgcctcgatctcgcaccacagctgcttaattaagtgcttaatatatgaaggtagctatatatgcctatgttgcgcggaggggtttatatagatcgagagagagatgacatcattcattgacatgcatgcagcacttagttactatacattcgttttagagttaggcaagctagcgtattgagaaagcagataacattaaatgagaaagaattatgattgattgagaaaataaagtaggtaaataatttaaatggtgaaattaattaacgatgtgatttgttgataggagaagttgttgttatattttaagataaaatttaaaggataaaagttgttatattttaagatggagggaataataattaataattgatatctgttttaaaatatagctacctatacatgatgagatatttcctaataatatgaatctgaacaatatgaaaaatgtgctatgttttaggatggagatagtagctagtttacgattatgaactgagctttttgtgttatactataaaagattgtatatagttagctctcccggccaagttgcccacgttgctcacgccctttacttttaaataataatttatctctactattataaaaattaaagatatttctactaatactttggtacgtcgttcgtatctgagtcgatttttaagttcgttcacttttgaaaatatataaggagtcgtataagaaatccttttaaaaaattcgcatgttaacttgtgacgagagtcaaactcctaattgctttagaattgaccatcatcccaataaaagttccaaattatatatcaatattatcaaaaaaaaatctcatataccttctggacaaaaaaaattctgacaattatataaataaaatagcctttacccgttgcaacgtacgagtatttttctagatagtagaaatatgataaattataagtcatgtttaaagtttatttatgataaaatatgttataacaaaacaaatgatatttttataaattgttttagatagaatgaatgatcaaatatgatgtcaaaaatcaacaatgttaaaaaacgaaggaaacaataagttcattactacagtatgaactgacttttgggtcaacggcactagctacactcgtcaaaatccactagatgcatggcaaagaatttcggtacccggttccttttgtctttatatgatacttcctcagttacaaatgatcatcatattattaaatattaaaacttttaaattgatcatcaaccctagtcctttatttaatatgcagtattattgtatttgtggatacaaattaattaagtatgcatatatgcaggggtagttaagcactgtttctagtgcatcccgggagttaaaattaaagtcccatatttatggattttacctcaccatatactcaacttaaatgaaattagttatatcaccgtgtatagcaaattatttatactatgtatagatatatatatctagtataaagtggggattttttatccatctacatttttttattattcttctttagcgaattttctatcatctaaccaccttttatttttttacttttctatttttatcgaattttctgttttgttgggatcgcacaacaaccacctttttctttttcttttttttttagcgtgagcgagcatttttttttaaacgtgcgctgcgtgctgtatgagccagggatgaaaaggaggatgcctgtgcttttatgacagtaaagtaaagatacggagaaaataagcttagctttactttttttttatgatagaagagatatagagaaaataaatttagttttccttgatgttggtgaaagaacttatacaataattaaataggaacgacggagggatggatggagtatattattgattatatgattatgtgataacattttaagagtaggaacgaataaattacttattaaaatttatcgaaggttgctttaaaatactatataaaaacttatgtatagaattgtttgcaccgttcaagtagcttttgaagcatgtcaatggtaatctgtattatgtaagaagaaaagaatggttaagtatttaataattttggatggagatttactaataaattactgtcttaataaattgtatatctttgtatttttgtggatcttaaatgtgtaaaatcatcttttttttgttttcatggtgttgaaattggttttgagccaagaactttgaaaataagtgaatgtagtttcttttgaagcaaagaccagataatatccattatcagaaaagtccctattcttttgtgctgaatgattgaataataaatggtttgtaataaacatttgaggattaaaaaatattaaatattatgaaagttgaaaaaaatgttttctaagaaattcgtatataatttttctgtgaaaattgtattatttaggagcctagaaaatgtgcgcaatcagccattgatcattctatttcttgaaaaggaataggccataggcagaaatatatataccagaggttatatatacaattcacagttgagtaatgtttccgcgttcatcttcgatgacataagagcgaacaataataatgttatatatggaactagctaggtaattaagctaggtagcagttatgtagccttttgtcaacttcgaatggagattcacaaatagaattcaataattatgtgctgtttatcttgtgttggcgtttacgagtttgcgttcgctttatgtttggaaaagttttttttttcaagttctctttaagttgcactcgttttgagtgatttaatgtaataattggctgtaactcgttcgagcaaagatggatttctattccattattaaaagatattatgggacttgtggtcaagtcaagtcatacaaatattctagacggtaactttttttttcctttttggcgaggattttagacggtaattgataactcataaattatcattagttaattaactagtaccaataggtagcagtataaattcgttattcctaccactcaactttcgggtcctttccaattttctttttgagagaccagagctggactcgcgatacgaactgtgcatttttaattgcaagtccaaatttaattgcgcgtcgacgaagcccacatatatgcaatttgtaaaaataatattggaaatgaataagtagttgaactatgcgacgaccatcgaataggtaattacttagatccacgacattgtgaccaaatttatcaacttggaaaaaaattgctactatatattcatgacatcagatgctttgcataattctaaccgtgctaattaagttgtgatggtttctgtcggcatctctccgttcgctccaattccggccagcacatccatttcttgtgcaactcatggccggaaatctccagcgacgcttaggttcggcgcagagctagggggctttctccgtctatatatggcaatacaaatgaatccaaggaaggcgatgatcgagctcaactccaggcaaaggccaaatatattaagggagatggagctggccggagatcaacgccagtcgtcgtggcctccagatccgatatataggtcgatcgccggcgatatatatggacctggaggcagggactatcgatcagtcatggcttctagatcgaggtgacgcgacgattgctagctggtggagcctcacgtgctgccgcggacgatgatgatgcatggtgctatagcctatagcagaggtgatgagacacgcaccgcaccgcctctagagccatcgtcttcccgtcggtgaagcccaatgcaacgcgctagctgtggccgacgtcgctatatagtatatatgagattagaggcagagagacacatgccacctcgatcgtcttctcccccaccgccgcgctcgacgacgccacatcgggtgctcagctgagcttgccccatttgcaccattccccaggaccaggagcacgagcgccaccgcaaatttgtctgagttgaggaagaagctactcctctgtttttaaatattttacaccgttgacttttttaagcacatatttgaccattcgtcttattcaaaaacttttatgaaatatgtaaaactatatgtatacatataattatatttaacaattaatcaaattgataggaaaagaattaataattacttaatttttttgaataagacaaacgatcaaacatatttaaaaaagtcaacggcgtcaaatatttagaaatggagggagtacataactagatggagaccccatactttaatataatttgccacgagacttctgtgtgattaagtgacaatataatatgtttggatttggtctgaataagcaggacactactctagtccaaatttgtataattattttatggtgatgtcatagaggtagtatgagtaagaacaagatcaatagtgcagctagcagcaagctctaaaattttatcatgtcaagtagagtaacttaaaagccaactcatacaacaagcaaactttatagttagctataatctatcttggtagcatacatacattaaataattgtatggatacatcagagagggttctgtatgggacccacataaacacattttttatcgtctcttctggctgcacgtgagcaatacagtttggggcacggtgcaagcgctggcgccaaaacaagcgctcacttgtttctttctctgagattttatttccttaatctcaaattaagctgataagtaagttttggagccagtttaacagctctatacctgctctaagtagttattcataaatattaatgcaagtccattggatgcaaatagtacttataagggcatgtacaatggttgtcaatagtggtatcttagcggtgctaattagaaatacttgttgacatggaagaaaaagaaagagagaaaaaaatcattgttatgcataacaatggcttaacaacgactcttaatcactataatatggaaatatggttgcatgagtataaaaaaaggaaagaatattaataaaataaatattttttaagttaatgattagagcctttatcgtctcaactattgtaaacatatggtctctaaataatcttgtattgtttaagagaccatactcgcctcaaccattgaacgtgccctaatatgctatcgataaatgctacggcaaaggatacgtttccttcctttaattttgggctggcgttgtttacatgtgcttgagatatatatactctataataatacaaatgtgatgctagtatatattgcgattaaatgtacagtaaatagggatgaacaatatacgattttttactgagaagacatgcatgtacctacactatatatatctggatcatctgctgcagaaagagtgagagttaatgtttgtcgtgattaaaccattaattaataataattccaggttcagtgtggttaattgagaaagttactactagaaaagaagaagtttgggatgaagcccaggcccaccatccgaaactagtagcggtcagcccgacaaagtaggtagcggccgccatgcgtccatcgatcccccgacgccttcctttgtcccgcgatcccggcggtgctccgtccatagctctcttgcctccgcccataaataccacccgcattggcgttcagctgtatcatccaccagcaataacattatattgcagcaatggcatcctcctcccttctactcgcctgtgttgtggtggcggctatggtgtccgccgtctcctgcgggccacccaaggtgccaccgggccccaacatcacgacaagctacggcgacaagtggctggaagcca

SEQ ID NO: 25521 - DNA, 1431 bp, Oryza sativa
atccacgtcaccggacatgaacgacgagcccatcgctgcctaccactttgacctctccggccttggccttcggcgccatggctaaggatggcaaggacgaagagctccgtaaggccggcatcatcgacacgcagttccgccgcgtcaagtgcaagtatcctgccgacaccaagatcaccttccacatcgagaaggcctccaaccccaactaccttgcgctgctagtcaagtacgtcgctggtgatggtgacgtcgtggaggtggaaatcaaggagaagggctccgaggagtggaaggcgctcaaggagtcatggggtgccatttggaggatagacacccccaagccgctcaagggccccttctccgtccgcgtcaccaccgagggtggcgagaagatcatcgccgaggacgccatccctgatggctggaaggccgacagcgtgtacaagtccaacgtccaggccaagtgagcattttaagcaaggaagaaaccagcgtacgtacgatccggcgcggctgcctatatatatatatatatatatatattatatactatatatgtgttgctgcatgcttgcatgcatgcacatatatatccagagaaatattttttaaacgaaataatctataaatttctgagctaggattgtggagcatatacacgccagcactataatggcgtctgctctcccatcgaactggccctgtgacaatggggtcatttgtttttgcccacaatattttctgctaaattcattctctgattttgcgtgagattatcatgagaagcagtaaccatgttgtgtatccttttcttcacgtcaaattgcactgcgctatttatttacgctgatttgtgaatgttttgtatggccatcatatcggaccgggaatgcaatggaccagtgcactggcaacgttaattttgggctaatagccaagcctattggacacaactgcttagacctagggagtatatattgctctccaatgcggaggctcgaccttatcctctccctctgtcagtgagtgaaaaagagcagcccctcttttcctccactagatcccctttcttctccgtcttcagtccttttaactatttctaatcaggactccaattggactatattctggcatggtccttgtgattttgctatcgtaaaaggatagtttcgctgaaaggttaattaaaatgctatcctaaactaaggggtgttcactaaaatgctattttaggtcttttgggttaatactaatgtttttgctctatttccaatttgtgttgtgaccaaactacccttgccttaggttaatcagatcgaatcgatcgaatccagtcggcttcggcgcattgcgttgactgaggactgaggagcagcggcgacaccgtcgcgcatccggcatcgggtccggccccggcgccggcgccgg

SEQ ID NO: 25522 - DNA, 24993 bp, Oryza sativa
  unsure (1)..(24993): unsure at all n locations
gccggcccccgccgctcccactcctgctcctcccctccctcctctccagtccactcgcgccgccgcctccatttgcgtccgccgccgccgccctcagtcagcgccgcatcgggtccttctccgacgccggacccccgccgctccctctcctgcgccgtagtccgtcctcccgccctccactccctactcacacgggtgcaatacagagaatggcacggctgcaatacagagaaggagggaaaaggcagcagacagaggtaggggtagtttggtcataacacaaattggaaatagagcaaaaacattagtattaacccaaaagacccaaaatagtattttagtgaacaccctttagtttaggatagcattttaatgaaccactttgaagggatagtatttcatcgaaaccatccttttacaatagcaaaatcataattttctctccttttaactagtttcaatctcgttcctctccccgtgtcttccttcaaaaagtctagtttgcgaatgtgacgtgccagagttccattttcctcttgacagcatgttgaagggttgagcctgagtgggttgatggaccattatgttttttatgctttccttactcattattacttccatttattttcttaccaattttatgacccaaaagtagcatactagtaacttaaatatttatttttgtacaaattataatttatgataaaatgcttcgtagcataaagtttccgggtataaagtttttattccatcataaggtgtcctagtataaagttgttattccaccatgaaatttccaggtataaagcttttatcccatcataaagtctatgagtagaaagttgtatagctttggtagatatttgtttgtgtataaattgccaaaaatatttagagcactatagaaagtttggagtaaatgtagggagatatatttcatttaaaatgctacaatacgatagaaatatggtttggttaaaaaatacagtaagtatctttacaagtaaatttgtacatatcacaattgtcctaatttcactagcgaaaatggatagaatgtgtggttctcttctaggggcatcgtaagcgaacatttagctggctagtcacactagccatagtaggctacctcacaaccaccagcatactcatttcattaaaaaaaggctacttaggagtagatgtgatacaatctaatgtaacgaatctagacacaatctagtataactaatctggataaagtaataatactagattgtatcacattttctcatatattgatttttttagaaacagggacttagagggagtatagtgtggttccctgatccctagcttcccaacactgatcctccgtgacgcggaggttggtatgactggtggccgcaaaatctgtggtttgttgtgatgcggtcgggcacccactgggtaggatgcggttcttgtagatcctcatttgatgggacattagtcgactaatttaattgtccttcagaagaccctttattaggccaaacgtgtcactttgatggtcgtttgtggaccgatcgaccttgacgctctaatatgccttagtggacccaacaatagtaggcaaaaaagtggcgctctgataggccattagttgattgaggatttttttttggattgcttgaaaacttccgcccgttttttttttttgcctctaaaactttaagatttgtggccatcggattgtattaagatttgtgcataaaggaaaaaaaatgctgaaacagaattttcacataggtcacacgtaagatctcggtactagacaaccaaaccataattgaatacaagttttatataagttatatcatagttatagtgtagttacagtgttgttacagtgcagttgtagtgtagtttcactaaaaaaacttgtaacagttttttagatactccctattatttttaaggaattgaatttcacgttgacaatcccttagaattgaaagcgtcaaataatttaatatcaaaattttctgatcgagaattgaagactcgatcatgggcccaggtaggagagcagacaccatagaccgatagactttctgctcactccacaaacctagctctattttttaaatttaaaatacatttttttccgtcccctgtgtgcataggtagctagacaacggaagaattccatgcaggcttagtcgacttggatctctgatttgtagagagcgttggccttccaattatcggggatgacgtcgttggcgacaagcttctggtcagactcggtggtgacacggagggagaaggggcccttgagtggcttgggagtgtctatcctccagatagcaccccatgactcgttgagtggcttccactcctcagagcctttctccttaagttccaccttcacgacatcaccgtcaccaccgacgtacttgacaagcactgcaaagtagttggggttggagcccttctcaacgtggaaggtgaccttagtctcaccagggtacttgcagcggacgcgacgaaactgcatatcgataattcccgccttgcggagttcctcatccttgccttccttagccatggcaccaaaagcatggccggagaggtcgaagtggtaggcggcgataggctcagtgttcatgtcggtgatgtggatgatgacgggcttgtcggagcaggcctctggcttggaacacttgacctcaaagcaggagccgcagcccttgccatccttgaagatagggtcattgccacatgagttcatgccgaggaagggagccttgtcaatgtccttgtacccacaagcgccgccgttgtcgtcggggccggcaccctttggcttgccgtaccaggtacccctagcttccagccactgtttgccgtaggccgcagtgatgttggggccaggcggcaccttgggcggcccacatgacactgcagacaccatggccgctgccacgacacaggccagaaggagacaagaggatgccattgttgctgatgggtgttagttatttgtgaatgatgtagctcggtgctatggtgggtggtatttatgggcggagacgggaaagccatggatggagcgccttcgggatcgcggaaccacgcgagcgtgaaacgggctcggggatggacgcatggcgagtattagttttgttaggctaagcgccgttttcggatatgatgctctaattatttagatgaaactagaaattgaaagaccaatttttcttatactgcgattagctttggtccctcctttctgttacctagcatgcagctccaggtctccctccctccttaagcatgcacgagtttgcatgctcagccttgcacaacctctctcttctatctaatcactcatttttagttcatacttcatattaaaatgatggagggggcaattagcaaaactttaaattattttttcttctaaattatttatcttatcttttatttgattatgtcattatattttttcaattaaatctttataacaacatcgcacatgattatatttataataaaaaaattgcatgaatatttttttcctaattgaaacatttttatattacatatgaaacatcgagttataactattgaaacattaaaaattatttactaaaacattcgtaaaataccacatgcaacatttatagataaattagtgagacaccacaaaatattgattgaaacatctgaataatacaatgtgcaacattatccctagcaataaaataacttaaaatatgaaacatagtgaaattttagctggaattcgcttcttgtacgtgaaactgtaggggcacctggtttgagctcggtgtaccacgtattcactcatgatcatccaggatttcgatcacgcataaattgataaacatgacaactttcgatgactttttatacaagtttgtatattgtggcgtcctagaataatcttaacaaatgaatggtaaatctcaatatgaaacgaggatgagccacgcaagcaacaaaataatgaccgtctgattcaaacgacgacaatatagggagaaagtatcgtagccataggataagataaatggtaagaaaaaaaacttggggcaaagaagaatctagataagtttagtaaaaagaaaaagaggaccagtccccactgttgggctatcgtcgctgctgcatcatcgatgttgccggctcacctgcacagcaattaacaggacaagaagcgctcaggcgtagagggactgcaggagcacaatgagggaaagatgagtaaactcttcctcagcttccaccccaaccttctgtctggcctagctcgtccattgcagaccagcagctagagaacaagggagagttagagagaactagagaagcctcctcagtaacaaggaaaccggagaaaatgagagagagagagagaggggggggggggagagaaagagggttgtgcagctcacagctccaaagtcccaatgccacctgctcgtgacatcggactcttggaacttttttcattttcatcttagtatattctatcctatgctccactgaaaattaaaagtatttgagcaaatacccccatattattactcacctttttatatcaaagaccttataaatttccaaattacactattgtgtatagcactttacatctgtgattttgtttggcatccttttttaaaaacctacaatgaatactagagcatcgcaagcagcttataattatcttaaactagatcattccacttcttggcgggcacataatttaggaaatttcgtgagacaatgagcaaaattctctaattttggttcacggtaagatttacttattacaagatatatctatttatttataactaaaattcctctttgaacacctattaagcgtgacaaaaaaaataaatttacaaaaatatatgtagcaatagagatggttagaaggacacaactcaagcaacatcgaagagaaggcagttatagttgcaaagatagaaaggagaaatgccagcatataagacaaataaaaaccctaaccatgattcttgcactcatcattttattcagtcaaaatatgtgttgagcatttcaaattacaagcctattgttcaaacactaattttgtatgtacctacggtaaatatatgatattatgataatattgttagtccctttttggaagaatattattaatcccgttaatgctctacaaacacttattcaaacataaggatataaatcaagataaatccataaccataaataacatgtaaacatatttaacaacaagatagtttataatcacgtgaagaggcaacttaataagctagttagagggaaaaaaaagaaaagcaagcaagcagtgagaagagctagctagcttgtatgtgtgctgtagttggccttgggcgaaagctagctaaccgtgcatgcagcgacggatttgaggatgatggcgggtcctctcctttgacactggccaggcatttccctctttgtggacgtcctcccttcttctgtagggagctccataagtagggaggaggcgatggcttgacaacaggggaaggtttggtccaactaagcagtgtggcccaactctgggctcttcatggctggattcaacaaggaggctggtgggtggcggagcgaaggagacgtgagatagtgcgcggaaaagtggttgccgggtagagagcactggcgacagggtagggtcgtctccctagcttgatgtcggccgagctacctcttttctcgtggaaatgttccccttctctatgggatgctctataggtaggtgggggccgcagtacattaacatgggaaggcttcggctgccgaggcgacatcgtccactttcaggctttccttggcaggattctgcgagaagattggtgggcagcggccattggaggcctagcctagcgtgaggggtagtggctgcggggtagagggcgctggcggtgaggcaaagttgtggtcttgatggtggttggactggaagtcggttggcggagggccactgaccagttgcgatggaggccacgtgttacacaagttgagatggtagtattagagttggtgggcaacgtaccatagcgtaaggggtgcatagtgtcccatgcgaagcctagcctagtgattcactgagccaatagcgactacgccttcgggcatggtaactgtcctaggagcattgtcgaggtacccctcttccctcgacaaagatctctaggtgaaaaccatgttcattcctttggacgggtgatgacggcgtcttttggcatcgcaactttcgtgaaggtgtcgttttccgccttggggtgttgttgtagacccggcggtgactgacctcgcatagcggtggccagttcggtgttcgactctcctctctatagcttatgtttgtgcagttggtgtgaggtttcgaggcgtgcgctttgatgcacatccttcctccacaactagttgtcgatgaaaaactttcttgtaactcttttttcctctattttaataacattcggatgacctccttcgatcatcccggcaaaaaaaagtaaaaaaataaatctatagcactcaacgtagattatttctctaattattcagaggtaacactgattttgcatcaaaacactaattagtgtagctgcgtcggaagggcacgcgtgcgctagaagagcgcatgcacgcgtgtaggccggtgcagctgcgcgttgctgctcctgctcgcatgggccggctatggccaattaagtatacaactttttatttgtattttggctatacccttgtaaggctctatgcttcccttatataggttgagggcaaggttatagttaggcatacacgactttagtttcttcaccaatacaaggaaatacccaatcggggtcctatgtcatgccttcgcatgcaaggtaactccaatgaccgggttatatactactacatatatcacgatcatggcccacttcctatcttcagtcgaatattcagtctgtgtgggtatccggtactcatgtcctccacactgatgattctctcaagaagatatcaacacataggaggtgaggtttagaactcgacatctttggtaggttttgatatattagattatatccacgtacttctcccttacttttgaagttcactttgaaatttgatgcatccgatgcagagaatttagctatgttaaaagttgacgtatgagctagatgtacttatggtaaagatgccatatgagcaaaattttgtagacaatattttgcaatgatggctcgcgttcgttcatggatgattagatttggtaatactacttaaggttctaaataaatggtatatatgtaatacgagacattataaatctaattgatatagatggaatagacggatgggggctagtttttgaagtaggtaatttcgtctcgtgttattcacgccacctcttgtaagtagtgcttttaaatatagtatgacaaggccgtctggctgggagagcatacaccattatattgttggcatgtatgtgctctactatccaagctcggctagttatttcattctttcattataaattaaaaaaatccactcgatctcgtgtgtgccatatatatacatacatacatacatatatatatatacacacacatatatatatatatatacatacatacatacatatatatatacatatatacatacacatatatatacatacatacatacatatatatatatatacatatatacatatatatatacatatatacatatatacatatatacatatatatatacatatatatatacatatatacatctatacatatatacatatatatatatacatatatatatatacatatatatatatatatgtgtgtgtgtgtgtgtgtgggcgcgcgcgcgcgcttgctgcatgcagcaacacaaatatatataggcagccgcaccggatcgtacgtacgttggtttcttccttgcttaaaatgctcacttggcttggacgttggacttgtacacgctgtcggccttccagccatcagggatggcgtcctcggcgatgatcttctcgccaccctcggtggtgacgcggacggagaaggggcccttgagcggcttgggggtgtctatcctccagatggcaccccatgactccttgagcgccttccactcctcggagcccttctccttgatttccacctccacgacgtcaccatcaccagcgacgtacttgactagcagtgcaaggtagttggggttggaggccttctcgatgtggaaggtgatcttggtgtcggcagggtacttgcacttgaagcggcggaactacgtgtcgatgatgccggccttacggagctcctcatccttgccatccttagccatggcgccgaaggcaaggccgaagaggtcgaagtggtaggcagcgatgggctcgtcgttcatgtcggtgacgtggataaggacgggcttgtcggagcatgcctttggcttggagcacttgatctcgaagcatgagccgcagcccttgccgtccttgaagatggggtcgttgccgcaggagttcatgccgaggaagggagccttgtcgacatccttgtacccgcaggcgccgctgttgtccttgcggccggcacccttggccgcaccgtaccaggtggccctggcttctagccacttgtcgccgtagcttgccgtgatgttggggcccggtggcaccttgggtggcccgcaggagacagcggacaccatggccgccaccacgacagaggcgagtaggagggaggaggatgccattgctgatgatgagtattagttgtcgttggtgaatgatgttatgtagttgggtgccatggagggtggtatttatgggcgatggaggggacagccacagccatggatggcaggccacaggcatagggatcgctcacatgcgcagcgtcgagcgcatgacttgggtcgatgtcgagtcgagctagcgcatgtccagctaacaagggaaagacatcttcttaattttctttattaagggaatgccattatattagtgattgtgacgccttccatttcataatcctactagtattaattatttttattatgaggaaaagtggctaatcaccgtcattggcatcggcgtgggcgtggggcctggttcaattggcaccggttttgggcgagatttatttttaggttcgctctagggtatctgttggaggcctttttttttgtcacactaccaaaatttatcttctgggaatccatttggccttctcttggagatgctcttagcgcagcttcgccaactaacaccccttgatttttcaagccaatcaccaatgaatcgatcgtgttggcctttgttttatggcttattacatctcacagttgggtcgggtctccatccaaactattccctccttccgttgatatatgacgacggttagttgaaaaataaactaaccaacatcatacattaatggaaggagagagtacaaattaacataggccgggtcttcagaacgacttttttctatgtcatgcctaatcatggattgcagatgattgagatagtatgtacatctcttcttagtaaaatcattgcatctccacgacatctaattactattctttttaacgaaacatacacagaggacaatcactcctatgaatggacacacaaagactacgatctatctctataaatacctctgaagacatgcacacaactatagaaatggttttcacacgcgatctcccaaccaaattcgcatgcaagcactactacaggaccccctattggtaccggttggataccaccatagatgctggtttcccaaccgataccaatttgacaacacctttacccgtccacataggtgtcagtcctaaaatggacacctaactgacacctatgcaggttatggttaccggttcttacctcataaccgttacctataatccctacaatcggcacctataatatttgaataaaaaaaagatgcaaactcacacacacacacacatatcggattttccctggcggccactaaagagcaccgccaatgaaaaacattgccatattaaaaaaaaccccgtcagactaaaaaaaaatccaccgccaccttcttctccttctcctctcatcatcctccccctcctctagatccactagcagcctccagatccaccggcggcatcctccttctgtgctcctccctcactggcagcaactccctctcctctccgcctcctcccttctccctctccaagaaccgcctccgcctcagtaagcagtggcgctccggggaggcacagtgatgggcggcctatgggtggcggcggctctcctcctctctgcccctcgcctcctctccctctcccctggcctcccaccggtggcgcatggtctcctcctctctgcggaggcggggcgcaacctcctctccgttgtggccacgagcggcctcctcctcttcgccgctggccgccgcgagcccggggctggatctggctgccgcgatgatgggggtgtctggatcggccgccgtgacaacgggggaggccggcgaggaggcagcgacgacttctccacggtggcgggagggtaggagcgaatctggtggcgggcggtgcttgggcggtcatccacggcgttgaggaggtggatccgatggctgctgccacgacgacgacaacggctgggctcctccaacccccttccctctaccacttggcgaccacggcgtgggattcggtaggcggcggccacggcaaggtgttgtgacggtgggctatgcttgtggccgtggcggccagcggtgtttgcggctgtggcggccagcagcaccgattttgaattttcttttatcccaataattgttatcaccggcggttctctttagcttgattttcactagcggccaggcggccgccagtgaaaatgcattatttccacttgcatttggtcgctggcagcacctctggctgccagcgaaaactatttttgtagtagtgatggtgcatggttctcatccggatgagattaggtaaacttagggtgtgtttgaggagaaggagattgagaagattaggaagatacgcaaaacgaggtaagctattagctcatgattaattgagtattgactattttaaattttaaaaatggattaatatgattttttaaagcaacttttttatagaaaaattttacaaaaaacgcactgtttaatagtttgggaaacgtgcgcgcagaaaacgaaacaaacaaactcactctctcaccctctcgaatgctgccttaaggctctgaatagaagttatatatatactctccccttcctagaaaaatccagcttttgagaattaatctggataagcgtttatgatgatttttttttatgttctagatctagttgatatgtagagaaattgatagataggggccaatatttttatgtaggtaattttgtctcgtgttatttatgccattcgtcttgcttttaaatacagcctgacatagccggctagctgggagagaatacaccattaaagcccaaaccgaacagggtcctcttacaactggaggttgaagcaaacccgatgaacaaaagaagattcagtctaactttaaaaaaactctgccagagacaaggaagggcactaataggcagcaaaaatcttgctggagatgacacctcgtcgttgtggaggaagaagacctcccaccatagagcaaatatgttgcactttttgactcaaacaccagagaaaaaccaaattgcatccttccaaatggcgcaaggcagagcaagctctgattttgagctcaagccagccatggaaggagacagctaggacaaaaaggatgcgtgttggcatctccatcgagctatacaacaaaggagaagaaaaagacctagtatgagataaactcgatttaaaacgggatgaacctgacggcttcccggaaccccccccccccccccccccacatcacaaaccccctcgccgatgaccagcagccaccgaagacggagaagaaaggggatctagtggaggaaaagaggggctgctctttttcactcactgacagagggagaggataaggtcgagcctccgcattggagagcaatatatactccctaggtctaagcagttgtgtccaataggcttggctattagcccaaaattaacgttgccagtgcactggtccattgatccccggcccattttatgggcatacaaaacaattcacaattaagcgtaaaataaatagcgcagtgcaatttgacgtgaagaaaaggatacacaacatggttactgcttctcatgataatctcacgcaaaatcagagaatgaatttagcagaaaatattgtgggcaaaaacaaatgaccccattgtcacagggccagttcgatgggagagcagacgccattatagtgctggcgtgtatatgctccacaatcctagctcagaaatttatagattatttcgtttaaaaaatatttctctggatatatatgtgcatgcatgcaagcatgcagcaacacatatatagtatataatatatatatatatatatatatatatatatatatataggcagccgcgccggatcgtacgtacgctggtttcttccttgcttaaaatgctcacttggcctggacgttggacttgtacacgctgtcggccttccagccatcagggatggcgtcctcggcgatgatcttctcgccaccctcggtggtgacgcggacggagaaggggcccttgagcggcttgggggtgtctatcctccaaatggcaccccatgactccttgagcgccttccactcctcggagcccttctccttgatttccacctccacgacgtcaccatcaccagcgacgtacttgactagcagcgcaaggtagttggggttggaggccttctcgatgtggaaggtgatcttggtgtcggcaggatacttgcacttgacgcggcggaactgcgtgtcgatgatgccggccttacggagctcttcgtccttgccatccttagccatggcgccgaaggcaaggccggagaggtcaaagtggtaggcagcgatgggctcgtcgttcatgtcggtgacgtggataagggcgggcttgtcggagcaggcctccggcttggagcacttgatctcgaagcatgagccgcagcccttgccgtccttgaagatggggtcgttgccgcaggagttcatgccgaggaagggagccttgtcgacatccttgtacccgcaggcgccgccgttgtccttggggccagcacccttgggcgcaccataccaggtggccttggcttccagccacttgtcgccgtagcttgtcgtgatgttggggcccggtggcaccttgggtggcccgcaggagacggcggacaccatagccgccaccacaacacaggcgagtagaagggaggaggatgccattgctgcaatataatgttattgctggtggatgatacagctgaacgccaatgcgggtggtatttatgggcggaggcaagagagctatggacggagcaccgccgggatcgcgggacaaaggaaggcgtcgggggatcgatggacgcatggcggccgctacctactttgtcgggctgaccgctactagtttcggatggtgggcctgggcttcatcccaaacttcttcttttctagtagtaactttctcaattaaccacactgaacctggaattattattaattaatggtttaatcacgacaaacattaactctcactctttctgcagcagatgatccagatatatatagtgtaggtacatgcatgtcttctcagtaaaaaatcgtatattgttcatccctatttactgtacatttaatcgcaatatatactagcatcacatttgtattattatagagtatatatatctcaagcacatgtaaacaacgccagcccaaaattaaaggaaggaaacgtatcctttgccgtagcatttatcggtagtagattatacgtacacgtactaactccgtccccaatataagtacatttgcgagtttccgtgtacaacgtttgaccatccattttatttgaaaaaaaattatgattagtatttttgttgtttttagatgataaaacatgaataaaacttttagtgtgattttttttatttttttataatttttttaaataagacggacggtcaaatgttgaacacagaaaatcacaattgcatttatattgggacggaggtagtactatttgcatccaatagacttgcattaattgtgatgtatccttactaacagtacctctatgacatcgccataaaataatgcgataattcaataaataccattgacaagcgtttaaatccaagaaatgatatcaacaagcgttaattccaagaattaccatcatacaaacgattttgtctcaaaaatgccatcgcggttaggattccttctacccccacgctgttaagtacactgttcatcatatatagtatttaatggcgcgggatagaaagaactctaacggcgatagcatttttaggacaaaaccgtttctacgatggcaatttttgaatttagacgcttgtcaatggatttcttgtattatctctaaaataattatacaaatttgactagagtagtgtccggttattcaaaccaaatccaaacatattatattgtaacttttttaaccgcattagtccattaaacatttgtcatcaattagctaaaacccattaagcgtcctagatacacttccatgatggatcttggacctagtcaactagtacaatatttatattggaacaaggaggtttgcaaacaaggctttactctgtgttcttattttttaaaaaattttctatataaaagttgctttaaaaatcatattaatctattttttaaattttttagctaatacttaattaatgtaatgctaatccttgctttgtttttcttgttaggaggcaagcaggttcccaacgtagataagatagaaaataagatatggctttcacactagggccctgtctgattcttctacaagcagtggataaaattttagatacttgtgacacgcaggtgaattttagatacaagttagatatctaggtggtgtttaaatttactgaagatgaagatgaagataaagatctaagtatttcacgcaaaacgaggtggtaataatgtgtgattaattaagttttaattattacaaacttgaaaaatggattaatctcatattttagaacaactttcatagagaaagttttcgaacgaaacacaccgtttaatagtttgaaaagcgtgccacttttatctagaagtttatccggttttcgttggagaaaagaatagtgcctatatatccaaacgtagacacctgccacacaagcatgaggtgattacttctattatacgctatgttcccatttatcacataatttgctaatatcataaaagttctacgaatttaatactattttttttcttttactgcatcgtactgtgaaattaacattttgttcccatatattttccctttgttgtattcttgtatcctcactcttctccatcttaaataacagtaatgctaactccagttaatgcttgttcccatgcttcgacaacaagctcgtgtgctcgagctctctagtcatctaccgtaacatgtattttgtttaacatatgagtctatctattttgtttttgttaataataactattttaacccatgcttgatgtatccatgttgcttaactagtttgttagaagttgatacaaatttgatttctaaaattatccgagaatactcgatagtaattatacatatagataatattcagttatataaataatccaacaaatatctatgattttatggaaaaactaaaaggcaacgtttggaatgaatataatgttcataatgcactgtaaacttatcaacgtgttcaaatacatatatcttagagcaaatttcataaaactatcaaattatcataaaactatgaatttaatactatttttggagtagatatgctattctcccttcagcggccgtagacgtcggaccctaccaggggcggagccacgtgtggggtagcttgggcttgggccccacacgtggcaaaaattttcaagggagaaacactggaatattgaaatttacgtagaatttgcaaaaaaaaaattgatagctatatggttcagccctagtcttgctaaaatgctgcctccgcctactattgcgtcgatgagccggacgaggaagatggacgcccacatcttgttcgaactacacaagaaagaaagagggaaaaaaaaggaacaataacgagatgaacctgaatatgggaccctttgccggctgccagagacgaaaggaaagggaaaggaggtcacaactcacacgagagattgatttggcctttgggtttggggtcgcctctcaggatggttggagaggcccccgaaagattgcgactcaaagtccattccctcgagtgagatgaattttcgcgcaaagtaagctggatggaagttattggtggttgcatcaactgaaatctcacctcattgctagacatgaatgctccctttgctctggtctggtccatcaacaagtacgttaacgtacgtacctttggcatgcctgccttcacccattgaatgcttcatctttgtaaataccctactccatctccatctccatgttgagcttgagaagatgctacttcttggcccagcggccagaatcttttcggccctgtccttgacgttgatggcaggtactagctaggttaggtaatcctcctatccctcgcacgtgacgtgatggcctccatcttcacaagaggagcgaatcgcatataagctcagtttacatcagacatacaattgatcaacggaatttctttcacaacagctcatatcatcatctgttacagtcagttgcaactatcatcaacacactcgctctattcaggaaaattggcaacacagcaaagaaaaaacccgagtcaacagacctccaacgctccaatgaaataacaaacttacttcactgttccttgatctatacctcatcatcccccccccccccccccttcaccgaaaatggccaaggcaaacaaatctacatcgtctgcaagctgggcgccgaggctttttcggcgagcacttactcaagtaaacaggtggccctgttcggtggtctctagctctcttccaagctgcatgtgcacaaatttcctgtgcttctgcttgttgatcctggcgcttaaccttctcacctgtgattgaaccctgcataaatgcaagtacgattaaacaagataagtatggctaaacaagagtgcttacgcccaaaaaaaaaaaaaactgcgcagaaccgctatcgtgcatctttgatgcttgcctaaagacataagatcatattctttgacacttggactggggaatacaaaatttcttcaaaatatagaagtaattaccagaaaatctttgcagagaaccattgccaccaatcatatgtgactcaatccttctttcttggcctaaatgcattctttcaggccaaacagaattcaacctccttgcgaagtcctccacttctctgcatgttaaaagtaaaacttgtcaggtatgtcagtagtaaatgatgttgaatactctctgcaactttctcaacaggcttaggagagcaatgaacttgaccagatgcaactgcgattattaagcaaaacttctatgaacttgaccagaagcaactgaattatatcatgctgtttttcagctgtgaattttgaactaaccaacttatatatcagcacaaatactaagaagaattgtttttaggggcaaaacatgtaatttgctaaagcataatagcatatgcaaaatagggcgctatagagttttgatgcattggaaagaaaagaacggcgcagaaaaaacagaactgaatgcttgagatgtcatatcctcacctgtcaagctcttcctgcattgcaggatcaagtccatcatcaaggtcagcatcttcaaaggggtactcaacatcatcttgcacatctgagctttggcaaggtgttctagaaatattaccagtacccgcattgaatggaactccacgagtagcttcctcctataagtcaacagataagtaagaacttgactgttctccacacaactactcaacaaaaaacagtgaggacacctaaccttgtttacaggttcaggattagcttttggggggttcttagaatggtcctttcttctcttgttctttttcttattcttagaagctttcccacctccagaacctataaaatggataaacctttatatgaaattgctaagttttttctatatagaaatactctttgagcaagctctttggttgcatgtttgcatctttgcctaaatattgtaaccagattagttaaaatcgactatagaatttgaccctggatgacaacttagtagtttactgattgctcagcgttattcagcagaacaggataatcatggttgaatgagacaagggaaacaacgaagttatatagtcaatataactcactgtaattatacctccatccccatttataaaacatagtatctcatccagtgaccgctcatctttttgctcttcttgtacttgaacatcctgaaacaaaattagcataagattcttaatacatgacattcaaacatgaactacactgctgaatggacaggataaatatcatttcacatggcctacaggcctaatatcagaaagcatactctgatgataatacaacagtttggattttatcatatttaccttcagtttctggcgctcctgtagttctttccgcttctttgcatataatcgattcaacaaacggatcctgggatcatcatttatatttttcaggggttccaatttctcttcctgaatgaatgcaagttccacagtaagcatcaatacatgctgataactataagcagacatgcgatttgtacctctgttaagtcatctggcaaatggaaaatatcacgaatttcctcaggtgtctttccttcaattattcgagcaagtgctcgactggtaagatcaaccaatggctttaattggagactatcagccgccgatgtcagctcacatagtctttctgtatctattctgacaaacttttcatcaaatgattttcgctcctgcacaataaatgtgaccatgatatgataactggagaaatgtaaattcatcaaatgattatttcctcttataacataaagtaaatgcctaagtggctaaaagaattagcatcctctccagaaagtttcccgaagttcataagctgaatcatgccatgatccttatcgataaaaataggagtattaaaagaagcagaattacccttgagactattacttgtaacaaaacaactacgggaataacatggctgttacaggaagcaaaattacataatggtctatacttgcaacaggtggacgcctgaaacaagcagaagagagaaagcagtaaaaagggagttgccagaagacaaaacttaaatcacgacataccttgtttgagcgccctgggacttgatgaaaccgacaatagtcaagaatcaaactcaaacttgtagggttaactctttctgggagagcaattgcatgattttttgatgatcctgttccattttttactatctctcgacatatcatagggcaaaacatggcaacctcctcctccacttgttgtatggaaccatcaaagcactgaagccaaatataactcttcaacgcctgtgagttcacaatgaaattaaattggaaccaaatgaatagctgataaggctggagaacaattgtttcccctccaataaacagaaaaaatagttatgatctagaaatgcataggggtcatacctctggctttattactgccaactcactttctgacattattgccaattccagagaaacaacaaagccgccaatacaatacaccagaaaatttacaagaaactcctttcggggtataacacctgccagtactccaatggccggaaattatgtcgacaaacttttatcctgtacaacaaatcacagtaccctgtttttggtcttcaattggatagtgaccttatttctcttttgattcaacaatggtctttatttatgactaatggaatgaatgatcttgtttagcctacagtacagagagaaacccgagatgcataagttatggcattttggagtacacagggggtaaatagtcacatagaaatgcaatatgacacatgaagcaaaacttttttttaaaaaaaaaaagaagaaagatagagcatccagcttcaaatagagaaataaaatatgcagcctttctacagttgtactctcaaggtagtagcaactaaatggcatcaccaaatgacataaagctcactattgccctttcaaaagtaccgataggttcctaggttaattctggttacactacatagacacctcgacccaataggtacaaacagattcacgctgggtaccatttggcggtatgactaactgatccatatttgaggtccacaggttgagttcattgaaagaattaatcctcataaatgcagaggagaaggcactagtctatgcacttaatcctggtaccgaacatgcatgggcatccagcaaccaaatatgaaatcagatatgcatgtgtaatcaaagcaatgaaatggaaactaggtaatcaaagatacagcaatttgcatccggcgacacgttccccctgtctaatcggcaaaaaatggcctccatttggtcctcgtaaaacacatagctatacaacctaacaaggccgcggctacggcaagaaacttatccattccccggcaagagacaaggtaagaaagacgtgaatcgcaaccaccggagcagcgaaatggggttaaaccctaaacgaggattggcgccgcggagggaggcaaacggaaggcgtgtcgcaaaagcaagcaatccacgaagcccactcgacggcgacggtgtcggctgtcgccccggccaaaaccctaacccgggaaccgaccctacgcacgaacgcaaacgaaggaaaggattgggcgcgggcgcgggcgcgggggcgggggcgtacctcgtggcggagagaaggagaggctggagagggagaaggcggcggtgacggcggcggcggcggcgccggcggcgaggagaggagaggagagggggaggttgtggttttttggttggtgggggtgcgcctgcggtttgggggaagcgaagcgaaatgggggaacccggccggtggagtccttatctatcccgcaacccatcttgggcttgggcctggaattccagcccactgggccgtgggcctcccttccttcctttttcttttttttatatatgtaatatttattatctcacaaaaatatttttcatagtattaatgaccaaattaccacaaaattacatatttaactcggcgtatcacaaatgacacatttcacaccaaatttatcacggaaattacacgtttaagatgaagtatcacaaaactatatgtttattaactaaagtatcacaaaactataagtttagaaccaatttagtcacaaaagcaataatgcttatagctccaacataacaatggtgctagggatctaaactctaaaagttgtagttttgtgataacttaaatattaaacatgtatttttgtgatacttgacctttactagtttcatgataaattttgtgctaaatctgtagttttgtgatacaacgcattaaatctatggttttatgataatttggtcaaaatacctatagttttgtgaaatgtactcacagggaaataataagagggagaagtgccaaactgaggatctccaaacgctgctgcacaggctgcaattgctgtatgtatatcctattcttcatcattttaatctcaagaatagcaatatttatataccgaattgtcccatgatctcaacaacctaccacaaggacaaggatcacaactcacaaaagtggtagccatgatttcagtttgatctcatcaacaggagacactgagacagtagcagctgttgggggaaaaaacgaaaaggaaatagtgagtgacagcgtgatacaaatatggactcgctggtcgtaccgagggtcgtaagtcactagagtatgaagtagcagctcagagggggcaaaaggtacaagatcttcatcttcacattctgagcaaaaggtacacggtatcctttctgcgacaaaaaacctaggaagaaactcaatcaacatcttggagctgaccctgaacgacgcagggcgctcctctcttaccaccggccttatcttgcatgcatggggcatccaaatcatagtaggagtaccttttttttaaattcatgtcctgaactgaacatgaaggcagaacgtcaatgagagatgttgagcagatactaactgctaagggccggggaatgcagttcgttttcgcctgaacattactaccagcagcccatttcagttgcattgaactcttcaaattaaatagcctcatcaggggatttaccatagaacaaaggcatgctcagatcagcgatcgtcggagcttagacgtgtatctggtgacagtggagaggtggcggcgaacgtcgagaggggaggcaccccaccgagaagagcgtagcgacggcgaggacagccatggcgaatcgacaagctttacgtcttgtgtggaagaaagcggaaaactatccagtcgttttcttttccttttctttattttattttttattaaatactgtaaaaaataataacaatataataataatataatagtactgccaagaagcggagcgagggcacgggaacgggagacgggtgggagggattcgtatggcgtcgccggaggagagcgcaatggcggagctgttgagggtcgccgatttctcaccggcgattgcctggtccggtcgatgatgcgcgctgtgtttggcaggagacggtggaggaggaggaggtgctgcggcggctcggcacgggggagaaaggaggcggcgcgacgcctccgcctgcacgggcccaaccccaacgtcgtcatcctctcccaccaccaagtgcctccctccccctgttgataactgattcagtgctccggtatctgctaggaaggagtagttgtttcactctatccacattgttgaatactctcaatgaatgaatattgttggcgcaggccgctcttgtgcggattgttgtcttggcatttttgttttattttataaattttggaatcaaattggtcgcgctgctctttttgtttctgcattctggattatctgaatggagtctctacactgtacaccacacttcagcattattcagtaactgcgcgcgcgcgcgcacgcgcgcgcacacacacacacatacatacatacatacatacatacatacatacatacatacatatatatatatatatatatatatatatatatatatatatatataaacacacaaagctgcctccaatgcaaaagggacagtgtcatttccctgctacaaatgtcctaatttccctttggtgtgatttttgttgaaaacacttgtgtcgcaacagtggattcatcaaaatgtctgcgatgcctgttaactctacttaatttcttttctataaaagcaggtgtccctctataaacacacacacgctacttggcttgctcttgtaaatgcaactgcttgttctctcctgtgtaaaatgacaattggcaaatagcaattactcatgcttcttgacaacttggggtagtaccaccgtagaactagaaaataaactacactgaggattagcctcatgtgaaaatatcttacaattattgctgcagctcaaagagtgtctgagagattccctcttggatagtactactacagggctcatgcctcccccctcattgtgttcaaagcaacggttttctattatttcttctggacatgagacacagatatgagcaatatgagcacagatttggattttactagtgctagtttttttttaatatgtgacgccgttcactttagcgtgacatttgactgttcatcttattcaaaaaaaaaatatatatatgtcatatattttgttgtgacttgttttatcatcagagaaactctaaccttaacttatattttgacatatttgcactaaatttttgaataaaacgaatggtcaaacgttatgtgaaaagtcaatgctgtcatacatgaaaaaacagaggtagtactagtttttttaatgtactgttcatttattaaaataattcttcccaatgtgtgagtttcaatgttcacctgttttaatttttacagttggtttctagtaaaaaaaaattacactatcttgattatctaggtcccatataccgattacttttctaactaaaattgatctgtgtaagatcattttatttaaataaaatagcttcataaggtcaaatttatggttgctgcaggaggacagcatgcttcgaaaattcctgatgaagctcttctcactctgggaatggaacaatatcttccccaagtacaggaacatgatctgtgtcatacttaactccatgtcatgggttacagtatcatctacagttgtgtccctcaccattgcttcagctggccagagatcttccatgatgtccatcgctatatatttactagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25523 - DNA, 696 bp, Oryza sativa
taccaccagtaccgggcctcctcgcgccacggcccccttgcccggttcaccaccattgccggctgcaactcccgccactgatgtggtgggccacctgctgacgccaccagccagctgcggacgtactgcaaccaccaaccgccgtcgggcacttgctgccgccgcccgggccgtgggctccgcgctgccatcgccgtgaggtccgcgccgccgtcccgcaagctccgaactgccgccgcgacagtcctcgctcgatctggccgccggggggccagatccgcctccggtcgccggaaccacctccggcgctgccggatccgccaccctgacgccaatccatcgccgttgccaaccccaccgtcgtcgccatccccgccgccgcctccatcgtcgccattccgaccaccgtcgcccacaccccctcgcccctaccatcgccgtctccacccccgccgtcagccgccaccccgccagatccggccacggcggggcggatctggcggtcgccatcgccacccaccggaggttcccttggccgccagcgtaggaagaggcgtgaagccccgccgccgctgtccttgtggtggcggcgaggcggaggaggaaggtggtcggggggaggagggggcggctaggttcgccacccgagtcgcctctgggggagagcgacgcaggggctcttgctggtggttataa

SEQ ID NO: 25524 - DNA, 11111 bp, Oryza sativa
  unsure (1)..(11111): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggggcgcatccgctctatagctcgtatcttcttggggttggcctcgatgcctcgggtagagaccaaaaacccgagaagcttgcccgcaggtacaccgaacacgcacttatcggggttcagttttatgcgggtggagcggagactctcaaaagtttccgctagatccgagagtaaggtctcttggttgcgcgtctttacaaccaagtcatcgacataagcttcaacattacgtcctatttggctacccaaagaaatccgagtagtacgttgaaaagtaggacctgcattatttaacccgaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggcattgcgcccgaccgcacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttaaccgggacctcgtcgcatgtgactatccgctgcctcggggcggcgggggcggaggtgccaagcctctcgtcgcctccctcgggcttggacgcggcggtgaggtggtccgcgcgctgctccatacaagcaagcgcgactttgaggtcgccatggacagagatggggccaccggggcccggcatcttcatctggagataggcgtagtggactgccgccatgaacttcaccaacgcgggcctccctaggaccgcattgtagggcagactgaggtccgccacatcaaagttcacccgctccgtgcgaaagttggcggatccaccgaaggtgaccgggaggtcgataggacctagcggccaagtgtgacccggcgtcacaccgataatcggctgggacggccggagccccatccccggggccttgatagcgtcaaaggctgcgggggaaaggatgttgagggctgctcccccatcaatgaggacacgccccagcttcacgttgcaaacagtgggggaaaccaccatttcgatctgtcctccccgggcaacgcacggtgggtggtcggtctggtcaaaggtgagggcaacctccgaccaccgcgtccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaagttttgactgcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacgaaagagtgcgagagcttagaagaacacacgtagaaccccctacctggcgcgccagatgacggagcgtggggctcctcaccgggagaccgcgcaggcccccctttgccagttcggccgggggccctgggtgagattctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcggaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcaccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggctgagacgggagcggtccgacccctcggggagacaaagagaagggcggccgtatcaccctcgggcccgaccccccccccccccccccgagggggttaggccgcgtgggtgatcgtgtctgcctcaagtctctaagtcatgatactcccggtcccatgtcaccgacaactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttacaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcataaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgcgcgctcgctcgcctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatatgcaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatacgtgtaccgctcctagccatacccgggacggcagctgcccccgcgccgacgccgtccgcgacctgtcacccaagcgcgcctccggtggtaggccgtacccgcgctggctgtgctggtacgaggggccccgccgtaccagcacggcagtcgatcgccgaagtcggagaagtgtactccagctgctgcctgctgcgccgaaatgtcaaaccggagtcgagcagagctgaggagagagagagagagagaggcagggcgactcttgcgttcgggaagaggcactctgccacgctgcttcaccttcgcgatcccatggctgatcagcaagagaagggtgcaaaatgtctgatccgtttagagcggactgaaagcagcacaccagtacgtggcgctgcaagcgtggatcgtcttcatgtcatatactcatatcctgatatccgtggtggatgtgattggtcaggaggaaaacgacgcatgcacagcttgatactgatacagtactgctagtatgaaatagcatcgtatcggagtaagatactatgagattttattttttaaaaaagtttaattaagatttgtattaattacaaatagccattcaataaaaaatacatagtaataatatatatcatgcaaatagagactttatcaagagaaatcacattagttttgatatatttaactgatttttatataaacttaagcatatatatttacgttatttttcaaaccatcttattttaaataatattttgtagaatcgtaagaatcgtagaatcaggatactatctataatttcgtaatatcgtgtcgtaataaatgaaaattaggatactatattgtttcgacttggtaattacgatacggatcgggatactaacaaccttggatatagtagtgaatatgtcgccatcacccctttcacttacgtgtgggcccacaatgctggcagtgttagtgtttcatcccgaagcaacataaatgtgtacctttagctcagcctaactcagtaagcatccaaaaattgatggaaaaaatggcttataggtggacatttttaggctttaaaatgaatcaaaatatattttttaatattccatggcaacacacgggcaaatcatctagttattctaaagttattactaccatattgtatctgaaaagcactctccttccaatcttaaatattattgcgacataattctcactgtctaaagggagggccgaatttattccctttatttaaaagatcacagttcactcacttaacacgttaatttacatgtctatagataattttcttttaaaaaaagataagtacaaatgcatgtgctcacatacacatgtacacgttgtgcacatcctatatctccgagagactggaccgatatatattgagattgacaaagttataataagtgtcttgctgttgacggggacatcatctatcaaaaaaatataattactcagaaaaatgatcacccatattaaatctggaatttaaattggaatagatataagaaatctaactagttgagttatatttgctggtatttatgaatcttgtttcaagtgaacaaggccacttgagacattgtttttaatttgtttaagtcaaatatcagttctaacaacttaggcagaacaaaaatctcaaatatatgagcaattttgaagcttctctgcagttatagcctggtttaattcctaactttttctttaaactttcaacttttctatcacattaaaactaattttctacacacacaaacttccaacttttctgtcacatcgtttaaatttcaatcaaacttttaattttcgtgtgaactaaacacacactatatatgtgaaactaagacgccgtacgtttggtctaatccatgaaggaaaggagaacgtggttttgagctttcatatgccaaatttgtcactatcgactcacggttggtgtttgaatgtttgttaggccacagcaacagaaaagggccggcaacttgttcgtaccactctagcctagtactccaacaatcttactccatctattctaaaatataagtatttttagatcatggcacggtcttcgagatgctatattgaccaacaatatttataaaagtaagatattttaaataaaaatagttgtatattatgatagtttgtttattgataaatctagtaacatcaattttatatgattgatgttctttactctttttttttttgctattaatagtcaaacttaaaaatgtttgacttatcactgtgctaaaaatgcttatattttaggacagaggaaatactattgagttactactggtattcctagtatttggtaggctagtattcataatttcctccgttttagaatatagcaatttaaaatcagatgagacttattctaatcatataaatttagagggagtatatccagattcatgctattaggatacgttctattcgatattgctatatcgtggaactgcggaagcacatggcaattgccaacagcccaaaccgcgggacacgcaagtagtacgtgcttgactacccgttttttttatgtgcatgcatgtgctgttgtgataaaagcaacgggtgcagatactagaagatatctgcctgtaccattcgatatcttggagaagtgccgtttatatatactccaggcagcatcacgaggtgcttttgtttcttcttcagacgtgcaggcgcaaatgggtgagatattctcgacgcattcattgagccgcctccttccggtgagtgggatatttctgatttctcgtcatgttttgatcactgcgtattcggcatgactgcctaggcacgtcttgcttttcagagcgatgcaaactcgcagatggaagatacacgggtgacgggttacggcccatgtttgatgggaggtcaccatttcgtagctttcccttgtgcgttgctcttcggctgtcacctgtcatgcacctgcatcccggatgtgttcttttccactgaaaacggaagataataggaatacgcgctctagctataatttaatgctgcgaaagttaaaaaaaaacgttctgcatatgaatctttaaggtgctattttaattctattttgttcgtttacttcctctatcccaaaaatcttgatgtttttagattcctcagcaaaattatcttcatgccaaaatgattaaattgctcccgtcaattcgattcagttgccattttatcaagtctacacgcactcatcaggttatacagaatcattgcatgcaattaattaataaattctttctaaaacacattgccaaataacttgacggaatagactagataaggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaatagataaatggtctcacttctccgatcaaatttactactccagcgactttttttattggtagaacggctcgtttgtagggtggatgaaaagaatcatcggttggccatattttctaataagttaaaacaactttattaagaaataaaaattaatttattggtaaaaaattgtatatttgctctgcgacttaaaagccaacataaaaaaatacattaaaaatatcttaaaatcaacttaaattttagcttttgctttagcttattaaaccaattgatagggcttgaaatatacttttaatcatttgaccatttagccatacaatgtttccttccattttattctgtccaaaataagcttaaagtactactatcttcgttctactatcttcgttctaaaatatagtttatttttaacacagtacattattccaaaataaagttatctgtttaatacctatctcctcccttctactattcacaactattttccttcactactccctccgtcctaaaatataagtatttttagttatgaatctggacaactgtgtatccacatttatagccaaaagttgttatattttaggacggaggtagtattttctattctcaaccaattacaaccatcctctaattcaaactatattgtccagattaatagccaaaagttgttacattttaggacggagtgagtaacatttttaatgcctatgtcaacaaaaaaaatgcttacattttgagatagttgtagtcctatgatactagagagtactttctctgttttagaataagttaatctagtactaactccgtcccaaaataattacagccgtggatattcgtgtccaacgttttaccgtccatcttatttgataaatttatgatttttttaaaaaaaagtcagacataaagtactattcatgttttatcatctaataataataatactaatcataaaaaaatcaaataaggcgaacggttaaacgttgaacatgaactatgcaaaactacactattttggaaggaataagttcacttcatgaccctcaaaagtgacccgaatctaatccatgaccctaaaccgcaaaaccggatatcttcacccccaaattattgaaaccggtgcaatttgactcccttggtggttttggagggcggtttcgctgacgtggcgctgacgtggcagtattgactcggtcttctttccacgtggcgcttaggtggcattagaaataaaaaatatgcgtgggacccattagtcattcacacacaaaataaaaattgtggggcccactgacatgtgggccccacatgtcatcctctctctccctttcttcttcctcccttctctctttctttctttttctcttctctccccttcggctggccacggggagcacgagcggctggagctggagcgccggccggcggggccagagcagcggcgg

SEQ ID NO: 25525 - DNA, 6970 bp, Oryza sativa
gcggatggatccgaagccgtagccggcctgtaaaccaccgtgcccccgctcaatctcgtcggcgtcggcgctgccgtcctctctcgcgtaatctctagcccgccgccgcttcagctctcgtcgaccgccaccaatccggcccacgccccccgctgccaggtccagcccaccgccgctcgctcccagcaaacgcccgaagtggagagggagaacagaaagaaagaagggaggaggaggggaggtccgggaggaagaagaaagggaagagatgacaggtagggcccacatgtcagtgggcctcacaatcttgtgtgtgtgaatgacaaataggtcccacatatatgtttttaattgaaatgccaccacagtgccacgtcagcacacagactaggtcaacaccgccacgtcagcgccacgtcagcgaaaccaccctccaaagccaccaagggagtcaaattgcaccggtttcaatagtttgtgggtgaagatatccggttttgcggtttaagatcatggattagattcgggtctcttttgagggtcatgaagtgaacttattctattttggaatggagggagtaggactacagcaaaagtgcatccagattaactgcatcccaacaaatctgatgacgtggaccgaattatgtccccgtctgaggactgagagcccacgaagcaccgagtgcacgacgctattctttactccccgccacgtcatccccctcccccaccccacggcccacccctgtgcccctgtaccaagacaaccactgccacatgttgcgcctcggacgagtcccgccatggccccacgcgtcatccaccgggagaaaagaaagcaacaaaaacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaagagcacgtgccaaaggtaaattactcctccccccgaatcgcggcttctccgctgcaaaatcccgtgcggttcttgtgtgcttgagttcgttggctgctcgattccctcttaaaagattgtgttccttccttgcacgcttgcccccgaccaggcgcgaaagccgtacacgatcacgaagcagcgcgagaagtggacggacgaggagcacaggctgttcttggaagccctgcagctgcacggccgcgcatggcgccgtatacaaggtatgtctcatcgaacagatcgaattttcatggcgatcgatcgcaattgtccgtattcgcctgtgtgccgtaacgtttgtgttcgtctgtgtgtggatgcagagcacataggtaccaagactgccgtgcaaatccgtagccacgcgcagaagttcttctctaaggtcgtacagcctttcgttctcatgtaaacaacaacaaaaaatctctgatctctgccatgaaaaaacaaacaaacgaaaaaaaaaaaaccattggttgtgttacttgattgcccaaagtaagtcgccaatttttcaattttttttcatgggagagaagaacagatgatgtcatgtttttactgcgggttgtttcacagagtttcctgacgctgtgattgcgcggtgctctgcaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaaggtatattctttcgtgggcagcacatgttggacaactttgtaaggcattagttcttccaattttgcaagaatacaagatattccccatcagaaaagcaatatttaggaccaataatttcagtcgagaatttctgacatcactttcagagaaacacaggtttttttagccttttaggtaggagtatctctgaatcaaattgtgatatgcaatctgatcatctgcagttttacatggtattaatttgatctattgtcgccaatggaaaaataaccatacccttttagtgttattggcacccttaataaattctgtttttgtttttcgaatgtgaatttcagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgcaatgtagtctgtacttgtgtgcatcgaatcagcatagatatctggacttggtttcatggtttgttaccatagtacgattttggaccatgtcagagcaggtacaattctagattataaaccatcgataatataataaacacatatcgataatataaatgagaagagatgagaagagataagagtagcgagttacagatttatagacagctgcagcgtagactataagacatagtgtgtgtatgacaggtggaatcaggtggtagatgtgacaaatatagtacaatgaatctggacaaacatttgtctagattcattgtattacgatgcttcacatccacccaaaatctcttatattatgggacgaatgaagtatatgtttatagggtactacctcggtcctaaaatataagcaactagttgggtggccaacgcaattacgcggctagcacccaaacaaaattatatattttcttagtatgattttacttaaaatttattaaatagctatatcattgtcttaagactttgaaagactaaaccttatcatcatcgtgtttctaattatatagtttttaaaagtcataccagttgctaccccttgtgtcatcttcttctttatttgcttgctcgatctaccattatttctattcattctttttggaacctttaaaaattggattttatagtttttagagtttattgtcaagttggatttcatttttataatttctaaatgtcccgtcaaacgttgccattatactcctctacggcccgtccactgtctcttctctttattgtcattgagattttaaaaatcgaacataattatcgtttgggttcattttttactttctagaagtccagccaaaccgtcagcagctttgccattgtactcctctacggctcgcccgctgcctcccttctttattgtcattgagattttaaaatcaaacattattatcattgttttttttttatttttttagaagttccaaacctttaaaaatggacttgtagtttcactttttataacttttagaagtcccatcaaacgatgccactatgcccctctatagcccgtccgccgccaactctttattgttattatgattctaaaaatcgaacataactattgttggaattcatttttttattttctagaagtcccgtcaaccttcggcggctctgcaactatactcttatacacccccgctgcttctcctttttattgtcattgagattttaaaaattgaatatgattatcaatgagttttttttttactttctagaattcccggcaaccgcattactaatttgcttcacggcctgcctaacgtccctccttttaattgtcattaggattctatttggtgttttattaacaatttttatatctcgtatcaaccgccaccactctactcctttataggcatgttacttaatttatctcgtcatatgttttagatggtcttttctttcaataatctttattttatcacaaattttagttatttaaaaattgtattcctaattgatatcttatttttctttttttaatttcagaatttttttaaaaaaattttagttaatatcatattgtattctttgaatgtttttattttttattttcaatttcagttgttttaaaattgtattcctacatgaacttttgtcatgtgttttagatggtcttttctttcaataatctttattttatcacaaattttagttatttataaattgtattcctaattgatatcttatttttcttttttaaatttcagaatttttttaaaaaaattagttaatatcatattgtattctttgaatgtttttgttttttattttcaatttcagttgttttaaaattgtatttctacatgaactttcttttaatttttctaattttaggtattattttatttttattctcaattttaattaatatcgtattaggttcttatatggattcttctttcaatattgcatatttttaatttcgaatttcagcaaattttaaattttattcctacatgaactcttcttttattttcttttgctaatttcagatttat

SEQ ID NO: 25526 - DNA, 30589 bp, Oryza sativa
caatattgcttatttttaattccaaatttcagctatttttaaattgtacttatacttggactctccttttctttttttttctttttcttcgattaatgtgggaatttcttttaatttttctaattttggatattatttttttaattctgaattttaattaatcacgtattgggttcttatatggagtcttctctcaatattgcttttttttaattccgaatttcagctaattttaaattgtactccgatttgaactattctttttttttgctaatttaggattttatttttatttttactcccaattttaattaatctcgcattgtgttcttatatggactcttcttttaatattccctatttttaattccgaattttagctattttaaaattgtattccgacttggactatccttttcttttctaattttggattttattttatttttatttggaattttgattaatccctcgtattgggttcttatatggaaacttctttcaatattgcttatttttaattccaaatttcagctatttttaaattgtatttctacttggactctccttttcttttctaattttggattttgttttatttcatttcgaattttgattaatctcgtattggggtcttatatagaaactattttcaatattgcttatttttaattccgaatttcaattatttttagattgtacttctacttggactctcattttattttattttctttttctccgattaatgtgaaaatttttagcccccagagcgaacgtggtgcctcctttcaaagctgttttaataatataaatagctgggtggcccgcgcaattgcgcggctagcaaaaaaatcatatatttttttaagtatgatttccttgaaatttattaaatagctatctcattgttaacactttgaaagaccaaaccttatcatcctcatcctcatgtttctaattatatagttttaaaaatcacaccagttgctaccccttatgtcatctcattctttatttgtttgctcgatctatcactttttctattcattcttggacctttaaaaattggattttatagtttttagagtttattgtcacgttgggtttcgtttttataatttctagatgtcccgtcaaacgttgtcgttatactcatatacatctcgtccactatctcttctttttattgtcattgagattttaaaaatcgaacataattatagtttgggttcatttttactttccagaagtcccgccaaaccatcagcggttttgccattgtactcctctacggctcgcccgatgcctcccttctttattgtcattgagatttcaaaattgaacatgattatcattggtattttttactttttagaagttccgaacctttaaaaattagacttgtagtttcattttttataatttttaaaagtctcatcaaacgatgccactatgcccctctgcagcccgtccgccgcctactctttattgccattgtaattttaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggattttttttctttatactttctagaagtcccggcaaccgctttacttgtttgctttatggcctgcttaacatccctccttttaatcctcattaggattctatttggtgttttattaacaatttttatatgccgtatttgttagggttacgggttaggcttaccctttactgtcacgtcccaaaacgaccctaaaatacattctctaaattatgcctagaataattaaaatccgtgtgaaagcctccaaaaattaaaatgtgcaaagtaaaagtcaaataaggcttagaggatttttgtatatttcctaaaagcctaaaatatgtaaataaattttagtggaattttcatagcacaaataataattgttaagaaataaacaaagttaaaaaggttttataaaaaaaaaccctaaaaatcccccttccctctcttgggccggctcggcccacttccctccccctctctcctcttccctcgcggcccacacggcccctccccgcgtgcgctgctgacgggcgggtccgcctgccaccctcgctgacgggtggggcccacccgtcatctccttcctcccgccgctcccgccgcctcgcccgcgcctagcgccgccgccgccgcgaatcccgccgcctccggccgttcccgcgtgcaataaagtggggggaaatattccccgtgatcccctccccctttccccccatttttccctctctctctctcgcatacaaacgggcggatttgctcccgcaaatctcgccggcgccattgatggcggccggacctcccggccggtttccttcctctcccggccgccctctcccccttccaaccctatttaaaccctccccgcgcctccctcgcctgtttctgccccttgccgcaccgtctccctgccggaatcgagctcgcgccatcgccctctctctcctccgtcgcagacgacctccggccggccctctccgctcgccgggaccgtctcccgcctcggcgtcgccttctccggcttcgccgcaccgtcaccgtccccgtccaccccctcgtcaggctcgccgaccgccggagcgccgccgtccccgtcgacccaagccgcgccgccgccttcctccgctccggccgcctttttcgtcgtcgccgtcgacctagggtgagccgtggaccgccgcctcttttcccccttcccttcccctctctcggccgctgctccgccgtgcctatggccgccgccggcgaccataggggcgcaggtgccgcctcccgccgaccgcgccggcatggccgccttcgggcgcgccgagtggccgccgcgtggggcccggccgtcagccgcctacgccctcgggtgcggctgacgcgtggggcccacggcgcaggccggtgtgagcccgggagcgcccggtccaccgtggaccgtgaggctgccgcgtgggccccactcccatggacccggtccgcgcgccctctcccctcggctgacgcaataaaccatttttaaattaaaatttaaatgaagaaattcgcaaatattcacttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaagatccgctcttcgtgaaggttgaagccgacgtttgggaaagtgatcaaggcaagtcacatcatccttgaacatattgaatcccagtttataaaattattttgatttaaattaatgcattatcgctttatttaaattcccgcgttatcactgttttatttagccatgcctatttacctttgttatgacctaattattattgctattgttattattaccttgttcaccctagactaaacaaaacccccaactagtaggtaccctatgcatggtaccactagtatgaatttaggtagatgcttcgctgcttaattaagcaacattaggtggttttacaactctagactttgggaatgttcatatcacctagacactatggaatggttggattattgtggaattggattcacacctccccctctattcaaaatcctcaaaatggttttaggctgggctcggggtgcatggttttgattgtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcaggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataacctattcgaatagccgcgccctcggttataggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggtcttgggttaaggcaggttcgtgtgggttcacggccttgattaataatattgcatagctctaggatcgtatttacaaaatagctttgagcaactaagtgtcttttaatgctgtttactgcaaaccctaaccccctatgttataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttttcgtttgtcttcctgtgtgctgggccttcgccgcccatgtaataaattatctatttacacttccgcttgttaaactctgtattgtatcaacttttggtgtaccttgcctcctgggacaaggaataatacacgcacgtaaggaacgcccgttgggttatttccggtcgtgacatttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggccccccggggagggtttaggatcgaatctcagacccaacacaacctccacagcctacgaagccggagcttgcgaggagccaagtcatcgagagctagtcgaatcaactcgactacaatctcgccggatccgacaagttcccttgttctctttgtaacctgtgttttttaccatataatcccacatcaactggattagggctattacctgtcaaggggcctgaaccagtataattcttgtcttttgtttgcttgatgtcatactacgtagatccttgtatcaacgtaccccaataccctctatatccagtctacgggtatcacccgtcgacagtggcgcgctaggtagggggccttggtacttaaggttctactactatgtcatccagcttcgtcgacaacaacgtcagcaccagcctcagccaagtactccctgcttcaacaatgctggtatggactcaagtcggcgaaatcgtcttcccggtttacaccacgacaccgatctcaaccggtcctccaatgaccggagacgagaacgcagtggctacgaaccaaggcgattccatgtcaaaaaatcctctcgtcgagacggagaacggaatatcgacgacatccaagctcaagagggattctgatacggccaaaccttgtccttccgacatgaaccacgagccgacaaagatgacttccgaagccacaaggtcttggtgtcctatccacaaaaccaagaaacacaccttgcaagattgctgggttttcctcaacgtccgtgctgaaattcgcgcctgcaaagaacgtggaattcagcgtacttctccaactcgggatgtctattgtcctattcacaagacaaagaatcaggacctctcgagctgcaaagtctttctcggcgccatgaaagctcagtctcctaagtcatatgtccccatcagggataatgacaaggaacaaggagtgactccaacttcagatcgattcgttggagtaatcgatatcgatcctcacgaaccatcggtcttacatctcctcgaggactatgggtcatcgacaacgagcacgccgcgggaggtattggctatcgatgatgttggcacgtcagcgcacgccaacgcagaagcggggaaacaatcgactactcaagcccagcacatcaggcccgttcaagcgatactgagggaaactccttacgatcccgttctgaacgttgacctcgagcgttggatagaacgactatgggaatcggtgactaacctcagcaacgcgtttgaagaagccgctaccgcagcacaccaggagcagccaccaactggcgaggccaatagtgaagatccggaacggagggaatcacctcaacgagctaccccttcacctcgcggcactggcgatcttcgagatcaaatcaacggccgccgggaagcacgacgcacacgagacaacgtgaatcgctcttgacgtcatgtctcttcacggcgccatgataacggaaatcgaggagactgctcaaacgaggaccgggaccacgacaaccaccacgatcacaacgatcgcgaacgacgggtgccagacaatactggtcatggccgccaccgtatcgacgacgacgatggagatcggcgccgagacaacagtggaagacgacgacaggattctcgagatccaggccgtcatcctcgtaatcgtacgccggaaccaagtgacccatcgtcatcgtcatcatccgcgtcctcctcatcgtcagacagatatccacgaaggacacacgatcgccaacaacccaccgccccaacgctgggtgtagggctttcggtcgttccctacgtgatgtctgatggtctgagagattccgacccggagcaatagaaaagtatgatgggagcaccgacccagaggagttccttcaagtctactccacagtactctatgctgccggagcagacgacaacgcgatagcgaactatttaccaaccgcgttgaagggttctgcacgttcatggctgatgcatcttcctccctactcaatctctttgtgggcagacctgtggcaacaattcatcgccaatttccaaggaacatacaagcgccacgcgattgaagacgacctacacgcgttgacacagaactcgggtgaatcattgagggaatatgtttgacgtttcaatgagtgcagaaacacaattcctgaaatcaccgacgcttttgtaattcgcgccttcaaatccggtgtcagagatcgctacactacccaggagttggcgacaagacgcatcacaatcactcggagattattcgagatcgttgagcgatgtgcccacgctaatgttgtgctaagacgcaagaacgataggccgaagaccgggggagagaagaaaccagccacggacacatctgagtcaagcaagaagaaaaatcgcaaaaacgggaaaatgaaagctcaagcggaagtcctcgcagcagaatacgcaaaccctcccaaacacccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgttgagacgaacgaagagacggctcctcacgaaccggactcagcgtatctagactccaacctccacgtctcacacatcttcggcggttccacaacgtactcctctaagcgagaatacaagaaagtggaacgtgaagtctgctcgacatggcagggggctgcccccaagatgaagtggtctgagcagaagatagagttctcggaagaagaccaccccaagaccgccgttatcccaggatgatatccgatcatggtcgaacccactattcggaacatcaaggtagcgcgagttctcattgacggtggcagctcaatcaatcttctttttgccagcactttggacgcgatgggaattccgcaaaacgagttgacaccaactgatcaacccttccacggaattactccccaatcatcgtccagacctttgggcaagattacatttcccgtgactttcggccaagccaacaacttccgaacagaacagatcacctttgatgttgctgaattcgatacagcttacaacgccatcatcgggagaactgcacttgcgaagttcatggccgcatctcactacgcatatcaagtgcttaagatgccgggaccaaagggaacaatcactatttaggggaacgcaaagctggcggtgcaatgcgacaagcggagcctcgacatggtcgagcaaacgcccagcccacccgccacgactgagccacccaagaaagtgaccaagacaaataagacgccgaaaccagacggcgccatcaagattgttccactctccagttccaaccccgacaagaccgtcaagatcggggcaacactaaacgagaaatagaaactcgcgctcatcaccttcctccgcgacaatgccgacgtgttcgcttggcagccgtccgatatgccgggggtccccaggaaggtgattgagcacaaactcatggtgcgacccgatgccaagccagtaaagcaaagactgcggagatttgcaccagaccgaaaacaagccatacgagaagagctcgacaaacttctcaaagctggcattattagagaagtacttcatccagagtggctagccaatccagtcatggtgcggaaggccaacggaaaatggaggatgtgtgtcgacttcaccgacctcaacaaggcgtgccccaaggatcactttccacttcctcgaatagaccaactggtagattcaacagccggttgcgagttattgagcttcctcgacgcttactctggctaccaccaaatcagcatggcaaaagaggacgaagagaagacagcattcatcacgccgtttggggtattttgctatgttaagatgccattcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcaaaccccgagaagatcaaggcaatcgagaacatgaagtcgcctacaagactcaaggaggtacaaaaactaaccggatgcatggcagcactaagtagattcgtcgctaggatgggagaacgaggacaacctttcttcgctctgttgaagaaacaagacaaatttgtatggacataggaagccgaagaggcattcattgcactcaagtgctacctatcaaacccccctgtacttgttgctccccaacctaatgaagaattattcctctatattgccgccacgccacactccgttagcactgtcattgttgtcgagagagagaaagtacagcgactagtttattacgtcagtgaagctctccacgacgcaaagacaagatacccacagatccaaaagttgctttacgctgtcatcatgacatcaaggaagctacaccactattttcaagcccacagagtcacagttgtctcctctttccctcttggtgaagttgtgagaaacaaagacgttgtcggccgcattgcgaaatgggtagtcgagctgagccagtttgatgtccactttgtgccacgaacagccatcaagtcccaggtactcgccgacttcgttgccgattggactatgccagataacaaattagacaaccaaggcgacaatgaaacatggacaatggcgttcgatggcgcactcaacagccaaggagcaggggcatgatttatcttgacgtctccctccggagatcaattcaagcacgcaatccacctcaacttcagggcaaccaataacactgcagaatacgaaggactactcgccgggatacgagctgcagctacacttggggccaagcgactaatcgtcaaaggggactccgaactagtcgcgaaccaggtacacaaagattataaatgctctaactccgagttatccaagtatcacgcagaagtcaggaaactagagaaaaagttcgatgggatcgaggtccgacacgtctaccacaaggacaacgtcgagccagacgacctagcatgacgtgcgtccagacgagaatcgctcgagcccggcacttttctcgacatcctgacgaagccatcggtgaaagaggttagcggcaaagtcagcccgaacacccccgacattagctcggaggtcaccgaggcagaacgcgccattgccgacatcgaaaccacagacgactggcgcatcccactaatcaaattcatcagcagcgaggagttgcccgaggacgatacagaggccgagaaaataacccgtaaagcaaagatctactgtacggtcggcaatgatctatataagaaagcgccaaacggggtacttctcaaatgcgtctcgaccgacgacagcagacacctcctcctcgacatacatgaaggcatatgtgggtcacacgccgccggtcggacattggtcggcaaagcttttcgacaaggctttttttggccaaccgcccttaaagatgcatgcgacatggtccagcgatgtgaagcctgtcaattccacagtaaacacacaaagctacccgcgcaagcgctccagactatccctctgacttggccattctcgtgctgggggctagatatacttgggccattcccacgaggacagggcggctacagattcctattcgtggcgatcgacaaattcaccaaatggatcgaagcagtacccacgggggaaatcaaggccgacaacgccatcaaattcatcaaagggatattttgcagatacggacaaccacaccgcatcataactgacaacggctcctagttcatcagcgccgatttccaggactactgcatcgggttgggggtcaaaatatgcttcgcctcggtctctcaccctcaaagcaatggacaagtcgagagggcaaacggcatagtattacaaggaatgaaaacccgcgtctacgacaggctcatgtcacacgacaaaaggtgggttgaagaactcccatcagtactatgggccgtacgcaccacaccgacaacgtctaataaggaaacacccttcttcctcgtgtacggctctgagaccatgctcccaggcgagctacaacatcagagtacacgagtacagaagtactccgacaagaaccaggaggagtagagagatatcgatgtaaatcttctcgaggagcatcgggaacgagttgccgtccgagcagccagctatcaacagaccctccgccgttatcacaagaagcacatccgtgcacgcatactttcgatcggcgactatgtcctccgacgagttcaaagccaagcagggcgaaacaaactctcacctaaatgggaaggaccttacacgatcacacaagtcttgcagccaggcgcattcaaaatcgtagacggcgacggtcgtgaattagcaaattcttagaacattgaccaactacgtaaattctatgtatgagtcaataccatccatacctgtaagcacccttacagtattaataaaggctatttctaggcccatattacaatcaacgtgtttcccccgatgatccctcactctgatgacacctagtgttgaaacctgtccttatgtccctttacgccgtctcgacaaggcctctgaggaacctaagggatcttcggctggggacgcccagagccgataaggccttgtcagatcctgtagagacgaaagaccatataagatctggtcgtgtaagagttctcgccgtgcgtattaaccaagccgtgaaatcggaaattaactttccaacttcacggctgggggctaggatcaaagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcatagggtacgagtactaccaagaaggccaacgccagtccatagactagaagatcttctcggccaacgacgacattgaccttgccagatggtctatctccgccggagtccttcgagaacgagcaaaaccctcacgaagatattcgaggtccaggcgcgggcgatgatctcgtaggcaagccaacacgtgccccccagcatatcggctcgatcgatgacactcctgcttcaaggcctcgtcgatacgctttccgattccatcgagttgggcacaggccccattaagccacgagatgtacccggccgccgactcctcgggatctccgcggactactcgaagctccctgcatactctggccatggatgtgcagcaactcttcaagtacgagttaaaccacacctcacgacctcggagcgtttccacagtctgctctttcttcatggccagcatggttctctcgagctctgccacttcaaacttcgtcttccagtattggatacaacgatcttggctagcaaggacaccctcgagatctgctaaacgtgataaccactaagtcaagctatacatctctttcgggatatggctgacctagtcaggtgggcattaaggggtgaagggactactaacctgaggaagtcgtcgccgtccttccctctatatcaaggggttgatccacatggtcaggcgagacgtgtggttcaaactcgagtaccggaattactgccagtgactcgagctgcccgcgctgctggacatcctcgtgatcagtatctctacagaggacaaaagttcccgaggtcagcataccaaagtaagccgggatagtaatcgcacgcacgaaggcggtcagagttcgagttttacacattatctaggaaatacaagaagtcctactcttcaaaaagggggagaacagactcccccagatcaccgacttcttccatcacctccttacgcgtgtcgctggccgccccctggtccaagatctcacgcagatcgagttcaagacgcgacagccttacacacgcgaggacatgacacgccccggtgtagattccgtttgacgtctcctccgcaatcctagccgcatgcttggaggggatttcccccatcgccgtcaccaattctgcgagagaggaggtcagcgaaaactcatcgggattcaccgggatcgtggacgtgacgccgcattccccgacgagctggtgaaggctagtgtaggtgaccctcaacgagccccggatctcagataggttgttcccgagttccgacattcggtcctcgagccccttccgttgtcgctcgttgccggctgccaactccctcatcttcgtgaggtcttcacgggcttcaaccaactcgcacaccagtctgtcagcacgcgcgttcgccgtcgccgcttccgacctcgcctccgcaatctcgcggtcgatgccgcgagcaccggcttcgaggaggcgccccatctcgacttggagctcctcccaggtgaggactgcagctggcagatcacgacctaccgcggggtcgctgactgggccactaggcatcgcctcccggctctcggctacgggcacgacatccgttgaggccacgacgggcgacgcactggaagctcctctagacttggctcgtgcagcctttgtccgcgcctccctacaggacgaccatgagtcagacaataatcgaataagaagcgcggggattcaagaattcatctacttacttctcgccgatcgtcacaatgcgttgtcgtcgtggaggtgggggagacgcgtccgaggcctgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagacacctccttgacgaccttcacttttagagatgacgccacctgatggtccgcgagcggtccgatgacatcagtcaaaggaagagcctacgctcaatcaagtcataaagtgatttcgaaaggagaatgcaggatgtttatcgaatatacttacgttgatggctttatcacgttccgccgcccccttttcacaaaggggcacagggatgtcactcaccgtggtcgggccactgatcatcacttggccgacgcggcgctccacggttttgccgctcagacctgttaatcgagaaccaaccttcgataagtcaagaggaatgcaaacacaagtatgtcaagataaatgcgagaaagataccccgaggagaaacccgggtcgcgtcctctgacccggaatagttataagctggatgggcccgagcctgaagcggctggatccacctaccaacgaagtctgcaacgacttcatatcccgacaaaccccgtactcggagatcgtcgatgatgtcgataaacgactgaagagagggggtcaaggggggctttgcggtccaagacggaatcttatccggttgatcttcgggaaccacaaagacagggttcgagttcttgatctcaagataaaaccacctattcctccacttgctgcgagaagaaggcactggaagggaatgtaacgcgacttcaggccatcccgaagtcggaacccgacgcaaccagataccctgttggattccatccaacacagttcgtagtaaaagcgaaaaagatcaaggaaaggctctaccccaatgtaggcctcgcaaagatgcacaaagatgctgaggaaggcgatggaattggggttcaaatggagaagagaaagaccatagaaattcaaaaccaggagaagaaattcggaaggtggagggagaaaaccgcagagaacataatcttcgatcacaaccatgcgacccaagatgggctgaggattagtacctcatgcttccctctccatggttccacagccaggaagagtgccatcctcctggagtttcttcaacgttgcactggtggaagccgatttgccgaggtccattgctgatcgaaggtcgccggaaaacgagcctaggttgacgaactagggtttcttgcggcggctgagaaggcaaagagttcttggaggtggtgcgtgtataacaggtttggcggacttcaaaatggactcccaaaattcctttaaataggcgcactaccgacggtgcgaattccagggaacagagagagatgcccaccggaaatttctggtcccgttacgcgcggcggttttttggacttcagtttaaaattcgctcgtgaccgttgggcttcaaatggcgtgctcgactacggtctatctccacggtcctcgcaccgggaatgacaacagtctcgacacccgaagtcgcaaatggttgcacgagttcattttaagcagaagtcggggactactgtcagggttacgggttaggcataccctttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggctcccggggagggtttaggatcgaatcttagacccaacacaacctccacagcctacgaagccgaagcttgcaaggagccaagtcatcgagagctagtcgaatcaactcgactacaatctcgccggatccgacaagttcccttgttctctttgtaacctatgttttttaccatataatcccacatcaactggattagggctattacctgtcaaggggcctgaaccagtataattcttgtcttttgtttgcttgatgtcgtactacgtagatccttgtaccaacgtaccccaataccctctatatccggtctacgggtatcacccgtcgacagtattaaccgccaccaactctactactttataggcatgttacttaatttatctcgtcatgtgttttagatggtcttttctttcaatagtctttatttttatcacaaattttagttgtttataaattttattcctaattaaaatattttttttctaatttcagaatttatttttttctaaaaaaattagttaataacgtattgtgttcttttaatgtttttattttttattttgaattttagttgtttcaaagttgtattcctacttgaactctgttttaatttttctatttttggatattattataattttatttgaaattttaattaatctcgtgttgggttcttatatggtttttctttaaatattgcttctttttaattccgaatttcagctaattttaaattgtaatcctacttgaactcttctttattttcttttgctaatttcagatttatttttatttttattctgaattttaattaatctcgtattgggttcttatatggaatcttcttttaatattacttatttttaattccgaatttcagctatttttaaattgtattcctaattggactctcttttccttttctaattttagattttattttatttttatttcaaattttaattaatatcgtattgggttcttatatggaaacttcttccaatattgcttatttttaattctgaatttcagctatttttaaattgtatttctacttggactctcctttccttttctaattttagattttattttatttttatttcgaattttgattaatctcgtattgggttcttatatggaaacttctttcaatattgcttatttttaaatccgaatttcagctatttttagattgtgcttctacttggactcttcttttctttttttttctttttctccgattaatgtgggaatttctagcccccacagcgaatgtggtgactcctttcaaagctgttttaataatataatagatagatagattttttgctgtgaatctggacaactgtttatccagatttatagctaaaaatgcttatattttgggacagatgtagtaattatatatgtattacatattaaataaattgattataaatgatttagaggtatttcctgctatacttgctctaaagataacaactcagataatgatgagctagtggcaagcgcaaaatggaagttaggaggacgaaaatatggttccaaacagaaaagccaaaggctaggatttattctaatagcgctttaagatacgtgcaggccgcaacaccggatcgaccaaaatccgcaacatgatatcggaatccgcctttgcgaagcgcggcggcggtgaggtggtgtgggcacgccaccgtcggcaacgacgaggcgagtagccgaaacggggaggaggaggaggaaacggaggcggagggaggcgcgcaggcgtctgcgccgatcaggtcacggcgccgctctggaccctccggtacgtctcgtctcctctgtcctttgcttttaatctctccgatcagggaaggccaacgcgtccacgctacatactaaccctcgcgtaatcgaaatcagtccaaagaggcgtcaattcctaatccaattcaaacgggtggagaggttaaacctagatcctactccaaattccgcaagccacagccgcacaatccagatgcagtttactgttcagagctggtctctcaaagtctcaacccctttttctgatttttctccatgatccccatcctatccacgccagttcatcgagcagtagcatatttctatctacttctactgtgtcctattaacaatttggcggcagagctgactattcctttatgttcttcatttgggttgcttggagttggagaagagattaccccaccgtttgttccatgctgctgtattttccaaaaatcatgctctcattggcttcccaccatttctgcgcctgatcctctccaaagtgcttccgactgcgagattgaaagagttagttattgcaaaggtaagacatgatgccatcgttgacaactgattgattataatctaggttcttgggggatctcacctgaaccggatgcgcttgatgcacttcttcccaccgggggatgtaaccactgtcgcgtaaaccccgcgctcgatctgctcgatcacaccgttggaatcggtaggagcagtggtggcatctgttccctcggtgcatctggtgctgccgttggaagttcttctgcaattctgatgcgtaaccgagtaattcgccatggaagcaattgaaggttgtgtgcattccctatccacctgcctgctgttgtggtgatctctgttgctcttcgactgttgaaattcgctggtgaatacatttttgtcaggtgggtctggtaattctgcttttagtgattttgcactggcgatgtggctaggcatgattctggagttgtctatttctcaccagccaaaaggttctttgataaaaaatcatgctgcacaattgggcaccccacacaacttatttagaaaaaaaagccggtaaatttgtcaaatggagataggtcatcggttttatacctgatcgatcaaaccttaattatgtctttagcagctttgcacttcgcagcctcatccttggcaattaaccaagtctcctcgacttttcgtttgtacagctgaactttcaggctcttttggcggcactgttttgcaagagtagttacctgcttatataaaacataatttccatctttatcactaaattatacgttgcataccagaacaaacattcagtgaaaacaaataatttaaacagatccacgaaacatgtttattacagagaatatggtatgtcagttacctgctcttgaagctgtttcacttcttccaataatatattttccatcaagtctaattccgcttttgaatcattagcagatttgagcaaagagctggcaggtttaggtgccattgtctcattcattacccgtacaatagaaccagagactgtctgtttattcaatgttgaacaataaggaatgctctctctcacacatctgaattgactggggcactctactaggccccatcttaatgtcctcacatgatctggcacagccaaattctgacttctctgatgggggctttgtgctgatgccattttctccataattgcatttgcttccttgaatatgcgcgccaattttggcgtatatgatcttatttctattggacatacctcatccttttggatcttctgttgtggatctaattttctatgctcctcaactttctgcatttgactgaaacatgcatcacaaacacggtaccttttgctcctatctggtgcaagagctgctctggaaaccttgttattgctgcaggaattgcagaacatggaaccacagttgtaacagttgtgcttcttcctcgtaaagccaaatgttagctggcagttgctgcacacagattggtccttgcttgagagtggcctatgtaaacaaattgccatagtgaagttgaaaccacaagctatactatgcacctgcttgtcttccaaggcctcgaccagagtcgggtagctcctgtcaacatagtcacctaaaccaagttgcccttctgttcctttgccccatgtaaacacctttccattcattgtcaaaactgctatatgtgaagagcctgatgatatctctctgacaaactctgtcttaagtggcccctcaattaaacaaatagatgtgtcctcagacagagggttccctaatcgtccgtgttccttgcttccaatggtaaaaacaacaccggttattgtaagcacaatggtttgtgcttttgcacaggatacctgagcaaaatcaaaatcattgagtggctcaacacaagttggtacaagtttcatctttttgtcagcatgacccagcttccctctatccgcatcaccccatgtgaacagcttcccactaggagcattgctcttgacagtgcccattctttctacaatagcagctgtgtgccatggtccacacgcaatggccttggctcgtacccctttcagggactccacttgtttgggccgagcaacggtcagcgtgtcaccatgtccaagaacaccaaaggttccatctccatatgcgaagagctggccagcagaggatatgatagccgtgtgccaatgaccacatgcaatcttcaagattgagatgccatccaaaggaccaaacaatttatgtgggaaccattggcttctttgatactgatcaccccacaaacccaagcagtgagtcccttcaccccattcataaagttctcctgaaattgaaactgcacaggtgtgctttgctccaaatgcaatagccttcactcgtgtagaggcaagagactcgataattttaggatctgatacactgacactcactttgtgccccaatctcccaccattatccacaccccaggagaagacctctccctgcttagtaactatcgctgcgtgtttctctccacaagcaacgctctgcacatcaataatatgtgtcgtgtttaataaccttggaagtgaaacattggcttttgatacatctccatgatctaaaacattgccaggaacttctccccagacaaagatgtccttcagagaagttgctccatatgcaacatgtaacccctcagatgatttttgtttaggcagttgggtaattatttgctcgttaagtttgtcagcaacttttatatccctgcaactgtgttttaccctattaaccacatcgggagtgaccttttccatgtagtagtctaggtctgaccatgtcctctgccttggagagaagaatggttctgagaaatccagattgctttgcaaaacatttttctgcatcagcctaggactgccatatattgagtgtaccttgatggagaaatcatgtagaaaaacatgtcatttcaactaaaaaggtgaaacacactttgtaactgagaacatagggcaacttatgaccaatcgtaggtcgtatcgctctacttagtttcatgatttgcaagaaaaaaaaagaggtgtcgcttatcatttatgcaaaagtctgtcaatgtggttgtcatttagctgtatcattattgttatatttggataagaactaattagttgaaatgaataatatttcaacacaactagcatgaccatcatttgaaatattacatatttacaatttcctgagcctatggatcaaatcgtgttacttagcataacttaggaaaaatcaaaacacacttgtagttgtggtaagttgcaaaattatcacatagaaatcacagcatgcacaagttatagaatgaacctgtttaaactttcttgtgtcatgcacagcaaatagcctactcctttgctgaatatagctaggagggctatttgtacagctgtttatccgacggctacttgttgagtcaatcaaaagtactggactgcatggaactgatagtaaggttgttaggcctatataccaacattcagcttgatccctatctttgcaaatctgcgaaatgtgatttagaaaaatgttacggaaggtaataatgtgaaggataaaatttacaaagtctaaacaacaggcctagtgagtaaaaataccaagtcaagtgaacattcaccattcttgtagaagactgacaatgagtgggattccttttctggccaatgcagacgtaaaagttttgtctgtaaaatactagaatcctcagaaaatgaacgtgttctatccttaatgatgtactatggacaaagaatagcaatgtgcttgagaaatgaaaaccacatactgtcttatgtccaagaactacacttgagacagagctcaagttcaaacgcttttccctgtctttggaataccacatgagcattttctcatcctgcaaaagaagcatgttaatgttatttagaggcacagcatcttgaattctaatgttttaaaaagataagacgttaatgtgcagtttactcaatctacttatctgaactggatacgttccatgggaactgggaagaagtagatattgcagacctaattttagaatatttaatattcaaacatcataccttgttgtgttcatagtgttacaatcttctctacattacggaaattgaattgctaatttcagaataaaggatggatggtgggagtgcagagagctagatttggagtaatctactgacgtagctgtatgtatggccataaatgttaatctcattgtgacatgtcatctgtttatcagcggtgggaaaacaaggaacatctttgaaaggttgcggaggaacatcgtgagatcttgatatgcagatagatgaaggagaagtggataactgggcggaattcatctaagagttctggtcatggctctgctcaacggaacatggtgaagaacttggaagccaaaacaaactaagtagcatcagttaatttacttggcatgagcttcatgcggacttaatttttatttgtttaattcaagtggctgaatagttattatacttcttccatcaaagttccgtgcattaagtaaataagcctgtaatggagtcattcatgttaaatgttcagaacattcagattaacacaactaaataaatatctcataggcactgaacatatgttttgctacatgtctctagtcgtcactaggttgcatgcgtaatccatgaaagttaatgaataaaatcgatctttagcatgctgctaagcataattacagtaacgaagctactcactgaagatagcctgaatgggcataacttgggcttccctctcttcccacatttcaggagatgtgcacccttcttcagagcaacaagcgcctgaaggaaagaaccagaaaattaaatcgcgtaatggaggaagatgtccttttcaggtttgatgtcttctgttataagtgaaccccaaaaggatacagacaagaaaatgaaatgacattatattaagcgcatttggaactttgggcggccacagaagcaaatgtcatgctcactcaacatcttggaaaaaaaatgacgtgcatatagcttactatatcctgaaaatgaaataatggtgtctaatactttctcaataagaatgcagtgtttattggctccttgaagacaaacaagaagagcaaatccatccaacttagcaaagatgcattgttggaattgtaggagagcaaaagaagaatcattggcataagcatgaatataccacaatgctttaaaagaagatgcaaaagaaaaacgcttcatgttgcatacctgctcgactcctctagctgcagggctcctcccctcaaagctcccagccattgcagccaggaaagacgcagcaaaagaaacggagagcgatgccttgcccctgagctgagctcaagttcaaacctcctttgatcaacagtgggagaaagcaaaagatggcagcaaagtgacagaaagaaagaaccacgcaaggaaagaagcaaagcaagagagaggacggacggacgggggcagagcttgaggacggacggaggagggagaagaagcagcaccgtcactgaaggcgacctgcgcaattcaggggccccggaaaaggaaacggtggcaattttattaactgctgggtttaaagatgagagaggcaggcagtcagtcttcgttcgacacaacctgcagaggtaaatcctgttctcccttttgattctgcgcccctcgctttccgtatattttctcttgggtagtgctagtgcggcatctctctgtagtttgtgacttcgagtgtaccgaacagcagtggcatttagctttcctctgttagcgtgagtaggcgcttcagaaatcttggatttcatgtcaaatctcaggatttgccacaactgcatgccacaagccccggaaaacctggtcactgccttccttttccctagcatctcttcatcagtcggtacattaaactacctcagttttgctgaaaatcttgcataattggatcatccgatctctgattaccatgatcagcatttctcaaagaatgcatcgaataacagaattactccactaccgtaacaaccttacattgtttaaaattcacgggcatccgatctgtctagggtggccagttaaccatccttggctccttgcccagctgtggtccagaaacgtggtactagtatcgtgatcatgagtttggacgttttagatagtaatgaggttggatttgcagaggcaagcatccacgcactgctgttaggattttgggacagcacatgatggtccgaaagaagagacgatggaggggggtagtgatgcagcacgtgtgcagcgtaggcaggcgctgcccccgttctggcctgcacaactgtttggtcactcctgtctgcaaatgatgccgtctcggtcgcttttgctgacttgatcttgctggggtacgttttttctctccctttttctccaacgagcagcgatcgtgacgtcttcgtagctcataatttcgtattctacctttcgtctccccagtactgtatgtatcagtatcactgcctacaaatgtactatgtctaccggtgctacgtgcatttatgcgctcacctttgctcacgacatgtctattcattgcgcatttatcctattgcagtcgtactgtgatcagttgtactgctggtgctgctttggtcgtgtgcatccccaaggattttctgcggtgtccactgatcaggtaggagttgaattcgtcaccttgttctcgcaaaggttagtgttagtgtttttgcaagggtagattgcttattaacaccagtggtcatggagccatggagatgcttaaggtgacgatgttgttacagctggaagtgaaaagatggatggtggggaagaaaaggtagagaaggcaagtaggcatgtgaaagcaccaacgagacaagcatgacgggccaagggaaaagataaaacttgtcctgcctcctcaacagcagtaaatgtgttgatttgttccccttgcatttcccgtgtagcgtcatggcattggcagtaactcgtggacgatttctctagcgattgttacccgctgttcatgctcaaaatggcaccataatcttatacacagccctactcttgttctgcagctatttgcacttgttctgcacctacggtctcaaaaaaggcatatttgtatgcctcctacacgggtaaaaacaggtgcagcaaatagtaccagtaagtccaaattaacccttttattactgtggatgagacaaaatgtaggagctagctgtctgctggcatgtggagtgactggaaggcatggcatgtgaaacttgtgaagccatacagtacgaagtaggtgaaaaacatacacatcccctcactgggtataaagtttgatttggcctaaattgaggccggtggttgcgctactcgtaggcacgtactacatacatcgggcacggtcccgaataattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactaggatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttcagtttttaaaaccatgatatgtctcgcggttaccacacagttttcacggtaaccgcgcagttaccacggtacgtaaccaccttaccatgggggtgtgataaccgcgccaataacaataagggaaaccctggttgcatgcagagtacagtagtttgagcagcagcatgcatgggaaaggaggcaaacaatgaggtggaaaaggagggacacggatgatggccgcggtttcccgggcacgggcacggccacgcgtgccggacggggcgtgaacagaagccgcgcccgtggtgccgggaaggaacagcaacagcctggcccggcatcgcccgtaaatggagagtttgggtacttgggtgggtcaccggcggctggaccctcgcatgtgcatgtggtgaagaaaatggagtttgtttgtgtggtctctgtacttgcttgtatggttcgtgcgtgtacatgccgagcaccctggttgctcggtgaaagctttaattggatcacgcgataattctcactttacggattgatttgtatataactactccatccgatttcttaattcttgattgatatttatcatgttttagacctgggttaggaggagaggagaaaaggcatcgggtgcatgagaaggaggcggagttctgattgccgtgaaaaaaaagacatacgtattagggaatgacctaatatcaaataattagaaggagtgaggctttaaactcagatcgtatagcccaccaccttgtgaagctagccggaaaacccctgggcgtttctcatttagatcaccaggataccagccaccttcatccacctagcagaaatgaatgcctggtacgagttagggaatccgctgttgtcttcttcctgatgcttcgccttctcaattgaccttctctatgtatgttttggcacgcgctggtgatggtgcatgtgggtagtgggcggcggtggtatcgggagaggaagactgcgacacctgatcttgaacaagctgtcgcctatcactgttcatggcactggcatgcatatcctccaatcctcgacccgtggaaaggtggtgcacgaccagtgtggcacacaggctgtgcacatccaactgtcgtcccacccaatagaccctgacgtcagtctccgtggctccctttgcaccgagctcctgccgtcagtcgttttcattgtcccaccgctaggtcttgcatcaacttaccgctccatccccatggcgcaagaagacctccttatggcccctggtcacctacaccaccatcgcttgtgctattcctcggctcgttatcgaggaggagcgacggcggtgcgcacctcgtgcgagaagcacactactaggaaaaccattttcgcaaaacgagacccttccatttttctaggcgggtatcattttcggaactaaatgtcctcctgtgaaaacggcaacgggggatgggatgctcgtccgcctgtgaagatgcattttggtagacagacgaaaatgcatcttcgcaggcttttgcttacaggtggaccggacggccggtccacttaggaaaaccgttttcatccgctggaaaaaatagttttcctagtagtggcagatacaaggatgggatcccgtacttttgcatttcctataggctaacacctttatcatctctaatcctagcttatagcaacacaattagtagatatgggatggatagctaggtagagagtctccacacaaacaaattttggttgcttgtgggggtgttcccgaggcttagagggataaccgaagtagtggcgaccggcggtggtgatggtgaggccagtgacaactttgtagattgggagagggcaggggatgagtttggtggcaggagaaaagggcgccaaccagttagggctggacgtggtagatgatggcaacgctcgttgctggaggctcggagcgatgattaaccttcttaatcacttcggtcattaatcatccaatatatgtcagatggcgactacaatgcagtgtaacgtaggaagactaattcattaacaaatattgtgtgttcatgtatcaccttatctgacgtgtcttgagtgatcaatgactaaagcgattgacaaggttagtcgtcattcgctatatcagctgtggtgcgggggaaaatctggttgcccaaacaaagctcgtcagagggaggctgtggttggcatccgaaggtccaagaggaattttgattgaaaaaaaaaaaaagagaagtgcacaggtccgagtgaagtccgagtcagacacctcacagtagggcagacgaacgtgggctgttttagacgcatttgtgcgtgtggcccggacacgcgaacattcgtgcattagcccccaacccgtgcatcctgcctgcctgcctgtgcacgttctcactaaagccatgggaccggcaagcgtcgcatcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgag

SEQ ID NO: 25527 - DNA, 7727 bp, Oryza sativa
acctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggcgttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtccgggggcccgcctgcaaatgggcggcgaggggccatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttaggccatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtaagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctgacgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacacgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagtgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcctacctgcttctgactcatccatatcatttctgatgcgtctagtttggcgtcgaccctttttcaccctaaacttagatggatctgaaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttggacctaatacgcaccactgcaatgagcactctctctacgaaccagtaccagctttcagtgatctcactctctacaaatgcaaaagccataggtagaacctggttgttcccatcacacccaattgctgtcaatatctgacctcggtatttacctgtcataaaaggtccatctatgcatagaacaggtcgacaatgcacaaaagcattgatgcaagcacccaatgagaaaaaggctctttgcagcacactctttgctctatcttcaaccgatgtaaatgtatgtaggtcatagtaagcattattattcctctgggcaatggtggctaacaaacgagccaaattatcataagaagcttcaaatgtgccatacctcatctcaatgatcttttgtttggctctccaagcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtttccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatgtttagtgaatataatgaaatttcataggggaggggctgggctttataggggggaggcaaaaatcgccct

SEQ ID NO: 25528 - DNA, 20375 bp, Oryza sativa
ggcggtaggcgactatttccgtcaattttcaaaatggaaaattatttttgtaaaacttttaataagaaaaattataaataaaaaaaattcccacagcagagagcatgccgggcggagatggcgacggcccgagcggcccaagcggcccaagcagcgacatcaccgggcagagcagcggcagggcttggcgcttgccggtgcaacaacggcaaggtcggcggcgcagtagtgggggactgcgggagctcggcggcgcgatagcagaggacgacgggagctcaacggcgtctgggcagcggggtggctcgagcacctcccctcttctttcgaccaccgcggatcaaggggtagcgcggccagcagtgagcggaggtcgtcgcggatcgaggggcggtgtggccgatgagctgcggcgggtgcagatcgaggggcggcgcgaccgacagcaagcggaggtcgtcgcggatcggggggcggcgtggccggcgagctccggcgggtgcagatcgaggggcggtgcggccggcagcaagcgcaggttatcgcggtcggggcagcgtggccgacaaactccagtgggcgcagatcgaggggtagccagcggaggccgtcgcaaaggcgggggccgcgatgagccccgcgacgctctcctctctccccgttggcggcgccgctcctctctctggtgaggtgagcgcgggaaaggggggttatttccctcgctgatgcgaagccacgcccgcgaggctccgccctccacaacgcggcagttcaccctttcttcgccctccgcaagtcgttcgacgaacgaagaacgagcatccatgtttggctacgagaacctcgtttggcttcgcgtaccgctgatgtggcgctgaatattcgtttttttctatggggctgaaggccacgtccttgcactttgaacgccctatgagccatccgatcatgccccaagcctgttcccttcatgctcagttcatgtcatgaatcataccgtcgcatccggtctactccctccgtcttaaaaaaaactcaacctaggagatttctcctaatacaaattcgttctactaggatctcctagcttaatttttttttgatagagggagtacttgcttgtgacaactaatcgttcaaaacacctttaatagcgatcagccgatcaacgcctagtcagtccctaacaattggcttctccaacaaaaatgttcaaaacgaccctgacagttttttttttcttacaatgatactgggggctcatgttcatgaaccacaggcacgccactgaccggatgtgcatgtgcctagatagctagacacggctggtcctagctaagaaaacaaaagaacagggcctaggacttgatgttttttccattttgtgcttttgtgtaacatcctgcatttccttctttatgaaccattcaatttgttgatgaagttcttacattttagtgttgcaaggttcagctccaaccttccacctgtcgaactcagtaacgctcaacaaaaatgagcttgcattccgatgccccccaccaccgtattcctacaaaaagagtcaaacgccaacaaatcaacagccttaaaatagatcattttcagatgctactttacagccttatagatttgatcggaggatgaagtaccttagagatagaagtagtgtcttcctcgttcaaacttctaagacttattttcagcatattgtcattattcaactcaggtactttgtacactacagcgccaatacttctggagaaggtaccattggttcgtgttagaacaacatagcgctttgaagaaacaatatggattgttcatcaacatggagaggttgaacagaaaacttgcctcagatttaaattacgactcttgtcagctagctgatttccaagttcgcttctcaaatttgaaattgcatcagcgttgacagcctaagggtcaataaaaatataattcagcagagcctgtaatgttggtaaaatgcaaacaaagagagtaaaaagtattacggatactgagacattaggctgtaggaatggttgcatgcctctgcatcagtaaagtattaagctataataagagaacctcaaattcgatggcggcgaaccataaagctaccataagtaagctatcttgaaattcaggtgggaatgattgcacaaataaaaaaaacatgcagaactaatggaaaaaagatacgtcctggttatgtaaggatagtggagttgcacaccagatggttccagaacctggaactggaaagctacgtgtaccaaaaaagaccacaggattttttcttgtaatatgtcaaattttaatccctggtcacgaaatatagctactgatccagtttactggaaatgtgctaatttggatcaaacatatagctcatggaccatcataaattgcaacaacagccccatcaaacaagtagtataacagaatttatagacgaatgtagggacgattcaccttcacataatagaatgttgacaaaacatgaatagaatattaatgaacatacaaaataatcaagagaaaaggaaaacctgcaggtatttaccagacaattaccgaacctgccacatcctaatgcaatttcataggatttctccagacattcatcaattaatttttgcttgtgtgacaatgttgcttgtccacgagaaatgacttcctcaggatccagttccagtaactgcaacaataccacttcacaggaagttattggaccaaaacaatacaagctttggatgaaaaagcattttggtatgatggctagctcggtgatttcaatgttttgtaacagctctcgtatagtaggacaacatcaataatcattctgtccaagtatagaaggcactaatgtattttaagatctagactttgtttttaaccaacaattaggctagcaatatataggtttagtgatgcaaaagtggtggtgctagatttgtaccatgaatttttaatgaggatatgctactgtagcagaacactagtaccaagttacttgcctgatcaaacaactttctgttgatattgacatcaaactcaatgtccaaatctttcaggccactgctgaaggccttgctattcggaatggtccatctccacagatccccatcctctataaacttgaaaagcttgtgtacggtttcaagcttgttatcaggtagatatttcaccccattaaaagaattgccacttctatgattccataaactactacctattgtcaagagtttgttgctaaagaaatcaaatgcgattgttgctccactgcgttgcatgtcaatcaccttattgacattttctccgagtgtggggttcccgcataaactttcaaaggcagttttatgatgatccaagattgtgacactgaacaagataaaaacattagaattgtcctagcattagggatagaatattctacaaaacaattcagaatgtatagaaatattgatgcataacttctacaatctacagttcagcaatattcagaacagttgatggccacaatgtgtttccccaaaatattttacagaatatactgaatctactcatgaagtgtacggaaatcgaatctgtatattaaatgaatgacagaatgaacataggctgaatcttatttctaagaatccaagattaacagcataatgcacatgaaactaacacacacagaacaaaacttaaagcaaatagcagtagataaatgcttacaaacctctcgacttttggggcaatatcagtgacaaaaccaggaggcccgacaaagtctaggagataaacatctttgatttcatcaaatggaagagcatcactcctacagagagggtaacagtaagaataatgctatagtaaagagaaacacttgagcatcactgtatctgctgtgcagaggctcatatcatgacaaaatcatcaaacagctttgttcaattttgacctcccattcatcattttcataattcatgaaatattgaaatccgggaaaaaaatgtatatttcacctaggcctgactataccaaacgtcactacagaatagaaaccccaaagcataatctttcccctccaaaaagggacttgtcagaatgccaactagatgcaattttctcccactaaaatacaaagggaaagcttaataagcgcaaagcaatgccaaagtgaacattgagcagctccacagatgttggtcggtctaaacgaactgaaactacagttagacattgtaaaggaagagttgtactcgcttgcagcttcctgccgatttcacatctcttcaaacgaacctatggaggagaagaacattggaagcagaaactagtagttcgaaggcccaaaggtcgatctcttaagttacagaagatttacctgatggggtcgtagacggtgttggggaagaagcagacggggagcgcggcggcggagaagtagaggtgcgcggcgagcgccgcgaacgcgccgtccgggcacgggtagtggtacagcacggccgagaccctccgcgcggacggcgcgaaagccatagcctatcgctatagcacccacctggagatggcgacggcgacggcgacgacggcggcggcggcgaaacgagaggcggcgggtttattcgccggacggtggtggtgggccggtgacttgacgctacgggcctcgtgactgatcaggagaccgagctaaaaccggcggcccggcccagcccacgttcctcgcctggccacagaaccattgccacgtcaccgatccgctccactcgcaacgacgagcttccccaccatccgattcaatccaacggcaatcctccccccacccacggatccatccccgcgcctcccaccacgtcatcaatccacggaaacacaccccaacccatcgcgcccgtccaccaccaatccaacgtcccaaacccacccaccaaaagcgcaaatctatccccaaaaattctcccgcccaaacacaaactcaaaatccccccaaaattctataaaaccacccccaaatccaaatccatctcaccaagagccacagcgatttcagatctccccaagtagtagacttctctcttcttccatctcggattcgtctcggtctcgtctcggtctccggcgatgtctgggcgcggcaagggaggcaaggggctgggcaagggcggggcgaagcgccaccgcaaggtgctccgcgacaacatccaggggatcaccaagccggcgatccggaggctggcgaggagggggggcgtgaagcgcatctccgggctcatctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctgagccctccggtcctccctcgccctcgcgctggccgcctctgccgccgccgcctcctggactggctgttgctggtgttttagctcttgttgtgtccttttgctttgctggtgtagagagacccggatgtgccacgggtgggtttttagtagtaggattagtagtatcccaactcctggttgtgatttgctcatttccatagatgtaatgacattacgatttcaatcgtagcaaaattatttgtttcctgcatttctgatcccgttgctgctgtgatttgagatgtgaatgctgatctgaatttgcaacaaggggtaagctgttgttgaagcacgtacagtagttgagagaatcatctaaaagcaacagaatagtggtagtatctctgtatacgaagttcgaactatgctgcagaaaaaaaacacaacaaagtttcgaattggcgattggttcttgaatgctaatgtgatttcgtgctgatttgtttgtgggaaatggcagtcaaaacgtacgtatttaccatgcttggttggtgttgctactgttagctgaaggcaaataaattgccacaagcccacacaatcttcagtttgatgcttagaaactcggtttattactccatgttgtcactcactcacttgtcagtcttgctcatttccgtagatgaaatgatgtgattctaatccttgcgaaaattaaatttgtctcctgtatttctcatttcgttgctggagtgattcggattttgaaatatgaacgttctttgttctgagatgttgagctgaatttgttgcaagcaatggtgggcttgtttcagcccagaactaggcttgccttttcagcctggcccgtatgtatgaaatgtgcagtacggcccaagcgcccaccctaaaaacagcttggctcgctgcaccatgcccgaaatccatccaaaatacacaaatcttcaaattggtgattgtttgtttctcgcggagactcaaattggtgattggtccgtgagtgctgcacagtttcatactacttcatttcgatttgttcccgcgcgttgggtgtcaaaatgttctctctatttttttcagtatactacagttgatcggcgttgattaccgtcaggcaaagggtaaataaattgtcatcgtcttctgatcgatgctttcgcttgcgaactcctcgagtttattttattacctaattaacccgtcatggtgtcgtcaatgttgccccccagaaatcagaatgatggcattcccgggtttgggcccgaagattacaaccctgtcgcaaaaaaaggacttgctttcgcctttcttatactacctcttgtgtgtgactaggagaacgaacgaatggattcgtacctttgttatcacaggcaagttcattagtagtgtagtactctgttgacttagcggcggataagacttaatcgattagcgcactaatcctgctttcctactttaattaatcacaagtagactctaccagtagtacatttttcccccttgccatagcggctctacttgttttagaatttccgactcctaatataaatcctcaagattttaagaatactatttatgtggggccaaatattgggtggtggtggtgagacagactcaccagcacaaccataagatacatttaaaggagtaaagatgtaattataaaattaagaaaatgaattagaagttagaagctactacctccgttttagtttataagactttctagcattgtccaccttcatatagatgttaataaatctagacacaaatatatgtctagatttattaatatatatatgaatgtgggtaatgttataaattcttataatatgaagcggagaaagtaaaaaacttagtgtattcacacctcacctccaaacaaaaccatggactcattatagagccaactttcattatcatatccatttcatacccaatgtaaccatcaccatatagcttataaattcaagtcgtaggaaaggataagtaccccatattgttgaaaggatatacaacgaagaccaaaagtgaagattggaccacgagttagtggtcaggggggcaattaccaggtcagctgagtcagctttgcacaatcggcatctcgtaatgaagcgcgataagtacacagagaatcatcctcatttaactcttttttttggagactatgtcaataatctcttcttaaattagagacagtctcatctcagctagctgcagctttctttgtgtttctttcactgtcaggagggtaacagtggtgcaaaggagtagcaagttgtttgttccacacttataatagtcgcagattaccggatctggcatattccatcatacaatgacaaatagcatgcatttttttaattatgttttgagaaaggttgcaaatgtacatttgttctttagcaaaaggggacatattttagacaaaaggaaatggatgccacatatggtctgtctttgtcctattaagcttacgtaccatcgatactactgctgttggacaactaaaggctaaagccatcttgccactttgatgcggttctaggcttctagctaaaaagtactaacataatgattaatgaacacatgccgttgctcgttgtgcgtttagtttgtttgataatcaaatttttgtaatgggctttagggcaaagctcatacacattttaagatatatcctttaaatataagagagcagtactccacaagtacgagcagtccactccactatacgagcaacagcggaagaacaagatgggaacgccacgcgcgcaaggtaaatcgaaacacacatttgtagtagtagccgcacagcccgcactatccaagtaaaatccgtagcaggtggactgcacaaacccgcgtggcgcaggcgggaattaatggcaccattgtttggtttatacatgaataaacaaaataacatactccctccgttccaaaataaatacggttttacactattcacgtttaccgtttgtcttatttaaatttttttatgatagtatttttattgctattagatgataaaatatgaatagtattttatgtttgactaaatatttttaaattttcataaattttttaaataagccggacggtcaaatgttgggcacggatattcacggctgcacttattttgggacggaggtagtatttacaaaagaaaattaaaaataatttatgaataaacatttacgtattgttcttaagaatctaaaagcaaaaaatttagaaagtaaatttcgataaaataaccttaaattggttaaaaaaaaattttaactgataggagtactaagcattagcttaggttaaaaagatgtggctgtaaagcgtgtggccctcctccgtttcccccaatcacaagcaacgcccactcgctactactactccactccgctagcctatagcctcagccgcacgcagcagcatcgcgtcgcgtgtggcctccgatgcgcccgcgcgcgcgggaacacacgtatacgcatgtggaggccttatccactctctccccctccccccgttctccggaaaaagaaaaaaaaaacggagagcaagaattcgaacgccgaacccagcggataaaaaacccaaaagaaaagcgataacgccgaatctattttttagtttttactccttcccttccctaccgcgccgcacacgcgataaacaaataaacgaccggtgttttttttcttcttttatctcatccgctcgcctcgcgtacgctctccgctactacttcagttctcgctcgttcttatcctcctctgccagcagtgactcacctcgccaccacggccacggtctcctcctcctcctccacacctttataatttgtaccagctgccttctttccaccagtcgacgacgacacggctcggttgttgctttgatcgatctgagctgcgttcgcttgccttgatctgagatcggcgttggtcggggagagtcaagagttggggatatatacatggacgcgtacgcgtggtgccggcgcggcggcgcggcggattgcgaggagcaggaggaggatatcgggtcgccgtccacgtcggcggggagctcggcgcggtcgtcggggtcgtcctcggagctcgccgacgacgcgagctcctcctcctcctccagctcggcggagcgccgcttcgagatgtccgacctcatgacgcagctcccgttcaagtgcgtgccgtttgctctagctggtcgcgttcttcttgatctttgatgatccttgagctagctgagctgacaccggagtgtttttttttttcatttttttcgtttgcaggagggggttgtcgaggttcttcgacggaaagtcgcagtcgttcgcgtcgctggcggcggtcgcctcgctggaggacctggcgaagccgccgaggaagcgcctcaagccgtcgcagagctgcgggggaggcctggacgcgcaccgcgggcgcgtcctgtcgccgcgccggcattgccccaaggccgtcgtcgccggcgccaagaaggcgaccgcgagggccgccctctcgatgctcgccgcctcgccgaggcggccgccgctggccgcgccggcgaggccggagggggtggcagctaagtttctcgtcgttaactaggtagtagaaagtttggtgatagttgcagtcgaagcaacgtgtttacccgtctgtacataagtactctgaatgaccggcattttcgctgtttggtggtccatttccactgtccgtggtaatttgttgggtgagcttgttgtaacataaatccacgattgatgaggtggatagttagaatgctcaattagaaagtacgcctcttccaggatgtgccttctgagttttgatccaagatgaaatcatgaaactgtcatagaaaaagcacaagggagttttgccaactcaaatttcaaatggctcaaagctgtaacaagtaacccaaaatgaaaatgtaagattaggcgacaacatcacgtaaatcaatgaaagcattagaatttgactagaacttcaggtgaagctgttaagtgggtaagactaacaaacaagttacattgtgagaacgaaaattccaataagcctattgagttcagcacagctctggtttccttctcccatgacaacatacagattacaactccagggtgagaaaatgaaaagtagtatacagcaggttcaccggcatagtttttcaaaaccagcgtggctttttcccagtggagaaatgtaattatcttttgaaaagctctccataggtataacaattcatgtctttcttacatcctgacgattatgagcagaaaatgccactatccaagtcgttcttgatataaaatattggccccctgaacctgaatgagagtcataatctgttcgaaagattcatagtcaaacaaactctcccatccaaatccaaaacgaaataaccttcatccaagaataatttaaatggccggtaaggatttggtacaggatgccaagttcagacagcacggtactcaataaacaggctcagcttctgaaccaacacagcctgtgaaccaaatacaggttttcttccttcactgatccagttcttctccaaacttgatgctttagcatttgcccgcatgtcatgctcaaaggctgaaaccatctgatagatcgaagttcgaataacatcggccatggaaaaagctttagtgtgaagaccacctctttgcgtgcttgcaatggcagttacattgccttttctcccggtggaaaagttagcccacttaatgcttgctggacccagtgagtgcgcaggttgtgggttagttttcttccccaaacaggcctcaacggcaactagcgcagacagcaaagtagacatcacagcagcattgcagcctgtgagttgagcaactccataccgatcttcttggcgtgaccgtgcagttaaagatgacaatgtccgagcgcaccatgtgcatatctacatgtaacaagccacacattaacttttcatcaggaattatcaaacatagaaacatttgaggaactagtctggacgtggtcaacactgttgacaattcaaccattcggaatgctaccaaaatcacaaatttgtggaaacaatactcccttcagtcagcaaaggaaaatgtttggggcttgtttgcatctaccaaggaatgattaatcagtgacttgtcataatactgtcgcaattaacttcctctagaaatttcaacttagcatgcataaagtcatttaataaggggcataggtggccaaatgaccccaaatctttccagatgtcttgcttttgtgaacaaaacgataatctccaaacggtctagtttcttgacaggagggagtttataatctgtatgaacggccatctgatgctaaactaaaaatatgggtaaagcatgacctaattgacccaacatacagaaaaagctggagcagctaacaaatggaatgctattttgcatggttccagatagcaacccaacatacctgctggcagcctccatttcagccatagtcagggtgctacgtgttctagccataacggacaaaatgttcaattatgttgtaaataccaaaaaatattccaactacagaagtagttgcaaaggtactgttatgattttgtcaaataaaacaatgtcttcctaccacaattactagcctgttttctgaagcaaaacatgcttcctaagttaatggtcacctgctaaagaccaaaaccaccaaacttaaacttgctcaattgtaaagctaaaataagaagcataaatggattattcacttccactataccaatgaaatagaatacaggacatccacgtgagaccaatgtatgacagtaataccaagacatcccacacgcccaaatgtccaaaattgctgcaggagagtgcatatgctattgtctgttgcagtgctgggcaattttttttagagaccacaatctcacatgatgatagttaacactcactaaatatccaattatcatccactagaactaaatgtgttgccacaaattagactggttataaataaagtagacatcagcactcacaagctatcaatctcaaaatgaactcctaagatgtctgaagtctgaacacttcaaactatgatactaacctttacaagcagatcttcctggatgcagatctagtcattatgtatgtgtatcactaaccaatgtggtgcagttaagattatagtacgtacatttaattcaactctagataatctgtcatgagtgacaaagcaaaaaacaaacagtaaacaccgaactgattctacagtaagatccaactgtttttggtcttaactcctaaacaaaggaaccatttcatgttctatatcaacacaaatgcaaacatgattaacaatttggaaaaaaaaacaggaaaacagccgaacacaacataagaggtaaaacagatagaagaaactgatgagtaacttacctgtgaatcattaaatgcagcagcaagtttgaactgttgtgacaacaattctggtttctcactagaaaacccttcaagagcttcagcaatttttgacgtgaactcctcaagcggcttcaaacaagctgtcacaattcttttgtaagtctcaccagattcctcaaagaaggccgctcgacgccatggttctaagttacattcagatacagcacacaaatcttggtatgcaagatactgcattagtgatcttggatcactcagttccaatgtttctaggatatactcagtaggattagtctctgcagcagcagtgctctgtggtggagcgaaactgcaccttcttgtatgcacaacctgaaatttgttgaaagcagttgaattatggttatgaactataaagtttcaggaaatgacgtcaatctccgcattccaggcaatacaacaagtacatcatataacatcttttttcctttgaagttggattgtgaagaacaaacctggacaaaatgatgacttatttcccaacagaaggcaacggcagtgctcattataaaaataccgatttgggcgataatttggcttccaatggatcctctgattctgaattgctgaggaagaacgaaaatcaagataaaggaaaggaagaaggcctgaagtgacaccttcagagccctttttccagatggcagaagccccattttcaaaccatagaacggaggtcgctggacaaaaaacaaattaagaaagcaagtaagacaattggcaaaattggtgggaagtgctgaaggattgcaagtaaacaacatgcaagcctaaaaaatcgcaagggcaaaaaaattaaccaaacagagctatagatatcagagaattgcacatataatttagatcaatataaaccatgtctccccaaaaaagatctagatggataaaaacttctctatcaataactatcaaagcaaactacagctcatgcatgtggattctgaatatcgtatattctggagaattataaaacagcgctatagtgtcttatcaaacatgataatcaaatttctcatctgagaatagcacatgtatgtccaatgtatatcaacctgaatattacagaggtgctagcagctattccctaatcatttgatcaattcatgaagctctctagtgggaagtgggaaccagttaaactcggaacaaatcacaaagaatcttagacccaacataccaataatacaagccacagttatcaaaaacatccatgcttagattcaataacaaaaaatcaccagcaccatcaatcatacctaagtaggtaatctaaaatcgtaacaagctaactttaaacctaaaattccgatctctatagtcgcaatacctctattaggagctacagccatttggcaatttgataagattcggaacgccattctagatgagaaccctacttttccccacttcactgacctgcacaacggggaactggagcaaccacctccgacgcccgaaatagtgcgcggcgaacacggctcccaacacagcgccgcggaactccatcccagcaacagccgcccacccggagtcctcgggtaccagcgacgcggcggcgcccacgcagagcgccccggcggcggcgaggagggacgccgcgagggcgcggcgcggcacggggggagcgcgcgggtggggcgacgcggagacgaggaaggcgagcgcgaggagccccgtggcggccagggagaggaacgggtggagcgcgaggaggaggccccggggcacgccgaggcgggcgtggcggcggcgcggggacgcggcgaggtagagcgcggaggccgcggctgagagcgcggcctggaagacgaagacggcgagccaccgctggccgacggcgtcgcgcggggcgccgcgcggcggtgccctgtccatggcggcgggggcggcggcggtggggcgagggttttgggggaggttttgaatttcccctctttatttttctctctttgggtatcgacgcgtttgaagtagggggaatttgggagtttttggtgtgtttcgagtgcccgaggggagatggaggttttccatgtttgaaagcgtgttttctgtcgtataacgtgagactcttgagtgtgacttgacgaccgaagacttgaagttctcatcgccatcgatgagttcaaagctaagcttagtggttaagctaactgcttgtcttgatacatcctggtcgcatagtttaagacagggcccatcgtgtgtgcacgagtgtaccaatatgggttaatacatgttaatgatctgatccataacactagtactttgaaacttccatcatcaattcaaacgcagttacgagcggatccaagaatatctaactagatgacaccccgcgcgttgctgcggaaatacaagagtaatataaagataaaaaattaggtatgaatgattgtattgttatacactgaacacttcaccaatgttataataataagcaactgaaatttgaatcataacagaatacgctgattgtctagtgaaaggccaattccttttactagaactaaggccaattgaacacagatgcaataaattgaatggtactaacatagattgttctattattacaaaaaaaaaactaacatagattgttctatgctatgtagcaagacagaaaaatggtagacaatatacgtcatcgtgattacacaaagatgctatgtaattgcttattccaaactatagttttaatgaagtagaaactttcaaaagttcagtcgaagatgtcaataacctactgaaacaaaaaggtattcttatttattttaaccaactgaaaaaaaaattgttcttattatttcaaccggtatgtgaatatagtaatgcaccaacccttcaattctctctataagatctgcaaccttcacaaagaacagaaagttaagaaatatttgaaactactacttcttttcttctcttcagattctacaactaaacaacaaatgatattagtaagaaaaagaaaaataaatccatgagcaagcaagcaagagagagatgaccaaagcggattgtgcatgttgatctgttgaagcatcagcatgagcagaggagtgggcaaataaatcaactagatgcatggaaagactgccaagcacagatgatcaatcgagaacaaagtcccagtgaattatagagagtatataaaggcatgaagaccgactgttcatctgattcaccggttacaggagataaaataacttcaatggaagattaaagagcttataactgctgggctactacatgtgttgctgttggtattccaactgtatgtttcgaaattaagagatggctaggtgggcctctttaattagttgttgctaaatgtttattttgattgctatccccagttgattgattgattgctatccaaacgtttatgtgcaatccgatggctggaatgaatcaaggtgacgtggcttactctcagaacaaaaaattagttttaattgcacttagtggggatgacttgtataggtatataggataagacggaccgacaaactatacaaaactatagcccccttctaatagatattcccttcgttctagaatgtagcaacttaaacgatgggataagacctatcctagactacaaatcttcatgtccagattcgtatttttagaggttgctatattttataatagagatagtatatgacagaaaaaattaatggagactcaatgattgctcatatggttgcaatatcggtactagtgcttggaaccttacgatctccatggcagatcctacactgacatccgcaattgatatttttaagacatactttggtctttaaaagtttttagtcaactttggattgaaggaaattcaaatgattttaaatcttaggaacttttttctatatgttttgtttgaaacagaattttttagtatatcagtttcatatggattaccatcctatgcactaattctataggaaattttaccaagagctcaaaccttttttttcctttaagaagtccaatgcttgttcttctctctttatctatttttctctcttaattccattagatacctagcgttatattcttgtgaaccgtccaaacgtgatatgtgctagattcctatattttcaattcctgcaggatttgtccatacgtggtattctaatcctataattttcttattgctacaattttcaaatcctacgttccaaatgagcaattaagtttaaacaacagccattaatttatcataagccatgtgtgtagaaaaataaaatttgaaacttttagcttttagccaccctatagcattgccatataatataccccattataagacgttttgaatttggttaaagtcaatttcaagttaaaccaagtttatagataaatatagtaatatataacactaaattagtttcatcaaatcaataattgaatatattttcataataaatttatcttgggttgaaaatgttactacttttttctacaaacttggtcaaacttaaaacagtttgactttgattaaagtcaaaacgtcttataacctgaaacggagagaatagtaaaggtgagaggctgacattgaggacaccaaacacacacagaacgagaaaattaacggtcccatcatttcgcttattcgtagattttaagagaaacggcatatttgcaaatgaaaagtagtttgtgaataaaatttttatatatgtgttcttagtgatctaaaagtaaaagctgaaaaataaacttcgatgaaaaaaccttaaatcagcttcaattttaaagttggaaaattcaagttttggctcataagtataagcataagtgaaaagatgaggtcctaactctttgtgaaaaagtcaatgtgaagtgcaagacatatgagtgaattagggcctgtatcgtagagttccaaattcaaaaatagatctgaagctctgagttaggaaaagacaaatttatccttcctagatccacctactatgctattaaaatttgggaatatgatagtgcttggttagtctctagctctgtgttctttggtgaattccaactttagttacttgtttttcacgcgtacatttttcaaactgctacacgatgtattttttttataaaatattctatagaaatattaatttattttatagatcattagctaatatttaattaattatacgctaaacttccgcttcgttttgtgtgctgcgggagaggggttgggaaccccacaatcgaacacagcctttacatgaccttacattaggggtgaaaacggtaacggtaattcccggccgaccggcgttcgttttcgactttctaccggccgagccatatggaaatggtaatcgaccgaaacaaaaatggaaatggtaaaaaatatggaaatgaaaacagaaatggttttgctgttatactgatcatttccgtatttaccgtattcttgtggaaattatcgtttcttgtaatatggtaattaccgtattctaaatatgtcgatatttatagggcatgtctctacttgacccatagcttacatattgattgactcttcaatcaaatctctaacttttgtgcatgactaaaatggagttaatttataatttatatagtataagtttgaatttatgtatacatataacatacttatgtaaagttaaatatatgtttttataatttaatgtttctgtatttgctaccggtttccgaccctaccatcttcaactttcaaatgtgattaccatcttcaacctctcgaagataatcctgtgcacacacgtttgctagagcaaatctcccaatcaaatccagccgaatctttcttggtaaaccaaaattggtcgagggtttttaatccactcgatctactctttttacccaaaaatcaaagcgtaaaactcggataaaaatgaccaaggaagatcgccgtcatcatcggcacctgtagaacagtgattaaatccgacaattaaagccgaatcaaagggaaaatcatggagaaaatgatgagaggagtgaggaatcgatttttcaatcaaattggaggagaaaacatacaatcgatatggcggtggcgtagcgctagggttcacctcggaaggcgtgcggtgaacagatgagattataaaaccggatgagaaaaacaaaaagctagcgcatgggagaaaaaaaccggcgataaaaaagattgaccaaaaaaactaagagtacccgagaggcgcgcggtgaatagatcggattaaaaaaaggaaaaaaaaaccaaaaaccttaatgtgtgcatataaaaaactcttttgcgtgcaaagaaaaaaggaaaaaaatatcggtgccaaaaaaaccaaacgaacatttttgttttttactgggagattttttttcctttttctacatagtcaagagatgtttttttttactgacgacgacggaagctttttttttaatcgctagttaagtgacgatgtaagcttctttttaaaatcgctcgttaagttggactttcttttctttctttatttacctttttttgagtcggacttctttttctttcttttttacagaagtcggaaatttcttgtcgtagagatatagattaaaccgaaacataaaactaaaaccgttttaaacacagatgacgtaccaaaattctagtaaaaacatcttaaacttttataatagataaagaaaaacaaccctcagacgatcagttgaacaatcagtaaattgcatttcacttgttgggctcctagtaaaccaaacaccctctcaccttttcactagcgaatgcaaccgcatgcgcttctcttctcagaacgatgggtcacacactcacactgagagacggaagggtggatcgaccctacacaccccaactcaaacattaattcgcagacggaatcccaccggtcttgtgcctctacaaatcctcgacgcattgctgcagcctagaaagtagaatcagatcatcacctacacttgcaaagcttccaaccggagccagaaacgttttcgctcgccggacggacgacgacgtcgtgctggtagcgatgagctactactacgacagcgacgacgacgacgtcgtgctggtgcagcagggggcggggacgagatccgcaagggcaaaagatggcaggtacagttcgtggtcgcagagcgagttggagaagcagatgttctcttggtccctcaaagatgtgctcaacaaagacttactcaagaaaaaggtaaccaagcagtagattgttacttcctccgtttcttattataagtaaacctttttaggtttgatcaaatttatataaaaatttaacatcttttacatcaaattagtttcattaaatacaacattaaatatattttattagtatatatgttttgtgttggaggtagtataagtttgatcaaacttaaaagaataaatttcacaaaactacatgttttatggttcaagttgcagaaaa

SEQ ID NO: 25529 - DNA, 6474 bp, Oryza sativa
  unsure (1)..(6474): unsure at all n locations
aaaatatatgtacttaagtgccaagtgtcaaaatgtttgtggttttctgcaacttggactacaaaacgtgtagttttgtaaaatttactcaacttaaaaagattgcatgacctgtaatatgaaatggagggaataactatttatcccatgaactgcagtttgcacacaatctcttccactgtaatggtagcgtacatcgcattatccagcttgttctctcgctgtaatctgagtattatctcgcggatgatcttgccttgatgcaggttaagaaaatacccacaattttctcctcgctgaaagagtacatgggatcattcaccgtgccgctgatcgaagagactcgtgctgatctctgctctgcactggaaggcatcaagcatgcgccagcagctgaagtgaccaggattaagctttgctcagacgagcagctcatatacagttttttcgccaataaagctgatcccaaggacatttttcaggaagtttacgccccaaaggaggcggatacactgttgctgacggatcggaaaccgaggcacatctctgacctgggacgcggtgagaagcccttggtgattgcctcggtgctcaaagccgaggatgctgaaggcaacaccgtcgtcaggctgtcaagtaagcatgttgagcagcagtttggattggaatcgtctctcttcgcggtgttcctgatcaacatgacgacgtacaatcgcatatggagtgaactggatgcggtggttgctagtgtcaggaacactgacatcattcggatgatagtaaattgcaatccaaaggtatgcattaccatgtaatatatctgctccattgcatgcaatttggtgcttatgcatgttctttaattcttacggcaggtcggccaagaatgttcatattcttcagaactgcctttacatctaccggacagagcacttggtggccttgaagatttcaagctcaacaagtcgcaaaaggtggcagtactagactgtgtgtcagcgatgcagcagcggagctcttccgtgcgcctgatctggggtcctcccgggacagggaagacgaagaccatcagcacgctcctgtgggcaatgctggtcaagaaccacaggacactgacctgcgctccgacgaacaccgccgtcgtcgaggtcgcatctcgggtcctcaatctcctcgaggatccttctgctggcagtggaaaagcctgttttttgagtgatgttgtgctgttcggaaatgaggatcggatgaacgtggacggaaacctgacaaagatcttcttggagaagcgcgctcgccgactgcagaagtgcctgagtccaggttcagggtgggtgcacagtctgagctccatgatacggattcttgagcaacctctggttcagtatgattcatatgtggagcaaattgaaagggagatagaagaggatcttgctgagaagaaaaggaacaaaaacaagaacaaggagaatgataaaaagcaggtaaaggaggatgttcctaaggtcataccaataatgccatctatctattatatactaaaagtccattaaacttcctacaaacgctcctaaaccgccatgtggctcctacgaacactcctatatcgtcatgtggcactctaacaaattatagaaattatgaggaaaaaataaaaatccaaccatcagttttcacttatgtcacgccccgaactagccccgaacggaaccagcctgtgacgctccaaattaacctgttaaccgataccaatcccaggaaatagagctggtatcacaggaagacagaatatcacagcaacagaggtctctttattatagagtaggagtacagtcatgttgggctgcggacagaccccgagctcacaactgcattacaaaagaggaaagcagaagccaagacttgaacctaacatcacaggcgcgacttgggaaccagatcgaaaccccaaaactcatcatagccgacttgctcctgaagaactcctcgtcagcggggtccatctcatcttcttcagccactggggggattatttatatagagcaagggtgaatacaggagtacttagcaagtcatgggaattatgtgtttaatgaaggcttcaaaggaaaggctgttgtttttacaattgatttttagttaaactcatttttaaaacaactaagtgagtgcttctcaaacgacacggatgagacagtacatctcgtccggtcagagtatgtgcaatgtatcagtctttgattgattcaagattggcacccggccacaactttcaaatggccacccgggcctagctgatcccgtcagctacagatgttccaaacatcgaacccaaattcccaacagcaatttcaccaagcactagtcgaacaaaactacactaaggaatcaccttacatcggcccatgaccgtgggcacggctgttcgaacagtttaataacctctgcagagggggcacactttacccacacgacattactaacccggatcacccagcccatggagaacagccacgtctggtgaccttaaggctttcatgacaaggcatttcgagagccgacacaggtttaccatatgccgacgagaggggtcccagaccaacaacaggttaggtcctagaccatactatgccaggaagcccaggggtcctccccgacaccaccctggcgaatccacttgtctcccggcatcaaggctcccctgattagctaattactcagccaggggtgtcccattccacccatgtggtcgtacttgttatatgttcagatgaaattccaaaggaatcggtccttaagtgcaagagcaggaaaccgtgctcccggcacgtcccccggtctgcgatttttggaaattcatttagttcgcaagcatcgacccaggcgtcgggtttttccaagtcttttgtaaaacccaagttttacccatcgttggatattttaaatttgaggggaggactccgacgtgcgtgcccgaaggcccgtacatcgaagtacaacagtcgacaaaggaggtttaagtgttcaataattcaaggaggctaattgcagcaattaggatgggggccggtaggctatctcgcaagccgcggccaaatttcttgtgttaatcctatccatgtattatttgcggaaaagaaatacttagatttaaattataggtgcaagatgatcaaaggtgacttgccttgctcgagatcttaagcttgatcctcgaaatccgcgcactctgggtcttcgagctcggaagctacacgcgaacgagacgactcaacaaacagcgaaattaaagccctattattgacctctaagcgtgccattgggtagatctcgagatttgaggatttttggaagttgagcggagtcaaacggatgtacggttgagaagatattgaatttctaagattattggatttttggtctaaaggaatacggatttaattaaaccctttgaaaaagaaaagaaagagggaggaggaacagacttccctcgggcggctagggtgcggcccgagagaaggggcgcggctcggccgagctaatgggccggcgggctcgagaaggcggcccaaaggcacgcacggggagagagggaggggaaccggtgggccgggtccacctcgcgtggtcccgagtgggactcgcttgtcggcggctcggctcaccgtgagtgaggtgcatgtggcgcggcgctagggttggggtgggtgcggtgcacgcgtgtggcttgcggtggacgcggcgcgcaagtggcccacgcgcagcctctcagctctccgtgggccgcgcgcacgcgagcggggacggagggagcggctgaccggggtcggcttgacccgttccggccgagctagcgccgatgtggcgccttcgtggctgccacgcgggccggcgggagaaagacgaaggcgccggccgcgaatggacggcgggaggcgacggtttctccgggacgctgtgcgacgacgagggcgacgaggtgtacactagaatgacaaggggaaaagagagggagcgagccaacggctcggattcgccggagggggctcgacggcggcggattgcggcggcagcaaccggcggcgagaaagggggaaatcagcgatggcgtgacgggagatcgattcgggcgagctagagcatctacgcgactccgggaatccgtttctagcgtcggattggacggaacatcgccgaggaaggccggcgacaggcggctactaccgagcacggcggtgacggcggtgagcctactgcgagcggcggcagcggtcggggcgacgcaggctagctacggggaggctacacaagctactgctcgagtctaaggggaggaggaagagcgaggagggagaacagggaggtgttctaccgagacgagacggggcgctgtgacgagaggccgacggcacgggagtgatctctccggcctcgggccggggaagaggaagaagacgagtgcccggagtccccttccgatcctagcgcgcaccggctcctccggcgcacgcgacagcgaagggcgacgacgaacagggcacggggcgaggcgacaatggcggaaggcgaaagcgagggagatgggtttaggggaggggctcgggtttattgggcggttatgtcggttcgaaaaccgaccttgggcggtcaagccagcgagctggcgtcccggctagcggccaaaacagcgacagggaggatgacgccggtggtggaagagaaaagggaaaaaggaaggaagaaagggggcttgccccttgcttctttgggaaaagaaggagggagagagggcgacgaggcaggaggaggagctctgcctccatcccttggaagctagcgcgcggagtagcggggccgggtcgatgacgacggcgatgacggtggggcggtttggaagggcgcggctacagggcggcagacgcgggctcaggcgcagcaggcgctgatggcggcggcgacttgccggtcggccaccttggcgcgcgcgcgcgggaagcaacgggtggcgcggcgatttgagcggcatcggcgggaagtggcaacgagagcagagagggagggagaagtgaaagagagagagagagtctctctctcgctcagcgcccgagcggcgcacgtgcctcacatgtgcgggcaaggatggaggggagaggagagttgggctgaggaggaaatgggccggggagaagagattggcccacgaactcgagggaggcaaaatagacttttcgagaggatttgatttgggacggatttgagattagggtttggatttcgacaatggattggggaattgagatctggaatggcacggacactggacaacaaacaaggagaaaattttcgcatttaggatttttaagagatagttttcccactaggcgccacgacgaaacgggcgctacaacttaacatggtggacccatcgtttcacaccattagatccatcttatatcaaggaaaaaaaatctcaaaacccattcgtatccgctccatcacgtacatacaccaaactatgtacgtacgcttgtaaaaaaaaaccacgtacgtacgtcccccaccttctctcttttttctccatttatttataggtagcaaattttttatattaaaatattaatattaaataattataatttcttataatatatttgatttcaattatgccatgtgttggtgtgtatatacatataagaaatagaccatttggatataaactcatatcctttatatgataactaaatactaatacatatcatgccattgtaaatgatctaccctctctccttactcactttattatccatattttctagctagcagcttagtatataaataattactatataatgcttattatattataaagattcattaagcagatccccataaaatatcatacagatctatccattatataataatggtccattatacatcctttatagtgtttctagctcatcacatggcacatctaataaattataaaaagtactacaaatactgcggaagaaacatttaatcaatgatttctatttaaatcgataaacctattatttttaacattaaatctatctctattaaacttttaaataaaaaaacatcttttccccttcctccccattcctctcatccacattattctagaaacattcatatgtaaattaaaactacaatgtcaaacaaaaattagaaactcgactattaaatagtgttttgtcaagagacaacatccctactttttttacatgtcatctaaattgacttaataaaatatgaaataattaaaaaaaatcacatatactcataatttatatgaaatatgccttttaccatggtctcattatttttttaccattagatttatcttaatagatagacaaaaagagaaaaggcccaatcccatccctcctgtctagctgtcctattatgttatgtccgtacatgtgcatgtntgcgccctcccccctcatg

SEQ ID NO: 25530 - DNA, 14180 bp, Oryza sativa
tcccattgccctattttcatgcttattagttagatagaaaatatatttcgtgatagaaatttttaaacaactataccatctaaactatttttttattagtgcacctcattagattatttgcagtaaactttcatgagtcgaaatttaaattaactatatttaataagtaaaagaaataaattactttagagcatattttggagactagctattggtcagttataaatatttaggaaaagctataaagatttttaaaccatatgattaataacatgttgcttacattataacaatgtgaaacacttttaagttgttagataacacgtttgtggaaaataacaaataccaacgaataatatttgtggagaaaacatacttcgaagtgtgacagtgctattcggttaatattatgttcttataagtttttgaaacatgcagcccacaatacatgcccgcgcgaatgcgcgggctatcttcatagttcaaggaatacttcataagtaattacaaacggcttgagaatgatcttaatgtttgtgtcaagactttctgtgattatctccccaggtcagctacaactgcagagaatttcagttacatgacccaggccctgcacatgctaaaattttttggtaaacttgtggagcccaaatcagaacagagcctgaaaaccctgttcaaactcagccccgatggcagcatcagctcactgtttcagaacttcgtgacatatgtgcaagatagtgtgagtacagagctgaaggatgctagagctcagtgtcttcagaagctaaaacacctatctgatcactttgaacttccgaacgttttcgacaagcgttcgatagaagatttcctagtccggaacgccaaaagcatactctgcacagcttctagctcatcccgtctgcactacctgccagaagcaagcccgtttgatctccttgtcgtcgacgaggcagcacagctgaaggagtgcgagtcactgatacctctccagctccctggcgttcgtcacgccgttctcatcggctatgaatttcagctgccggcacttgtcaaaagcagggtaagctctcaccatctctattagtagaacattcacaatctctattactatgctatgtaacaattgtctgtttgtttcttcacaggtttgtgaagatgctgagtttggaaggagcctgtttgagaggctgagttcgctgggacacccgaagcacctcctggatgtgcagtacaggatgcacccagggatcagcaagttcccggtctcaagcttctacgagaacaagatatctgacggcgagaacgtattacacagggactacgagaggaagccccttgccgggccaatgtacggctcctactccttcatcaacgtcgatgccggcaaggagagcaagggcaagcacgacaagagcctcatgaaccccatcgaggtcgccgccgtgacccggatcgttcagagattgttcaaaggtacacattgcatcatgcccttgcattctggcatggcatcgctgagctcagatagcttggtttgtgcagagtcggttgacaccgggaggaagctgtgcgtgggcgtggtgtcgccgtacaaggggcaggtccgcgccatccaggagaggctcgggaaggcgtacgagacgcacgggggcttcaccgtgaaggtgcgatccgtggacgggttccagggcgccgaggaggacatcatcatcttctccgccgtgcgcagcaacaccaccggatcggtcgggttcctctccaacgtcaaccgcaccaacgtcgcgctgacccgggccaagtaggttgcctcgatcctcccggccaattacgtcagtcgcacagagagttgatttcactccgattttgttgtttgatccattgttgtttttgtttttgcaggcactgtctttggattcttggcaatgcaaatactctagcgagtagcaaagaccatttggcgtgagatagtggctgatgcaaagaacagaggctgcctctttaacgcgagcgaggataaagaactcaacaatgcgataattagggccgtcatcgagctggacgaagtcgacgacctgctcgagatggactccctgcgtcttagcggctcgcgatttggggtacgtttaaacctgacattttaaacatttattttctttaccatttgatcgtgtcctcttccgtgctctttcatatcatgcagcatatttgggcagtgaaattaattagttaatgcgaaagaaagctagcttaacgcctttctgaattctgtgtttggctaaggccttgaggcttgagcagtaaccgttccttacagtaactaaccgccgttactctttccagaaatccaaggcgaaatagactactgaaggcgaaatagactcgtaaaagtcaaatttgaacttacatgtttgtgaagtgatatattatatattaacctaccttgtaatttttttttgatttttttcataatcatttaggtgacatgtaagaaacgggtggacgtccacccgagagattagaatccatcctctactcgccggtgtgtcatcgaactgctcccggatgtggaatctttcaactaaagcatatatatactagtagctatatgcatgtatccaatatagttctcaaccatatgtactgaagttctgatgagatattgatatgatgaaaggcatggctctctatgattctatccatgatttgcgaagtatcttactctctccatgcgttagaatttcgaagtagaaactctgctagctggatagaaataatttgaaaagtatggtcagaatttgcaacttggtttaggcggacaagaggcaccaacttttgtgcaagtcgatcagcaaacatcttgtaccctcatcagattggttctagtctagtaaaatactacactatggctaaaaaaaaacctcatgctggcgtggccgtggcattggaaatgattcaatcagtcgtacaaagagtagtatattaggcttggcacctgttttattttgtatgcagatttggagaggcaagtagagatttggcactagttattaacaagtgtcggtagactggaagagtcaaataggcgatggcgcattagtgcaaaaagattgataatcgtaccttttgatgtgtatcttgcaataattttttaacacgcacaagttctgcacccccagttaattactccatccgtttcaaattgatctgcatatttgtgttcatttattaggtctattcgttatttctgcattggagtaaatagacattgatgcatgcatccatgcacacatgtatttataacccacatgcaatatattgatttgctattggctaggaaatagtggggatgatgcatgtattaagtttgttgctagagtaaatatagtatgagagaattattagtttttcttagtcttgatgtacctatgaaatatgtagatcaatttggaatggatggagtactattttgtacttcctacttccctaaatgtttgacaccattgacttttttaaacatatttgaccgttcgtcttattcaaaaacttttgtgaaatatgtaaaactatatgtatatataaaagtatatttaacaataaatcaaatgataggaaaagaattaataattacttaaatttttttaataagacgaacggtcaaatatttttaaaaaaggtcaacggcgtcaaatattttaggatggagggagtagtaaatacagattggcatgcatggccatctatagatagaggcgttggtcctccaagacccaggaatgccatggccaccgccggagtgaccgagcacctgctctcgccgcgcgcaggcgcaggcgacgacatgagcgccggcgacggggaaggctggtgcaacgccctcgccaagtacgaggcgctcgcgtcctccctaccgtcttgccatggtctcgggagcgccccgtaccgcaggtacggcggattctggtacccggcgcacctgatgccggcgacgctggccgcgcgggacacgttcgtggcccgccccagcgacgtcatcctcgccaccatgcccaagtccggctcgacgtggctcaaggcgctcgccttctgcgtcgtgcaccgcggccgccacgcgccggccgccgggcagcacccgctcctccactccagcccgcacgacctcgtgccattcctgcactccatctacgagatcagccgcagctgccgcgtcgcgccaggccatcgcctcgatgccatgccgtcgccgcgcatcctggcagtgcacgaaccgctctcgagcctgcccgcgtcggtcaaggcgtccgggtgccgcgtcgtctacctgtgccgcgaccccaaggacgcgttcgtctcgctccggcattacctcgacgagatcaaaccagagggatccaccatgacgccgttcgacgaggccttcgagctgctctgcgacggcgtctcgccgtacgggcctatgtgggaccacgccgccgagtactggaaggagagcctggcgcggccggaggaggtcgtgttcctccggtacgagagcctcaaggaggacggcgtggggagcgtgaggcggctcgccggcttcctcggctgcccgttcaccggcgaggagcttgccggtggcgtccccgaaactatcgtggagctctgcagtatggaaaggatgagaaacgtggaggcaaatcgagacggcgagcacggggctacctggtcgtcgttcaagaactcggccttcttcaggaagggtgaggtcggagactggaaggagcacatgtcgccggagatggcgcggaggctcgacgacgtcgtggaggagaagctgcgaggctcccggatgtcgctgatccgccaccgccagtattgattgatcgaggtcgtgggtcaattgttcaagtcctcaagtgtgtcatgcttatgcagatgcattagcaactttattttcgtctggttttctttctctgcatcttgtgttgcatgcatggcttcgttgccatggcaacttgctcgatcggccaaaacgttgctcgggattgctaacatgggccaagttatttctttgaccacggtgaagcccgggaaaaccaaatattgtgtttttatttatgtttggtgatgcaactgatgtttcaaaatcaagataagaagtatttgaatggcataataaatggttgtcttttttatgttgaatgctccttttaccagcaaagcaagtcgagtttctaactaccagggatggttattgagtcgttgtctcgtcagtgtgtttttttttttttcaaagggccaaacaggttgcttggcgttatattaatagaaggagattaagcacacatcaaaagctgaagaaaaaaaaatgaaaaattgtacgttgctgactgcaaacatgcttgcacgttagaccaccttgcacctcatggcaacaatctcgtaacgtgttttgctccggccaaactccaacagcccaactcgtcctgaatttggttggcaaaaagaaagaactcatctggtcctatagcaagcagaagagttgagaccgcctggatagctatgcagcacaagacaatcccatgggaagtaggaagagacaactctcttttcctggtagagagcacgagggctagtttgccgtcattttacatgccatttgtacattcatcagttggaagtcattaccccagcaggccaacaatgctatctaggagatatttctgttactagcagccgcattacgtgatccacagataacttccctcaacatcaacacagacagcagcaatacatgatttcaccgtgttcgctcagaatggggacaaataatgtgaccgggtatcagcattgagcactggcattagcatggagtcctacagcgtaaaacaacgttgtcttgaaatttgtggctgctctgcctaacctgctagtgctgaaacgatgatcatttgtcgctgcgatacatgttgattgtatacgttcttagatcagctaccagagtccagagacgagcaaagagtgaagatgagcttagttgatcggtcgattccaacaaatttcactgcgacggtggattaaccaccatcaggattgaggaataaataagatattcctgcaaatgactcaattctaagcaatgcgatcatcgtggaaactgttttatcaatacgatcaaattctcatgatcgcttcattttatttggaggacatgtaaaatcatgtagtatttgaaatctaaaattgcatgaaaaattatcaaatcatcgccatttaatatctccctacatttgtatcgcgagtcaagtgaatacctttattccaaccgtgacaccggccattccggtcacagcttctccgtctctgcctccggcgaatccggctccgcttccgcctccgacgaatcgaccggcaacggcgagaccggcattacgaaatcggcgacggattcttcgccggcgagctcgcggcagcgccggagcatcgattccgactcggcggccctgcccagaacggagtagagcacgcattggcagaacacggggcggtagtcgccggggtcctcccgggcgagctcctcgaaggcggcgatcgcgtcgtccaccttgccgtccacgaagagctcctgcgcggcgaggaggcgggcgtattgctcgcggccgccgacgactccggcggcggcggcggcggcggcggagaggcgggcccgcgcggcctccgcgccgccgaagctggcgagcgcggcggtctcgacgattagcttctcgaaggggtgggggtcgtcggtgacgggatcgtcgggcgaggccgcgacggttacctccgggggaggagggggcggtgccggggtgcacgcgatggccgccggggaggtggcggcgaggatgacggcggcggaggcggcgaggcggagggaggagaggacggggtgcggggcggccgggttggagccgccggtggccttgacggccgcggcgaggacggtgcggcgccgggaggaggacgccgcgacggcgaacggcgcgcgggtcgaggcagcggcgaggaaggccatggcggcggctagggtttgctcgcggctcggagatttccaagcctcgagtagttatcgaaaaaaaaaaagagaaaaaaatatttgcagaccagaacagaagaatggcggagtttggtagggtcaagacttcaattttgaaatttcgtatgattcatgcgtttggtaggtggcggcgttcgcttctgacgaagcggagttggtagaaacctctgcatcacgctgctactctgcaaaacttcaaaaatttcgttgatactggatgtctggattaccatttgatccagcacattcgagttgtgctagcaattagcaaagcggatattatcagtagtaagcaattaccaatggattacccaagaatttttcaagacaaacattggcttgctcgctcaaaagagcgaggacacttgcttccattgttacaaaggaacaattggttacacgaaatcatcagcaccttgaaccaccaaggttagctacaggaggtgaaggttgtgggaaaacttcagatttcagatccctatctatacacattttgaacaagggttagagattttagaccatgggtcatccttttttttcatgtcctgggcttgcagccgtgtcactttgcaggcctctccatatttttagctttcatgttttcatccgttttcatcccctagccactgttgaggggatgatactgggcgagccgtagcttcgaagggattctcctcagaataaacaggacaagagatgaaggaagaatttcaacgatctgcaagtacagccaaacaggggataagaacaagtacagaatatatttagctggtattgataatggaaatcaatttctagctagaactgataacggggaaaaaaagttgatttcactgaggtaaacaatatggtcgcaggattcatgcgtaccaggtaatagatgaaattaagaattggatggtcaagcacatcaaggtcagcttttttgtcaaatgcatcaaagcacatctgcaaaacaaattgggcagtgtcaaaaccgctcaagtaagaaatggaacactgaaactcaaaaactcatccaaggatcagagaactgaaaaccttaccataatgcatcgtgccaagaaacaaaggaagcatatagtggcaactctcccaacttccctcagttttttctgcctcccttttgactcaataggaaaacgcttcagcatgaagaaaagcctgccaatcaaaacagggcaaatgaatgttaatgtcaaatgctagatgaagcactgaataagtggacattttcttgaaatactgttctacgtataagttattagtagactaaatggttcaaggttacatagtttgcagctagtctagccagccaatttggctgtctatgattgatgaaacttggttaagagtcattcagtaatactcttagtcctacctccctccatatagcagaaaacccaaggctgcagaaaaggataggcctgcaatgaacaacttcgaaaggactatcatagatgggtttggattgtgccacaacaacgcccacagcagaacctgaagaaataaacttgagtgagtattttgagatacgcagcctagcggaagttttatactaagcaagcactgaaccatcacaagataagtggcacaataacagctaaagttattcccttctactttcatccagtatctcattgtttcacatcagtgcatactagcaacagtatatcttttcttttcagggaaaaatggataagcgcatcacagcttttcatggtctataacaaatttcttgaaattcacagttccaaagaaaatatctgatcaccgcaacttgtgcaatagggtgtactattgattattgcaatgctaacggaattatacaaaatctgataaatagcaatcactaatcaatacagacttttagagataacttgctttacctgtatcacatatattacaccattaatagtgtagaaacctgatctaagcccttcagtctctagaccacgtgcttgataagatatctcagcccagaaaagtgccaacattgcatacgttgtgaagaatgcaagccccggaagatcaagaataacatgctgaaagatctggaataaaaatgaatgaagaatataactctggccaattgggtgaaacataacaattacaagacagaaaatagcaaagatgtccagacctcagggttcacttgttggacttggcggcggactgcaaagatagaacacctcgctgcagattgaaatcacattaaactcaaaagcacaaagggagttgagcatgtaacttgtactacaagtgaaattgaacaaatacctccattcacaatgaaattaagtaattgaaagaccttttgtgttgtccatccatattcaggaactctgtactgtatcctaacaacttggatctgcatatcacatgataagtaattaagtatgccttgtcttcctcaagtaaatttaatcatttaacagcgagcattcacatgtgcaccatatctgtaagcataggaactggatctgcagttcatacttcccacactaatgtagtaactactcattattcagataccaaggcataaatacacattattgtcctttgtactgtctatccaggcatccagcaggatttccggatatcagaaagataagcatggcagataatcacaagtccttgtccagctatctctatttcaaatcgcaggtttttcatattgattgatctaaagttctgtaaaatattcgtcctcattatcagcttttacaagtttcagatgcaaaacactggtatgctcaaagcacaaagctaatacaaaaccgtctttattcccaattaaactcgctgatggtgatatcgcaaatctgcggtattcccatcaaacaagcaccaaaaatcaagtctttattctcctgccatgaactcaagtcaccaacccagttggagtacgtgtattgttattccttttaccccttaatccatcttgacacaaaattctgaaagaatctttcccccagtgctttcgcataagcataactagagtatagtatcagtcaggaggactcaggaggaggaggaggaggagatgagcactgcggcgagatgcttacgaaggaggatgcggcgacgaggccgtagagagcggcgagggagaggaagatcccgtcctgccacgccgtcgagccgttcacgagatcccaccaccccgctccggcaaccggcatcggcgccgcggccgccatcgccgccggccgggcgaggagatcctttggagagggctcttcttcttccccgagtagaaatttgcgagctttttcgcgagattcggcggcgacggcgtggatttatatggacggctcgtgtcgctttcgttcttcgctcgaacagggcagcacaggttggggtggagcctggctaagattagaactctcaaagccgagtcgagtttggagaaaaaaaaagagtcgttttttgtgttgtttttggcgttaattttgttccagattcgagttattagcatttgattcgacacgggcaggtccagtttcctttgtttattggcagctaaataaatttatttactcgttttgcttttgtcatgtgttggttgggcacttggacgatgaaaagacacgttgttcacgggttaattaggcgctatcagggcagatataagtcggcatcaacgagatgaggaatgttgatagcttgattttgtggtttatgtgtatatgtagtgttatcatataagccccaatcaatctctagcctacccctaatccaagttaacataatggtcaagcttagtgggcataagtatctgagatgcgatgcgacggcatttgcattgttgctggtgtacctacctggcccatggggtataagataatatatcttcttgttctgtatctcgtgagggactgaattgttctgcatgccaagtcgtttggtgacagaattaagaacttcaggaagtggggaatacaagaacaatgctgaaagttcagagggtggaaattgttcacaggtttgtgagagcgaaacgaaagagcatttcctcccaaattgatcgcataaaaagtggatcaaattgcacgcgtgttcttatcatttccacaatccaatccagatttatttgtttatttattgataggaatccaatccagattgggtcactgttagcccatattccctgacaaaacgaacaaacagagcattgagcagctgcatcaaacttggtctgatgtgtgaactgaacttactcctctcgctgtcccaatgtaaaatatcttcgaaagccaaatactggtagcacctgtactcaatttggtctgatgtgtgaactgaagtttactctctttttgtcatatgtatacaatccaatggtcagaactcataactgtatttgtaatcagggaacagggtatattcgaaccttcttttccgttgtcaccgtttgcccctcacaccagaatcttcaccccacaccagcataagaacatatgcactgatgcgcacatatgcaaggatgggtcatcacttttggttggagacatttggatagtttgaacagtgctccttttcctagtcatcctctccatgttgtcctatccgcagacaaaaattactggcacagatacctcagcgagatcagccgctagctagcatcaacagttgaaaattttcagggccacccttttcttccccttgtgctgtcaacagcaagcatcgataccatgcagatgcccgtcgaatagtcaattcaaaaggatagcgggttaattagcaatccagttctactgctcccttccttttaattcatgttcataagaaaaagggtcgcatagtgcaattaattaagaacaacttgtcgattgataagcttagttcgaccttaattcctattcgttaatttgtctatcatatcaccacactctttgcacgttggattgctgagcaactacttgaccattactagatgatcgacgaagttagatttggtttttcatctcttattttgcaccactaattaggtcacttagcttgttcgatttggtcagatatgtatctgtcgctggcatgtaggattttaaataagattatattttaggtcacatgatggagcaggcgtggacgttgtcgtcgtggaagaaggcgagggcgtggtcgtcgacgatgtgggtgaaggcgtggttggggtaggagccgatcaccggggcgttgtagccgtggacgtagtacttgtgcgtcgccatgtaggtgtcgtcctccaggtactggatcgcgaacgggtagtactcgccgtcgtacggccacggccagaactccgccgccctccccgtccgccgcgccgcccggagcacctcccgccggtccacgtaccccgtcaccgtcaccttctgcgtgtccatgtcgatctccaccgtgctcacgcctgcacgcacgcacgcattttacacacgaaacacacacgtactggagtatactttacacacacgaaacagtactggcaccttcgagccgggacatggccttcctcacgcgcttctcgcagccctcgcagtccatgtggacgttcatctccacgatcttaggcacacatacacaaacagcactcagaaatgcatatggaaaatgtatagtactccatctccttctgacggtgcatttacatgttttactcacagacaaggcgtctgacgacgtgacgctcctctgcgtcctccagaaccgcagcattttttcttccttccagccggctgcgtgtgcgcgtggatatggatgtgcacgatatatcggagaagatcgcggagactaactaggcgtataaatactagcgctagcggacggatgccgtggtaagttgacatcaaaacacatgccgtgctcacgagcatgttgcaggggggatgctaatgctgaaggacggtttttgcttttggcatcatattcgggatcgatgcaggaactgatcggctgtgtgacatgttgggggaagagctagccatccatccaggcagccattctatcaccgagacacggatgctgcaggttcaggatgatgatgtgttattcacaaatcaagaatgaagaatctagccagtagccagggataatgttcggctggataatgtccagtagtggaggagattttggttcgtgagtggtcgtttcctgtcgctactcgcttaccattgtcttgctgcggtatagaacatatagtgggcctgattttgaatggacatacagattacacggcccagtttactcagtttctgctagcaattgcgcagacggcccaacctaactgactggaactttggactattgactgggcttaatttttgggaataagttcaccagaggtcccccaacttaaccacgagatttttttagtcctttaactacaaaaccagaaaggtatacccctaaacttactcaaaccattcaaagtttgtcccatggcagtatatatggttggtttcgctgacgtggcattctagtcaacaaaataaaaaataaaaaagttatggagcccacatgtaagtgaaaaggaaaaaaaaatatgggacccgcatatcttctttttctaaatcttctcctcttttctcttttctttcctctctcctcttttcgttcttatctttgccatagagggggagcgacagcgggcggccatgagcggctggaacaggcgggcgagcgcgcggcgaccgctagagtggagccgggtggcggcgatggcgggggagtgtgcgtccggagcagcgcggcggcgagagcatggccggcaaagtggaacggcagcggcgagagagcgcggttggcggagcggcgacagcggcggcggtgtggagcgggtagcggaaaccgagagcggccggagcaggtgggcgagcgcgcggcgaccaccggagtggagcgggtggcaacggcgtcgggcaagcgcgcgtccgaagcagcgaggcggtgagcgcgcggccggcaaagcggaacgcatctggcgaagcggagcagagcggcgacggaggcggagtggagcggggtggcggcagcggagagcggctggagcaggcgggcgagcgcgtggcggccgacggccgatgcggcggaggcgcgggtgctctgctgcgccgat

SEQ ID NO: 25531 - DNA, 16726 bp, Oryza sativa
gcctcccccccccccccccctctgctgcaaagataaaactaaagagaaaaaggaaaagagtaggagattgctgattagaatggttaaacccacattttttttctcacttacatgtgggccccacatatttatttttttatttttttctgactaggatgccacatcagcgaaactacccatatgtgttatcatgggaccttctttgaacggtttgagtgagtttaggggtagacatttctgcttttatggttaaagggatgttaaaaaaatctcattgttaagttgagggacctccggtgaaattattcctaatttttgttgcccattgtagccttaagcccaacgtcccgaattcctcgtccgccaaccgttgcatctcccaaaccaacgagaccgaaccatctcgctgatgaggcgcgcgtgtcagcgtgtgggacttgggataggatttcaccggcgcaagagacggtcggttcggcagccgactggctcgcgggttcggtattgcggcggaggaattttgcttggttaattctgagtgcaccgcgaagaaggcgaacgacggtcgacggacatgcgcggatgcggtcgagcacagcgcactacagtagcagccgcccggccggcatcagcgaacagaactacagaagtactcatgtgccaggccccaggggcaaccggttacggagcagcagctgcctgtatggtactgtatgactttttgttaattacaaccgtgctgtgttgttttcccatcccttttttatactagtcgaaagaagattagaagaaaaacctaataggcttgagttatttcttttgcaagtgacgaactatccgttctcgtgagtccgtgagttacactgaccacaaatgtgaagcaacgcctgccgacagctggtctgccagatccagcgaaacattagctattctctcttcaagaaatgaaaaggttgaaatgggggacacatgtaagtgactacctctcatcctcttcaccattcctctctctctctctctcttaatggcactctaactcctctccccatctccttggttcaatcaaaatgcagttgccttctatcaaccttggtggtaggaatggaggtggcgctaaagatgctcgatactttggtggaatggttcgctaagtagctctcccccaacgccaccgtacatctcgccactgatcagagcctagtattcaccgtgtgcttctaaggcttcttgctagaactgctcgccattgcccctcctcatgccacaacttgtccatattaagaatttcctccggcgtcattggcccaagccctccctctacagtgacgacgctaaccaccacttcccagttcccactctttgactacgtatagctcctccttaccgcatcgcccctcatccaagcatagctctccgaggcccttgtcatcatcgcggcctccaagtttcatactctcactgctatcgggcttctcacgacaaaaaggctaggttcgcctctgaccttggctttttcccatcccatgtccttcttcctaccacctctccgccattgttttcccaagcactttcctaatcacttggatttgctcggcgttgccactgtcgttgtgctattgtctgtcgcgtcgcgcgttgggccacactgttcccaatgtgacagcgggagagagagagagatgaggagagggagggataaggtggcagtagtgattttattttttatgcagcataagcaccgtgtgctagcgcaagtagatcaaaatcatcagataaaaacactgacctaatgccatgtaaccgtcacaccggataaaaccaccttcaaaatcactcggaaaggtaaaataagccagttttgatagttgaaggggacgatacacccagttttatcgttaattaaggtatgtggattagattcgagtgatagtcgagggactaaagattgactttctctctttcatctggcatcgcacgatgacgtaaggtccattagtcccaaaataaagaagtgcggattaggttttttttttcagcctggttcatcctagtttctctctttcgatctctctctgttgaacaagaaaagtactagttcatttgagctcgttccatcggaatatataaagaataaataagctgtgtaaggttcaaactgtggataaaattactgtaacgtccagatcaatcaatagacaaattttactagcatgcatgcatatgcgcagggagcctccacgctggactggccacaaccaataggtttaagaattttatatccatttcgtagtagatttttaaaccatccaatcgatatgaatcactcaaacacgaggtcttgtctttgtctaatgcatgatgccgtagtactatactttttttaaggcatgcatgccgtattgctgtaatgctgtagcacattatattgcgaatcataaccatactccacatgaacgtcagaaaccctgttcgacagctcaggtagagtagccaactgaaactctgaaagacactgtagcaaggtctatgctgatgtctacacccaatctgcagactgcaacttcttctaaaccaaatgcaccccccaaatgaatataatatattcctattactagttaataattaatttgatgaatgcaacctaaggcactcccaatttaagtagtagtactctttccgttcatttccccttcattcttaatctttatagtctataaatacataaatttgtgaacggagaggtgttctgaaagggtaagaaagaactcacggttggtcacggctccacgtagcaactttttatcgttggtcaagcaacggaaaagcgcgaaaaaatatacgaccctttccatgaattctgtgaaagagagagagatcgaggaggactaccaagaagggacttgattattaaataagtagaagaaataatatgtgtgttaaaaaagtaaacatagaatcttgggttgataccacacacactccttaccaatacactagctatttgcatctcgatcactatgatgaattctgacggatcatgttcacaataagatgaattcacccttgctctccttgacgttgtcgtattctgaaatagtagcaaagcaaaaatttatatactgtgggatcgattattgttactttatattttagtggggtcgtttgtgtttatttagtttaaaggatttacacgtaaaattcaatatttgtaagagtgtttgtttatctgtggagtctcccatgagggccatagcccataagaattcaccgaattgacgatccccccccccaaggcatatgcatgcattgttcttatcattgtaatgttgtcaccacactattactcacaaatggcaattggtatatgccaggttaaccctgggcccttgcaacaccgcctacattattccacttcatgcttctctacgtcagtttgtgtgtgtcggcaaggcgtgctggtgcaccgtcataactcctctacttgagaatgaaagagaacagatagataaagcaaatgatatgtagtctatcaatcaatctatttgtcttatttaaaaaaggataggtgcatgcctccactacttttgttctgtgatggtctggaaatttctaccaataaaagaatatgatagattaaagccattaattaaatcacgatgaattgatatggtcgcagattgatcgatcgttattatgaacatgtacacgttgccatgcaagtaaatcgagtgacgtgaaaaatagagaacggagataagagaaatatcattgacaacggctcaaagttaactcttactcctagcatttattaaaagaatttttgttgcatgggataaaaaaacaaagctaataaaaaatgttttttacattaatggttaagaggtcttgttgtctcaattattataggatgatattctttaagtgataccacctttgtatatgcatataaatgtaggtgtatttctatatagagataaacaataattgttttgagggaaatgagagctaattactggttatgtaataatattacaatcttgcatgctctaacacttgcttaacataaggcggagcatgatcatgccaaaccgcgcaatgagatgtccatttagcaaattgagcaaattcacgagctaccctgttacaattacaattttacttccaatggacttattagttttacactatttaatttgacggaaatctattcggccaactagttttgatagaactatagctatatatagtatacaagttatcttcatattttctagctggctccaatattggtttatgatgaggacatccttcactattacccgctggcaaaaacgcaaaagtcgagcggcgaccgtgtgagcctcagaataatcccaccttgcttagcttgggaggaggaagccatcttaaaagggagagccacccttcccctattggactcgtcttttagggagattggacctttccccgagtgggtgggcctaagaactgttggggtccgggcaaccttaatttgttggacctcggccaaccccacctgggccggattgtttatcatttggtatcagagctgggcccttgttaagggggtgggaatgataagttcatcctacactattacccgttggcaaaaacgcaaaagtcgggcggcgaccgtgtgagcctctgaataatcccaccttacttaacttgggagaaggaagctaccttaaaagggagagccacccttcccctattggactagtctttttccccaccttgcttaacttgggaggaggaagctatcttaaaagggggaggaggaagctatcttaaaagggagagccacccttcccctattggactagtcttttagggagaagctaccttaaaagggagagccacccttcccctattggactagtctttttccccccaccttgcttaacttgggaggaggaagctatcttaaaagggagagccacccttcccctattggactagtcttttagggagattgagcccttccccgggtgggtgtgcataagaactgttggggtccaagcaaccttaagttattaggcctgccggattgttatcagtttataatgttatgacatcgggaagcataatattagtttataatgttatgacatcgggaagcatgatattatacgcaatggtgctacactattcgagtcggtagataaaggattttttatttcattatggatgccacaatatttgtaggcttatttcttagaatctatatggttctttaagtttaatttatcgatcgattttctttgttagggtagttggggtttatcccttgatcacgtactgttattcagttaaagaacttattggctttgtgccgcattttagaggccgaaaatgtgatagctgaaaaaaaagtcatgttacttaatgatagtttgtaacggaatgcgctttttggttggtgtttggcagctcgtctctgtatagttgtactttctcaacatcatcatgatcatcaatattatttgcgatgggctcaaccatgtctttgctctatttggaatatatactgtacgtagtaggtgaatctacagtagatcagctagtgtgcatgcagcgctactccataattcccctttttgattcgtccatctcgcgcgcgcgcattcggtgtcgtggatggatcggtatcttgccggcaaggcaggggtcgcgcccgggccgggggccacaccggccggcgtgcatgtggatattccccttccacgcgcgcctagccggcgcgcgcccttgcttcattcgatctggcgattggccgtccttgtcacggcctcacgggccgcgggatgatgtacacatcctctctccgcgcgcacgtctgctgccgcctcccacggaagcacatgcggccgatcgggtggacgacgtggtggtggtggtggtggtgtaccggtgcgctctcgcgcgcgcgcgagagagagacaagaggtgggtggggaaagcgcgccgcgcgaaagcgacgtgacgagacggcggttcgagagcaggacggtggatggatcgcgcgcgcgcgagagagagagagaggaaacggatggtgatcatgaggggccagggcacatcgaggcatgcatgctccagcgagcctagctcccagcctattaggggtgggcaaaaaaaaccaaacaaaaaaaccgagaccgaaaaatttggtcatcaattcagtcatacgtaacgaaaaaacgaattttgttcggtcaattcggttaatttcctcgggtaaccgaatagaccgaaaagaccgaattataaaaaaaatgtctaaatgcaacctacaatatactatgtttaataggattaaactctattttttcacatccatacttcttctaggcatgcaagctaataagagtctttactcataagtgcttacgattttttttttgtgatttttatgttgaaaatttctattatttctttgcatatatgaaaatgttgttgaatttcggtcaggaccgagaccgaatttgtcggtcttaacattttttgcgctgaaattcgattttcccttttcaaagaccgaaaaaatcgaaagaccgaagatcgagaccgaaattttcggttagaccgaatgcccacccctacagcctatgcatgcagcatacatacacactatcatgcgataatacggcgtagtatgcacgatttgcaccctcactatcgatcgaccgcgatctgtgtatagcatcccatatctttacctattataaaaattaaagatatttttgccacaaattttcgtacgtctttctaatccaattctgtttctgttttgcggtttcgtttattctgtttagccgtttcgtttattagtgagaagaaaaaaaaagattagacaggtattgcaggcgagacggacagcgaaggggctgacgtcctcaatgcctgcctgggcctcagcccaagtaacgtatcagcccataatcttctaattgtgattggccatagagtatgctatttggtattttctctgtctcaaaatttaataattttagcctttagaatttgttcctatttaatttcacaagttttcttaatacttgtgtccaactataaaactttttatattttgattagtatggatgtagtaataaataaattaaactgaatttaaatttggcttccgtagattttttttggtccatcgtcgcacgcgctcgtgctgtccgattccaccacctcgcgtcgagcatgcgtcttccgtatcctgtgtaaaccacgcaaggctgacaaccacaagcaatcaaacccacgagccaaatatgaaacctccatttcaaaagttcccaaattagaactctaaattttcaaattcagatgatgaaaaacaccaaatcaacacgaaaggaagttggataaaatatatattcaaacgagttctcacagtagatttcacctaaactaaaacgtatataacaataataaaattaaaataaccttcacctgttgtaacgtacggatatttttctagtgtacatcatatatatgatagagagaggccgggggccccaaagacggcaagatcgatcggtggctttatgcgtcgtccgtcctctttctctcaatccagttgtgatgctacacaaagcacagaccgtattataccggatccgtttgctttctctgattctctcgccctcaacgaccaacacgtacgcgtctctctcagctgtcgtctctctcgtctgatccttcccttgccgtgcaagattgagcgcgctgcgcgcgtgccttacccggcccttaatgcagcttgttggcttctggttggatggttctactcacatgcgccaagtaagtccggaggtgcaggttggctagctgcaggctgcggcaggcgtaataccgtggtcactaagcatgcatgcaaggctgcgtgtgggacccaaaggattatatatgagcttgacttagggtgagtttgaggagagggggatcgagaagattgggaagatacgtaaaacgaggtgagccattagcgtataattaattaagtattaactattttaaatttcaaaaatggattaatatgatttttaaagcaacttttctatagaaaatttttacaaaaaatacaccgtttagtagtttgggaagcgtgcgtgcggaatactatgtacctttctcacccaatcccccagaacgaacgcacccttacaggccatatactgatcgatctatttcaccctggccatatatccattcaatcaatgcttttgaaaacatacaatcaaacttattgttacttcaactttattttgcgaataaaacttatttcaactttgatcatgtgatttttcggttatgtgaaatttagcgactaaatttgtagataaaaacgagaggcaaactctaaagtgaaataatctgtgaaaaaaaacacaacatctgacaatctgtgaaaaatgagaggcaaccgcctacgatcgataatagattttcgcaagctgttggatcgcccgcacgtgaaaatattgaattctgtagacacctacgtacaggcgggccgcctaggcccttgtgaagatcgattctgaccgcatgcatgcaaaaacatttttttgtactagtgcactacatatataaggtggtgaatgtgttggagtcatcgtaggaaactttatttaaggcagtgaaaatatataacattcatttcctgtatcatttatagatgcacaaggatttcaactctgatgcctacaactccctcaccacaccaaatttgtttcccccgtaacatgaaacagcaaactagagagatcttacataatccatatccgacaccacaatccaaaatctgaaccacatattcaacgtgatttttctttactgaaaaatcaagagatgattaattattacaggaacattatttttgaggatcatgctaattgaaatcatcaaggtatgcatgtttcaaacaacccaaaaaagtccttccggccacctaaccattccgaaaaaaaaaattcttagcaaacgatatggaaccaaataatcgaggggatgctgataatgaggaggaggaggagtttggaccaccaatcgagtccagtgatgggctggttaaagtccataggcctcgcattaacgagatggcttggaagcatgaatgccctgcatgccccatgtaccccagccaggcctgtctgttggccggagtcgtcaagcaggcactgtttggagtgagagatagatcagagagagagagagagagagagagagagtctcagcctcagagcgacgacggcgtggcatacagttgaacagtagtacgtacctagtcgccggtagagatggggtggagagagatgcgtggcccagcgcgcggcatgtcgatcatgtgcgtgtcttacttgggtcgcggaggcgtgggcctccgcccgcatgatgcagcttggaggagtagcggcagctcagctagcagagtagcaggtgccatgcggagctcagtgagtgctcactgcgcgactagcctgttgctctgttgctgctaagagagaggtggctagccggccagtccagctagcgacgccgctaactcccgcatgcatgccatctcgtactacctgtatgtgagctgatggagtatgtacctgtactgtattgcagctagcgtgtcgttacataacccctcgaaacctgcgtgcctggcagttcattaatcaatatacactttgcgatgtacggacgtagagagatcgagatgagggttataaacttatattaggcgatataagatcagggagttcagaactacactactagctcatggcgattgcagtgcataacttgtatttatcttacatatgtcgagcgcgctcgatctgtacaatgccatgaattagagtcgcgatcgtttaggcgagcacgtactcgtgcatctttttgaaaaatcaaatcatgcatatatgctgcgggcacatgtacagtcccatgtgccagtagttactgcaatgacttgtgccggccggtgatcccatgcatgtagtagtactgcatttgtgcaaattaatgccagctgatctacgttacgagcgatatgaatatgccaggggagatagcgcaatgcagtttgcaggtagcatcacgcaatgcaacaagaagctactcgaccggtagagagggagaggaagcatggggcagctgatgatcgagctagggagaaaccgagatcgatgagatgagaagaaaccgagacctcttttgggctgcgtggaaatggaaagcgaagcgcccccccccccccccctgccctgcctgccttccttctgccgctctctgaaaaagaaggggccttttgttttgcatgttctacgatagcaaaaggctgcccatctctttggcctctccatcagttttatctttcctttctgccactgcgtcccaatgacaatgcccatgcatgctcctctctctctctcacactctctctctctaggtgtgctcgcttaattgctttcagttgcaggtcttcggcctctaccggccaacagtggggagagggaaaagattgaacatcatgatgcatgtgtcaggtgtggaattagaagcctctgcagatctgtgtgagatggccatgtacccctgcagctgctgctgttcttactactactacgactaccacattcatggcgccagtaaatgtgagatcgagctagctagaagctagtagctgcatgcttgtacagatgtaacggtgtacgctacaccagcgtatcgccaggtatatatcaaccccatggtacgtacttgcagcgacacaacatgagataatcgtacagtgtacgtccgtatccataacactaactccatgcgacgtacttgtacgtacgtacggtgccaaccaaacaagcgatatacggtcatacggccggacgcggcaaattacacatactactcgccatgcacatcgagctactcctacacatacaccgatacacggtacacacacctatacgtctcgatcgatcagctatagtagtgtctagtgtgtgtgtgtgcatggagccatcaatcagtatgtacgtggttgggtgctagctactgtaggactgaagtatcaccgttgattttggggctgaaaggtggtactccccggttgatcagaacatagtcgcgtgcatgcatcgatctgtgtgtgtcgacatgaatgtgagcagtgccatgccatgcaccatcacccccagctagctagctcactgtcactgacacctcttcttccctggaccacacccggccggccagctatctctctctctctctctctctcgatctcacacacacaaaacagtcttttcctcactctctggctggtgggtagtgaggccagcagcgtgtatgtgtgcgtcaacatgagacttggttgttgtattgttgttgtagtagtagtggtggtacttggagcaaaggctggccgggcagccaggcagcaaaatttgggcccttaaaagtcatgtgttccctactgcaaaagacgtgtaagcttgagatttgcccatgcaaaaagttcaaatgatactcgaccatgcatccattttatgcatgctgcatgcatgcagcgtgctttggtgtagtagtgtgtgtgtgcgcgcgcgcgcgcgggccgctgcacaaaggcaaagaatttgttccgtgtgagagtgcgtgccatgccatgcattcacgcacgcgcacgcgctccatttcagcttgattgacagtttgacgctaaggagaaaaccagaaaaagggctcttgatccatgcatatgttgcatccatgcgtcctactactgatcttgctgttatgctgtatctcatgtgtgcattctattgctgtagagtagcagggctttgaaaataatggtactaattaatttccaaggtgagatgcatatgcatgcgtacagatcgatcgatacgcatgtgttaggttgtgtagcacaatatatatacatgtttatatactgtgcatagtcatccctagatggatatcgctatagacaagtggactgctgttcttgtgtgattgttactactagcttggaggcgatggtgaaacgcaacagcgactttggaatattttgggggttcaggcccaaccagcattaagtttctgcagtgttcagagacctaactctgtgctctaatgatccattccccttttactattccacgctagctagcttacgggatcatgcatgcatggcagcaagtgtttgaattatcaccacctgtgctcctttaatctgccctgacgatcgttcgtccctgtagctgtggcactgttattaacgaaaccgtgcatagtatcctgcagtagctagtgtgtgtggtccagaaactcacctttgaacgacgcgtatatatgacacaatttatgagcatcgtcgccgtttacctggactgtttagccagcttagagtttttattaccagggaagtacagcctaaaagaaccctagcttgtactgcaaaaatatatacatatgcaggggatagttgagcatatagagaagaatctctgccagcggtttagtgcgcatcaagagcggcctatggttatatcctttgccatagctaggtccctgtgtataaatgccccagtttaactcatcaccaggatgagtgttgatttgatttaattgtggggactatgcttgtcccagctcccaacatttggtttcgttcaaaatttcaatcaaatctccagtcaatatagtaaattttctattttaaaaaaataagacctcgatttagtttcgtgcgacggagacaaaactgcgattaactattcgcctattatatgttaaaatatctatatgcactcgttggccagatgaaaataatacaagtagttattttcactataaaaaaaaaccctaattaacctagttaggtactgtcattcccaactagattaggttttttttgacggagggagtactcatcaagagaatcaagcatgttgatctatctgccacagcgttaattataagctcaatgtaagttctcatgttaagtagaaagatctggctactaatttaagtaattcatatgtatcatggatcgatattaaataaaagcatgccattgaagatattaaagactacatatttttagtttttctaatatctaataattctaaaagtttcagagttaacagaaatatagttatacccatagtggaaactcagtttagtcctttataatttggttttgaaattcaaactaatagttagcaagttttaactatgtatatatggacttaatttacttttggtttagccaactagtataatttaaaaatagccagcatttggttaaatataatatatcatagtccacacatatacaggtcggtaactagtatatatacttaacttttttagtatcatatatataattttgtcgtttttataaaatatgcgacaactgtttctagtctgattatcgaacaactttacatggattatggcaatgcgaacagatagtgctctgtttttgttttcttggttcggtcccctacagtactctattatggagccatgcatggagggaaacatatcctctgacgttgcatgagcaaaagccgaaatgaacagtacggagtgtgtcttcagcgcgctttagccatagttaatctaaaccaaacatctcagatctacaggtacagtagggaagttaatttgtggcagccaaaaaacacaatagtgctgcaatacccttgaacacactaatttgtgttagtacagttgtgttgtgccgttcctctccctgtcctggcactgtttctatttaatttgtttccccctctacctgtgtttaagcaaatcgtacatatatatcatgttaattagcgccgttttctcttcctgattcgaacataggggtacataggactttgttgagtgcatgatgcagaattctttctgaagaaattctcggaccacttgatgctggatttaatgtatgtgcagaactgcactttacctccattaacttcatgggattcgaatcctcgcctgttatccccactctagatagctactactatagtgtaaatttcgtacaatttttgtcagccttttgctttcttataaaatgttacgccgaattttttagtaccatctttcgctgttacattgaatatgttagtatttaaaattagacgttctctttgattaaaactagcagcgaacactcaaacaagacaaggattcgaatttccagaattttgtaataaatccatcatattgttttttcttaaaaaaatagaccttttagctacagtaccagccacgatgacaccagtttactaccgcaacatcgttttcatccctttcacaaggttattatggcatgtccaaacccttaccacgccccattatcacatttaaggaggagtaatcaaaagttcacacatacgtttaaggaggagttatcaaaagttcacacatccgggagtatcaactaaggctgaattctttcttcacttttcaacacaccactctcgttttatacgtacacacttttaaaactgctaaacggtatatttttaataaaattttctacacaaaagttgctttaaaattcatattaatatattttcaagttatttttagctaatatttaattaattatatattaataaaccaccatatctcgaacacagcccaaatggctataacagtactcgatctaacttcgaagttaggttttgcaacttcaaaattacagattttgaccttccaactgggttgtagttgcttcattcatctattacatgtctcgcttggtttcgtcccaaaccaataaggcatgatgcaaatagcggtcacgtgcgtgtgcctattgcaaaaactacatatataacccgacaccgaaagttgctcgcttcttttccgtataagttacatgatgattatttcttttcaaaatgttattagaaaatgttcaaagaataataataataaagaattacaaaggtagcggcatctgccaaagccaatttcactagctaaacatctcatcaaaccatcgatcgatcgaagctgtggtagaccgtgcaggtcaatgcaagagattgcacacccactgacgacggaaaaacgaaatggacgtgccgcctgctatgtaaagaggttacagccagtactgctatggtttttatcgttacaaaagcaagccacatgatcaccatttaataatcatctgcttctagctgctatggttgttgttaaagagacgacacttgtatacaccttttaatctagatcatcatctaaccagactggccatgcattcagtcagagtcgttgcccctccatttttggtacgttggagctcgcatgctcctgggaccatatatatataagcgccttgtcagctagatgctcaagttcacttgctaatttaagcggccgggaatattatgcagaggcaataatgattaactacaaccgagacagtcgcctgctgttctttcttcagttcgtgtccatggcgatgcatgtttttttttcagccctggattgcctttttgttttaaaaaaacaaagtagtactacctcttgattaaaacaggttataggatgaaattggatttataaaaaacatatatctgctgcgcgaaggttatagttacaatttgctctgtttgatttattctggagtacttgccaggcactgaaaaacctgaagtacttcttcagtcgttttgattccaagcgccagagatatatttgtttctcccttctttttttgaactacattatctttataggactattgagatatccatggcggtgacaggcaaacaaagccggcaggtcagcatcgtgttaggatcttatcagacttaacctgacagagtaggaccggctgccggctgacggctgaaataaatcataaaaactatgtaccagattacatgggctacagtacacatacatgccaattaaggtgtacaggaactgcgtactaggtctagatccatagccagagcactcgtatagtttcctaaattgtatggggtaccaataaattaaggctgctactattacgaagcatgatagataggacgaaaattttgtcttacatgtactgcataagcacattattaatatcagttgggctcttggcaagtgtaaaccgtaattaattaatgtatctgattgctgggcaagggcagtcttaactgttactagtctagaacacaggatatgcgtgataatgttataaaaccggccccgaaatcacatcggaaaccaaatcgtgaaagaaaacgtcatagaacatctaaacataatgatgataccgagacatgatatttaataacggagttcagtcgaggcctacatctccaggacactaattacgggcgctcctctccccgatctagcatattacagtgtatccaggtatccacgaccctccacctgctaggtcgtcggctagtcgtacccacacacctatgctattgtcgtcttacggttacaacagatatgtccctctatttaagagagtttccaggatagagtccgattcttactctattcctatacctagtacaactccaagtcctaaactgtaactgatcacgtacacatatttgacacaaactttaatagacaatgttgacaagaaaaaaaatgttgctgatcgtgtcgcatacttaaaatatattaaacattatttctatgtaat

SEQ ID NO: 25532 - DNA, 3032 bp, Oryza sativa
  unsure (1)..(3032): unsure at all n locations
tgatactgaataagacatatcctagttctatgaatctgaacatgagatatatccagattcgttgtactatgatatatctcatccgataatagattgctatatatattgggacagaggtagtacttgaacgcggatgctttcaaaccctcatgtgaaactctaacaagataagataggtatatcattgaccgatataataggaataacacgtgttggctttgtttaatgtttttcccttcaacagagccagctgaaaacaagtgtttgcttacacaaatgatgtcagactaaggcacgtgaagatcatgtaagatcaatgtgtgttttgatttttattctgtgatgaacaattggcatctgtgattattggttttgatatttggagattatcgtcgaagtggttttggagataatcaattttcaggtgatgatcagattcactgttattttatgtgaccggtctgaccgggctgtgtatgccggtcagaccggcggtgatctagcggtcagaccggccggcccgcggtctgaccggccgacgctgtgtcggtttcggtttcgggttgtttctttggatatccgtgattgtttcatggttatggcttctagatggatactatacgtatgtaatactgttgtttgctaacaatgagtcaagttggtgatagcttggtctcggaatatggtttctttgtttgtttcatgtgtaggtgactcgatgcctcgggagagtatttgcggtgatgaaccgggagtcggcttggtggtaagacgatgtccgtggtggtcagatatcatgcgggatactaaggctagagttgatgcacgtggttggtgaagattctatatggcatacgatggaggtattgtgtgcgtatgggatgcggagtcgaatttggaaggagtccaaatttggtacaattggttatgtaaagtttgtatcttgtactagaggatttcctaaggtgtttaggactcttagtatgagtttggttcgtggctttaggctgcctacctcatgtataaatagagggggagcgtgaggcttcccggtatcgtttttgtatcgcttttgagagcaattgagttgctagtttagtcagggtttcgagtttagtcgaaatttttgtaaggagtgctgttggtgcactttgtaaacacagagagaagcaataaagttgttatctactttaagagttcttcaatttgtgtttcaccgggtttggccggtctaacgggcaattcacgggcggtcagaccgatggcattgtggcggtcagaccggcgcggcgacagcgagcggcaggcgactttggcagttcgaccgatcattttacatcggtcagatcggcggcatccactcggtcagaccgacagatcaatctcggtcagaccgatctccgtcgatttcgagggtaacttttatttccgctaaaagtttttggtttttgggtataccaaccattcacccctcctctggttggcttagttcttgtgattcgatcctacagatccttttcttgataattagatactaaccttagccacaaattattaaattccatgtagtagcaagagtgagagaagtgggcacccagagagtcacatgctcccttgacatatgcatatcaaatcaaaaccatctgagaagcatgttacatatctaccactgtctctgctctgctcaactcttaataagataggcatgttgaacagttgtactgatatactacgattctacgaataattaaagtttcggggagagctgcatatatgcggtccaggagctagctagatcgatatatagatatcttgaactcggccaaccatctctctcactgatctctcttctcctagctagccttgtactgatctgcctcccatttccccatcaacttttgtctctccacacatgcgaaggcacgcgtattgcacaagtgggaacgcacctgcctttctagccacactagtgtgtatcgttagggttttgtcggtttggaaagatgcctcatcacatcagtcatcagcagcagatcttcaacttggtgactactgagaaaaacctgctcaccttatacgtacggatcagttaaaggtagtttttgaccagagagatggccaaatgagaaccaaattctactactactgactaccattagggaaatttcaacctgtttatatacatatggtggacgaaaagggggaaattgtagtcggccaataagaatggaacaagaagctgaaaaatattcgcgtataagcatggttcagcccactactaattaactgatgtggacctatatttgctgcactaacgaccaagctacagcttaattagcaccaattatccggaaattaataaattgcaacctaagcaataggaaggatatgcaagacatttagaccagtatataacataattcctccggttataccccaaaagatgtttttttaattatacttttagaagtttataagatatacaattttgaccacttatttcttttgcataaataaaaaatagttataaacatgcatggagtatcatgaatgtttttcttatttatataaaacttaactatgtcatttgcatatacctacaacttgcataaaaataataacaacgttcaaaattaacttatgtttattgtaagaattttcaaaaaatatatatattttgaccaaatggagtagtttttatgtaaaataaaacgtcattttttttgtagaaatctagactaaagtatttgcttgaacataacatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 25533 - DNA, 526 bp, Oryza sativa
atgtgccaggcactgtgctaaggctggaaatacatgagaacaagatatataagttatctccttatgtaaaacctacttgcatatatattagtgcatacattagaatgtgtattccacctttattcataccagaatcataccaggacacctagatagttcagtaatgctttggctggcaatcgtttggctgtcagtgaagaaacctgaaaaacattaacttaaacgttaaggatattatctcatttgcataagaaatttgaaagagagtcaaccagggctgatgctctgaatttatacttctatcgattactcaggatccttctggctttctattgtgccacttctaagcatggaaccattggttctaagcttgcaaaacagcttctccttcttaaggtatttctccaggttccagactggaaaagggggaaaagccaaaggaaaaaaaaaggcaggtgctccccgaatctgagctcataaaagagctttctccaaacttaagagttttctcaataacatccattta

SEQ ID NO: 25534 - DNA, 806 bp, Oryza sativa
gatacattgcacatactccgaccggacgagatgcactgtctcatccgtatcatttgagaagcactcacttagttgttttaaaaaggagtttaactaaaaatcaattgtaaaaacaacagcctttcctttgaagccttcattaaacacataatttccatgacttgctgagtacacctgtactcacctatgctctatataaataatcctccccccagtggctaaagaagatgagatggaccccgctgacgaggagttcttccaggagcaagtcggctatgatgagttttggggtttcgatctggttcccaagtcgcgcctgtgatgttaggttcaagtcttggcttctgctttcctcttttgtaatgcagttgtgagctcggggtctgtccgcagcccaacatgactgtactcctactctataataaagagacctctgttgctgtgatattctgtcttcctgtgataccagctctatttcctgggattggtatcggttaacaggttaatttggagcgtcacaggctggttccgttcggggctagttcggggcgtgacataagtgaaaactgatggttggatttttattttttcctcataatttctataatttgttagagtgccacatgacgatataggagtgttcgtaggagccacatggcggtttaggagcgtttgtaggaagtttaatggacttttagtatataatagatagatggcattattggtatgaccttaggaacatcctcctttacctgctttttatcattctccttgttcttgtttttgttccttttcttctcagcagg

SEQ ID NO: 25535 - DNA, 740 bp, Oryza sativa
tgcagccccgttaatagaaaatggcctcttaaagaggagaagaaagataaacctgagacaactgaactgaaacggatggtagataggaaaaatatatggtagaaactagtgaaaccctaaaaactatcgttggattgagaattgataaatagatatttaagattcgtccacatttttcttaaacttaaacaaccattaatataaaacgatagagttcacgggaataaatctacattgccaaacagataaactgaaagcataaaaccatccgtttctaaagaatggggactgcactaaggccacaaacttcctaatgaaaccacacaacggagaaggtgcaaatcgacagggaggtgcggcaatgccgcgacgattgcgaccttgggcctcctttggcgtgcacaacgcttgacaaaccagcaatccccttcggttgcctccacgatgacggcacaaaatagaggtatgctactgagtcacaaattttggtgtaagcatccccatgctcagcaagagttgtccacggagttcgtcgttaaatctaaggagagtaagctcaacccgaacaacaaactctgcatggaacaagctgttaggaaacacatgggaagatggagcccaaatccaggttcccataaccactgaagaactcgaatggtggcaaacgaactgttgtcttcttggatcgacgtacgtggttggggaagcgtgtgaatcttgactaatggaaccttggcatt

SEQ ID NO: 25536 - DNA, 600 bp, Oryza sativa
cccaatggaaaggtaaaacatcacttgcagtaatctattgttggtcaatacagaaatattactttgaacttagcatggtattgccttatatatgttcaacaagtgtttatttgcatagctatgacgcagtggaactgaattctgtgcttgatcgcaggtacttgcagtgaagaagatagacagtgcgtcactttccttgtatgaagaagataactttcttgaggttgtgtcgagcatttcacgacttaggcacccaaacattgtgccgcttgcaggctattgtgttgaacatggacaaaggcttcttgtgtatgagcacattggaaatgggacactgcatgatatattgcattttttcgatgatacaagcaagatccttacatggaaccaccgcatgaggatagcactaggcaccgcgcgagctttagagtatgttattatttgagcactctagtgtttttcactctatgaaaaggttatgttaatcaagtataatgctacaatgcaatgccaacctttcttcagatacctgcatgaggtgtgcttgccccctgttgtacatagaaacttaaagtcagcgaatatcctgcttgatataga

SEQ ID NO: 25537 - DNA, 682 bp, Oryza sativa
ggcatggcatcgaggcgatggcctggcgcgacgcggcagctgcggctgatctcgtagatggagtgcaggaatggcacgaggtcgtgcgggctggagtggaggagcgggtgctgcccggcggccggcgcgtggcggccgcggtgcacgacgcagaaggcgagcgccttgagccacgtcgagccggacttgggcatggtggcgaggatgacgtcgctggggcgggccacgaacgtgtcccgcgcggccagcgtcgccggcatcaggtgcgccgggtaccagaatccgccgtacctgcggtacggggcgctcccgagaccatggcaagacggtagggaggacgcgagcgcctcgtacttggcgagggcgttgcaccagccttccccgtcgccggcgctcatgtcgtcgcctgcgcctgcgcgcggcgagagcaggtgctcggtcactccggcggtggccatggcattcctgggtcttggaggaccaacgcctctatctatagatggccatgcatgccaatctgtatttactactccctccatcctaaaatatttgacgccgttgaccttttttaaaaatatttgaccgttcgtcttattaaaaaaatttaagtaattattaattcttttcctatcatttgatttattgttaaatatacttttatatatacatatagttttacata

SEQ ID NO: 25538 - DNA, 21984 bp, Oryza sativa
  unsure (1)..(21984): unsure at all n locations
cgccttccatcaccaaccgttccaccaccacctcctgcagccgcaaccgccgccgccgccgacgacgttctactacgcggcgacggcctccacgtccacggtcaccacgacgaccacggcgccggtaccacagctcgctgccggcgcgccggtgctgttcttgttgcagctgctgtgtcttccacggctgaaacacaagccgtggtggcgacggcgccagaggacgccgcgtcagcgtcggcggcggcggcggcggaggaggaggccgcgtggggcttccacggcggcgacgaggaggactacgcggcggcgctactgtggagcgagccggacccctggttcgatctcttcctcaagtgaccgattccatgcatgcatgggagttcttggcgagctagcttagcttagcttggcgttccagctgaggggggcgtccatggcgaatgcatctgcatgcaacctagcttgatcagttcactagctaactagggtttcgatttgagattctactaattcatctttcttttttccttattattttttgctttcttcttcgtagtttgtttggtggggttcgcttggggtaatgaggtggtattgggaagatttagggtttacaattgatttaagattcgattttagtaattgaaaatccatttgcatgcaacatcaatggatgcatgcttaattatgacaagaatatgatatgtattttttattgatctttgtatataaatgagtagcaatgtttcaaaaaaaaaatctgaggttacttctaatcctgaacaatattgtactgttatctttttggtgcagtacgtagtctttatgtataggctagaactttgtgttctaatttacacatgcgatgtttaattaacacaagctatactaaaccccccactttgtttttttcgatctttaatttgatttacatgataaagagctgtcttttattgttaaattgctgatgttttaaagaacaattgatgatttgatttcagcagcatatgatctcatgcatgaaaaaataattatctccaatctagtttgtgttaattttattatgacaattgaagccatgtgtgccctacaagttatattctctattactctaaaatgttggggtagtttccttccattaacaagtgtgccctgtatcttaaaaaaacgaacatattgtctattttgctctttcaccattcgcagttctcgggtacattcccgacctccatctaatatatatgataaaaacatttaacttatggcttcttaaaacatatggttttcctgatgtttttacaattttatccaaatggatgttctgccttaacaattgagcataatcatatactcatatacatactagttcgttggagaaatttatttaaaataaatattgacgaattttttgtaaagtaaaaaaaagaatcacattattgcttttatttctgctgattttgaaggacttgtataattctaattctataagaatttcaacagatacatgattcctattttatttctccacacataactaattttgtctcattaatcaagcaagcatcatatatatctgtaaattactgattgcatttcccaatgagatgataaaccatcagttttgagttgtgcctttacattattaaaagtcatgacggtaatctttgcaatcttcgaactcctgatcgagtttcaaaatctcctaaattggtgtgcgcgcgatattgtgtgaatgtacccgttacatgcgtattgaacatttttttggtgttttccttgaaagatttggttttcttcaataatatagtacacaaaaggaataaaattaattgttgcataaaatttacttgtctcatctggccacaatccaggccaacagtaccgttaacttgcatggaagagatgatcaacctcttcagtttccttacctacctaggtatagctagatttcagtggcgttgaacaagacgagtcattagtgtagactcctttcattataaaaccactaacttaaagtaagaattatatattaggagcttctcattcggattatcctaataaatataatacatatgcatataattaaattagagatcttgatttaaaagccgaatttaagggagggcgggagtgctcgttaattgcatacatggtgctatgagatattgaaaaactgattacgcgccatattttgaaatggaatgagcaattaattgaatattaagtatcatagatgtttcatatataatagaagatgtgtatatatgcatgtaagtaattagcacatctcttctaaatttgttttttttaatcctcatctcaagatctctaatttaattggttgcacgtattgtatttgttataaaataattcagacgagtaggcgaaataattatcttttggtttttgggataagtgtattttggaatggagggagtactgatttttgtagatggtgagtggtgttgacttgtgtacttaatggacattaatttaatctcgggaatgaaagtttcttaagtgcgtgactggttagctaggggttggatgttctgaatcttcaatgcaaagatctgagcaaaagtgcttgggttttcctattttcaatcaatcatcagtactgagaaaaaccgttttcttgaggggaaaaaccgttttcaatagcaaaacgaaataaatctcagaattttatatattactcaaatcatctttatctctactattataaaaattaaagatgtttttgccagttcattggtatgtcattcgtgtatgaatcagtctttaaatttgtttgcttttgaaaatacatatccgtattttagtcagtttttagattcgttcgttttttgaaatacagaaggagttgtataagaaatctctttcaaaaaaactcgcgtactaacttgagatgattggattcctaaattcctaattaaagctcatgattttctaaaaacgtatatattcaaatgaattctcacagtgaatttcaacttagctaaaccatataataataacaagattaaaatagctgtcacccgatgcaacgcacggatattttttttctagtattaaataaaaactcaaaaataaatcttagtaatatattttattttcaagaccgtacctttttccctaaccatccaaacccgcttgtagaaacaactcctccacactacagtggtgtatgtaatgtagggcatggtttacacctccatttttcagcaaaaaattggaatttcggttgccaccaaagtttcaagaattttggtatttttagccaaaattatttgaaaaattaataaattgaatgaatttaaataaattttgatcaaattcataaaaaatattttaaaaagggaatttttttgggtggaaatacgtgctttctggtgggtggggggagggcgaaataactgaaatttcataattctgttccggaattgcaatccctgatatgacgtggtgggggatgacatgctggcggttgtcgatcggtcaagtgaatccgacgtgcgttgccacgccaatctgctcaatcctcacgtttcactcattcaaatccaacccgagcttcatcttctacatctttctgactgtttgaaaggcatttccatacgcggttgctctcccagatatgaaaaattaacatttcaagttttcaacacaagcgatcgccgatcagaagcggttggctaaacatctgtcagaaaccattttagccacctattaaaatggtttttttatagtgaatcataaaaacaccgccacttggcaattaatatttgcatatattgcttgccagttagagtatccgatggtacgaggcaccggccgcccttctggcccacatatatctcaacactgcgaaaaaaggaaaggtctcttaatttatcagtgagcctgaaattcatccatgaatcgtaatacgagacatgacgcgtccctcaattcttaaaactagtgcaaataaaatctcaagatggttagaacggtgatttcggctaacatgatatggcattgacgtggcacttaaagtaccaaaaacagtataacccacatgtatgtaagtgttggttaaaaataaaaaaaaaattgcaatgggacccacatcaacattccctcttttttccctcttctctcccatcctcctctctctccctttcctcgtccatgagcacccaagggggagaagaagccgccatggttggcggtggcggtgtcatgcaccttatcactttccgcctcgtagtcgtcgaagggcgcagtgataaagggcgagactaggaagccggtgaactcctacaccttgacacggatgttggaggtgttggtgatgagcacaaagttgggtggtcggcaggacactctccagcgcttcttgggcttcttggatggcaccaaaaggggatgtaacatcctggcccaattagtatttggcatgtgtggcccatgagggctttacggacatgtttagtaccaacttgctagtttaacaagggtggaaccaacttacaaggtctattccctccaaccatgccactcccaggttaatccttttacacgaagtaataacgaaagtgtaaatggggtggtatgtgtaaagtgggcccgcctatcggatgggctggctacacgcttatagagggagggttgttacagtgttgttaacacctaatttggcacctaggcacgaaatagggaaacatagccaaatttgcgagaggactgggtttcttatggaaggccggtctgactgccaccatcgagacggtcagactggcggttggagttggtttgaccagcagcatatggtcggttagatcggttgagttcgactctgagtccaatttcgtcaggtctcaggcttccatgtttaggactgaggcttttttagtcctaattgatctctaagcctaataggacatggaaaaggtccagtggaggcaagaccaacccatttataagggctatggctggttcgattctaaaccaccgacgacaacccctctctagttttgtgatgcaccaaggacaagcctaatagaacgtggaaaaggtccagaggaggcaagaccaacccatttataagggctatggctggttcgtttctaaacccccaacgacaacccctctctggttttgtgatgcaccaaagacaatcaggaaacttgagggcaacacaggagcttctaatttgaaaaaaagaaaatcaagaatcatcatttatctcctggaacacaactagagccgaaatggatatcttttggcttatctcgctttcaaaaaaggaggctacaatgtattcgagccaaagattaaatgaagacaaaagccgaagacgtgaggaacgaaacgtacaacaattaaagcctcaaaaaatacctaggcgagtgaggagacccaaagaaggaaaagttgagtgaccggtgatttccaagagtagtgatgaaaccaattcgttgagaaaagaaccatcggtcattagagatgaatctcttccacatgattctataggggttaacacaatgtttatcttaccttcgaaatcgtgcattcaacaaagccgattttgctcgggggcaaaatgttaatatgcttctaaggaaattaggagacacgaacgatgataggtacgacctcacatcttgaagtcgccatttgttgggtctaagtgcaaggtgctcggtgagtaattatctagttggaaatatctataccaagttgtgtgaatcgttcgtaagaaattattgatttgttaggatattacaaagagattgatttactaaacacttagaacctcatatggccgataaaaattattgccctaagaccacatgtcctatgcttttcggctcacaagttcgccaaaaaggcaggggtatgtgttaacgcctaaatttgacatctagacacgaaatagaaaaacattgccaaatttgggagaagatcaggtttcctatggaaggccggtctgaccggccacacaccgccgatctgattggcccaatggcaatgatcagatcggctgatgactctgaatccaaattttgtcgggtctcgggtttccttgtttgggcctgaggtttgttttaatcctaaaaatgatctctcatcataataggacgtgggaaaaaccctgtgaggcaagaataacctttttataagggctatggcaagttggattctaaactcccaaccacaacctctaaaattaatcgaatcgttttttttacctttactttgcagcatatcttctacactatcctagtttagtccatctttgttgatttgtgccataaatttttcgccttcactacatgagtgcgatacccctttgtagctttgtcttgtaaaccttctgtttcgcctacgagacgggtggttatcttcaaatcgatcagctctactagctggttaaatcttcaaaatccatcttggtttagagttttctagatcgagatgattggcgactccgttaacaccgcaaatctttaagtgagtctgtgttggtcagaaaaagcgccaacaagtacgacggcagtgcctgcgagggagacatgacggtgatggatgagaaggctgaggcaacagtgcttgcacgttttgggagctgagggacgcgtcatatctgctattgcggattatagattaaattcagactcggtgacaaattaagggacctagagtgaacttattcccaaaaaattcatttcggcccatgagcatgtagtcccaattatcgggccccagccctagctctataggaccgctcctgtccacatcttatcaaaaagttctgtttgttctttttatcttgagacggattaaggtagagaattgataatttttatatctttgtaattcgcgtacttgtaaataaagttacaagaaggagttctaccattttcaacgagaacgataaaataactctggaattgggccgagatacacatactcccctcttttgtagaaaaagtccaattctaaaaatagacaagtgcttgtccagataaattcttagaattaacattttttttaatacaggtaggtttgctcgttgttgtttggaattaacatgccattgttttaatttcacctctccaaaaattgtacttcttatttgatcctccaaatgttcttaaataaaaaggtcattaattgtacttcttatttagttaagctctacaattgattgtgatacatatttgttggcgaacggcttcgtcagactctcgcggcgcgctccacgcgcacgacgcgcaccccgcgcacgacgccgcgctcctctcgcaccactcgcaccgctgcacgtcccttagatcaggggattagttaggcccaggcaactcccaagccttgttgtacatgtataaatataagctccattgatcaatgaaagttacggttgatccaaatctccttctacatggtatcagtgaccctctgatcttagtcttccgctacctctcccttgctagccatgtcgcacagctccggcgcttccgacgcctcgtccacctctgacgaagagcctgtgccggcgccttccacctctgttcttcaaaccgtcaacatccgctcccacgtcccggtcgtcctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggcnnnnnnnnnnnnnnnnnnnnnncgtcttcgacgtcgtctacaagccccgcgcctctgccttcaccgtgtggagcgacatcgaaggcgtcttccgtgacaacgccgtccaacggtctgtctaccttgagaccgagttccgctcgatcaatcaaggtgacatgaccatcacgcagtacaccgccaagctgaagcaactcgccgacggctccgcgacatcaacatgcccgtgtctgagcccagccaggtgctcaacctcctgcgcggcctcaacaccaagttccgctccctccgcgccaggcatcaccgaccggaatccgccacacactttcatgaccgcgcgctcctacctgctgctggcggagctccagatgcagcacgacgccaaggctgaagccggggaggccctctacgccggcaccgggtcttcctccggcacctcgacaccaccggccagcctcgtcccaagggacggggcaagcgtcgtggccggggcggcggcgccccacctggcggcgctccttcgactcctggcggcggcgctggtgccgggcacgacggccagcctcgccctcctgcgccttggggctacaacccctggacaggctttgtccaggcctggcctttcccgttccgggctcccggcgcgggtgtgttgggccctcgcccgccgttccaggcccaacaggccatgaccgcgcagcacctgcttccggctcttcctccggcatctgaggtgtttcatactgttcgttccttctttgcttatgcacacacacagcaaacccaacccgcggtacgccatgactgccacgtcgaccctgtcgccgacaccttcgtctgttcgcgcggcgctccgggatcccaactggcgcgcggcgatgcaggctgagtttgacgccctgctcgcgaacaggacgtggactctggttccccggcctcccggtgctcggatcatcaccggcaagtgggtcttcaagaccaagcttcatgctgacggctcactcgacaagtacaaggcacgttgggtggttcgcgggtttaaccagcgcccgggcgtcgactttggcgagacattctcgcccgtcgtcaaaccagcgaccattcgcaccgtgctgacgctgatttcctccaagcaatggccggcgcatcaactggacgtttcaaacgcgttcctgcacggccatcttcaggaacgtgtcctgtgccagcagcccacaggctttgaggatgctgctcgcccggcggacgtgtgcctcctctcccgttcgctgtaaggtcttcgtcaagccccgcgcgcttggttcaagcgcttcgccgatcatgcaaccagcctcggcttcgtccagtcccgcgccgacccctccctgttcgtgctgcgccgtggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccgatgtcctcgaacgtgcaggcatggcgaactgcaaggccgtggccactccggcggacgctaaacccaagctgtcaagcgacgaggggcctctcttccaggactcctcctggtaccgcagcattgccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggaccaaacacatcgagctcgacatccacttcgtcagggagaaggtcgcgctcggtgaactccgcgtcctaccgataccgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcacgacgccgcgctcctctcgcaccgctcgcaccgctgcacgtcccttagatcaggggattagttaggcccaggcaactcccaagccttgttgtacatgtataaatataagctccattgatcaatgaaagttacggttgatccaaatctccttctacaatatttatctaaggttatttgaaacatagatatgagattttgtaaaaatagatctatgatcttgtaagaagtatttgagcctataaataatttcaaatgaaaaggttgtcaagtataatgttatagatcttgtccagatataaactttgtcttcgtccaactttatatgaaaataataggtgtagatatgtgttttttcattgattttcacacaagagtggcttaggccgcccacataaaagaataaattttcacatgtggaagcttaagccacccatgaaaatgatgtcatcttcattagcaggcggtttaatcatctgcatgtaaaaattggtaattacaaacaacgatggacagtaagacgcatgcggtgactttgtctatctcaaaatatatcgatttagtctcacagagttgctcatagtgatagtaatggtcgatataacccaactcccgaacaagtcatcaagattccttctatgcgtctccactactaactactatgctaactattgtcgatgcatgtaaaacatggttcaccacttaaagaacggtagtccaatagaaaacattatgtcattcagtcacaagatatcgtaagggcatttctaacagactctccaatataaaatttagccagtttgatgaaaaagtgcactccaacagctttgccaactggatggccgagccatccagctgagcaaattggttccctagctagccaaacttagccatcctgcacgactggccaaatcagatttccaaccatgggccccaagccgtcagacacccttcttcccctctctcttcccgcacccacacagaggagcatcgcaatcaccggtcgtcgtcgaggtcgccatcaccatccaccatccgtcatccgtcgatgctgccgaggtcttcgttgctagccacagccgccgccatctacgccgtcgccatccactatcgccagcctccgccaccttcatccgcgttggattcgacctgagcagcatggatccaggggggcacacgcgacctctgcccctccgtgctcgccggatttggccggcgcggcatggattcagggagggcacgacctccacagcctccatcgcctctgcgcggggctgcggttgccgtcgtcgttgccatctgccacaaccgcggctccgattgctaaccatccgctgcagctgccgtcgtcgccttggtcaccgacatcagtcgtcgccgccgttgtctgtgccatggccagccgccgtcgtctgcgctgtcattgctgaagattagaagaggaagagggggagaaagaggaggagaaagaagaaggggtcgtagagactgatatatgggtcccaatgtaataggcttagaatagataatatagatggagaggttattggaggaggcaatgagttcgacttgccaaattaattggatagctgattatatggatgtttggagagtctatatattttgaatagaatgttggagtcttggagatgctctaagaagtggtcgcccacttgacaacgttattaggcgttaaagctcaagggcgtcagtgcgacagtgcatagggatacgatgtatctctacctttatatgacaaatatgagatgagtgcggctgtgtttcgcaaaagtagaggtagttagccatagcgcaccgtgcgtaaggtaggacgtcctccttgagccgacgcagctctgacttgtgagcagcgagcggctgacctgaaatctaacaagagtcggtgtgggccaaggctggcagctatggatctcagttccgatccggctgtaaccaacgatgaaattcttctttcttttctccgactccaccatcaccaccaccaattaaaccgaccccacctgatctgactgactgactgacgaattgactgcccctgccgtaacggccgatgcagccgttgacaccacgcgcgtcgcctgcaaacacctgcacgcctagtcgcctcgtacgacgtaacacacgtaggagttgtacgcgaccaaaacgccaaacgccaacggtttggtgccccgtccgtcccaggcaggcaggcagcacagcgagcccaaccgccgcgcgccgcgcgcgtcgtcgcccgcccgtcggctgatcagccgtcgcgtccaccctcccccgcgcagccagctgatgtctcaccggccgcgcgcgccaccgcccgcctgcccgcccacgcacgcacgcacgcacccgtccgtctgccgcgcgcggcgcgtcgtcgtataccggttgctgctgctgccgcacacgattattcccggtcccgacccgatcgaaaaatgtgaaacccggccccttttttcgtctcttgtgtttctctgttttgcttgtattatctatcttgttagtttaattttcttttctacgaaaagctaacgtatggtgtgtttgttttgttactatataggtaataaagaggattaaagttaatattaatatcaccgcataatcctaattaaccgtggggactagagatatgaacgcatcattaatctctagcgtatatttatcacaggaagtttgcgatatatgaaatttctatgtaggattacccaagataactactcctagctagctaattttagttacgagaacggaattaattaactgtatactcctacctacattccgagtaattatatcaaacatagggatcaatcgatattgcctcataatttctagccatccaaccaacattatccctacaatcaaattaagcacacgctaaaggtttatgcatgtttgctaaaagaagaataatgcatattccaatttccagttaattaagcaacaactactaatgacaatcactttccttgccggtacatgacaagaagtgacatggcatgcatgggcagaagcagtagagtttgccagttgtccaagtaaccaagctagctagcagaaggtttgttacacttttgtttgatgcgctttccatgaaccaccggccggcggtacatactgagccaaaccgaaccgatatagatgtgacagtgaagctcatgctttgggccatctcgtccatgcatgctgctaaactaaccctgacagttcacaggtcacatacatggcgtacgtctccatctcgatatatctgtgcctgtccgtctacagcaaaaggatcgatcgatcgatgcctatcgccagaaatatgcgcgcgagtgattcctctcatggcattctcatgcgtggtttcttcgaaccttgtcatgacaagaggattaaggcttcgttccgaatggatggtgcgctagctattgggctgggattttcgttggcacgtaaaacgatacaagtcatattatatgattaatcggtttattgggtagaaaaaaattttatacaaaataggagtaaaccttaaaccgttcggaaaatgtgctcaccgagcactactacagaatctttttttcatgccgtcaaaacatgtcttctatgtgtctgcggatacacggatttttcacatacggatggtctaaccacgtgcgaaaacaaaatatcgcaagctaccctcttaaggtgtccacttgcgaatatacattatcgtagtcagtcacgttaagagccccgcctgtgataatcattttcccatatggcctacaatacattggccatttggaaaatagtgcccactacctaattaaatattttctgtaatttttaatcaaattttaaaatgttttttaaaatttctgttttatagtggtaatattttgcactacacataggacctatccaagaggtcgttcttagcaaatagtaatgcatagtaattaaaatcctgcatgcacaaataaatatgtttcaatatataaaacagaaaatatttatatatttgtacatataaacatatgtttgtgaactatattacaaatgatcgatctcgtttatgaaatagtatattttcagttcacatattctattccccgctctcgaaggtgattcattttgtcttctgcattcagttggctctcattgttgtaaaaaaaagacctagtgcattgcaacagtcatggcagatgaagtaacacaagccaatgcgaatgttccaaaccgttgccatgttgaacttgtttgcaacataagggatttgatgaatttgctaaaaactaacaatacatgttaggaaatgaactacggatgaaatactctgtatagagaataatctcgggacttacattatcagggtttgatttgtacttctcattgaccctaagcatcttgcacacataatatatacatagtacatagtagggtgcttgggggttgtttgaaacactgcgaacataataataacattgctcggtacaaataagtaatcatttgaaaatttcttgtacatgtcatgtgtaagtaccagccaacccgttttgatgtatagctttggcttttgctcctttattgccattccttctttaacgtatatcctatgtgcatcgtgccgataaaattatttcttgttgagttacttcaaaattttcagaataacattaaggtactcagggggtatttacttccaaagtcaaaatagtaaggaactctatgtagctattcttgttatagtttgatgggtcgagcactatgaccaagtaaaaacaccaccagatatactagaaataaaatgtagtggtcactgcaaataagatagatgaattagaggcgatatttgctagtaattatgtagtattgaacactaaccacgtaatgaaatagaagagttgctgcttacttaaagttgtatgggaaaattatgacatcttttgtcttggtgtgagcgcattgctcgttccaagtataccactacctcgtacttctttcgcttgtgcatttttttgatatatgattccttttccttggctatcttacctttagttccatgcaattcacatgcagctctatagtatgttgcgtcttgcaaatcttaattagttgggttgacatagccaaccggttgcctcgtcctatagaatacaacttaaatcaacggacatttgtttcctacatttatgtggaacatacaagagtaaacacttacaaacaaaatgtggtagcgagattgacatccattttctctagtttgaacaatgcatgtaggtgacacaaatcgattatgaatatcctattgagtccacacatgaaagcatcaagcgggaccttgacactaataaaaccgaggccctttctaaatgccttcatataaaattcatgtagcgtcctcatctatcatggtagttcctctaaaaggtgccacggtaagaatgacttatcatatttataatctctccaaatcctccttggcccatgcgaatgccattacggaccgcctggagcctggagggagcctcatccacaaaaatccattctgtattagtggagaatgatgcaatagccgccccaagtagttgttcatacaatgcaacctcagtaagctagcatgaaatacaactattagtcatgcttaagatttatagcagtatatttcccccttttttacgttaatgatacaagttattgcctatgttcaaaattatataatgcagttgaatttttttaactattcgtgttttaaaggaatatctaaactcatttactttaattgtaagatagaaatagaattccattaaactatacgatcgacacgataaatcacttgccaccagatcgaatagaaagttcaggtttcgttcaatcaaaacataagagcgagtacaataagacgatgtaaacgggttatacaagtccttaggagtggacctaggccccggaccacccaggctgccatccgaggcgtgaaggtctcatttaaacccatctagtttcatcatgtattagatgtttgggctaaaatcactatgggctgggcgggacccgtccaaagtccaggtccatccatacatacaacgtccttgtccgcccttaaataacagtaaataactctagtatttcacaagtagtaacatcttctccaaataaccatcaaaagttatacacccttttgaccatacacaacagtttaacccatctccggaatagtttacttttgaaaagttagaaatgaagtttcatgaagctatatgacacaataaaccaccttaattttacaagatcaaatgaagtttcatttaagttaaaacctatcgccatcatagactcgagctaaaacaagctaaataatggaccaattcactattgcatacatgttgacacaccgataacaaaacatatttcagaaaaaactacaattacacgaagtacatattcaacaataaaagatatataatataaaaatgtaaaattaaaaacaagctatctataattataaactcacttttttttgctattggtccccacaacaatcacatacattacgacatcacacacccaacgcaaggtgccaaacccttttaacagaaggaagacgtaacagatagccgcgctccgcagttccatctcccatgacacgtctcacgccagcgacacgctcgtcctgaaaaaggccagcaaatcctccacccccacatcatcccatgcataggcatgcgtgcggctgtaacagcgagaactgcatgtgccaacgctggccggggaagtgctgatcacttgacttgtagtccccatcaacactaccagcccaaacatggcaagacacacgatgctcctgcccgtacttaaatgacggttaaaccgctccagcatttcgcaagtaacatattttcccccggtaaccatcaaaaagttttacatcccttttactatacaagacgattcagcccccgtctctagaatggtttacttttgggatctagaaatgaagtttcataggttatatgacacgaccaaatacttgttactatattaaatgtatattaaatacaagatatgggttttcgtgtaagtcaaaatatatcaccttcatacactacagccaaaccaaaatcgaccaatctattattacatattttgtggacacatagataaaaaaatatatatattaaaaaattacaattacaacatgtacacatttaataataaaaatatatgtatatataagtaaaaggaaaagaaatctactctcactataaacctataaacctatgtatcactgccggtcctcacacacgacacacctaaacagatcaacacgataaaaagatcccacaacacacgcacaccacgacttccgtttctttgagagaaagaagacgtaacagccagcagcgcagccgcgcgcgctccagttccacttccaacgacacgtcccgaaaaggcccagcaaatcccctccccccgcacacacacacacccacatcaccccccgtacatgcgcgagcgtgcgcccgtaacggcggggatgagaaccgcatgctccaacaccggactccgacgaggaaagagagagagagagagcgaggagttggagctcgtccccatccaaccgtgcgtgcgtgccgcccgcgcgcgcgcctggcggttggtggaccacgacctcgatcgtcccgtgtcgtccaacgcaacgcatgcgggggaatggaaaaaccaccgcgaaaacgcccaagaaaacctcgcgccggaaacgcctctcgcgcgcccccgcccccgccccgtccacctaacgcgaacagacgacgcacgcgccgcgggctttatatcctcccgcgagcgcgagtccccatcgcgcggccgtcgccgatcgacgagatgctgattcacggggagggctcgtcgtcgtcggcggcgcgcgggggggaagatcaaggggtcgtggagcccggaggaggacgagcagctgagaggggcggtggcgaggcacgggccgaggaactggacgacgatcagcgaggaggtgcccgggaggtcggggaagtcgtgccggctgcggtggtgcaaccagctcagccccggggtgcaccgccgccccttcacccccgacgagaacgcgctcatggtcgccgcccacgccaagtacggcaacaagtgggccaccatcgcgcgcgtcctaaacggccgcaccgacaactccgtcaagaaccactggaactcctcgctccgccgcaaccgcaggaccgccgccgcggccgccgcggcggctgcatccgtgtggtaccagtccatggatctctcggaggaggccgacaacgacgacgagggcaccagcgacgactcggtggcgatccctgcgcagtcgtcgccggcggcggtcgtcgctggtgtccctgtgcttccgccgccgccgcccccggccaagaggctgtgcgtggcgccgcccaccggcgtggagcaccgggctccgccgcccgacccgcctacgtcgctgtcgctcagcccgccgggcgccgccgccgccgccatctcagcctccaccgtggtcggcgggtcgtcggcggcgcgcgcggaggaggaggccgtggcgagggagaaggcgaggatggagcaggacccgtggctgatggcgatgatgcggcagatgatcaccgaggaggtgcagcggcaggtgagcgtggtgtactcgctggtggcatcctccgcggcgatggcggcacagacgggcaacgccggcggcgtcggccggaaagggcccgacggccgcccatccaacggtcaggattgattgatcaaccgatcatagatctctaatcttgattcatcttcttgtagttgttgcattgcatttacattgcaaagccttttccatttccaactcaaaacaaacttgttgctgttggttagttcatcaattactccatttccatccttttgttactcaaataataatatatagtttattagcttagttagcttattaatctcatgtaattacttgagaattttgtaaggctcggttttttttttctcgtgtgattaaattagttagagccggtttgatgtgggtattgagccgtttggtttttcagttgggcggttcaggtttggttgggtggatagtactcctgtgtatcatcccttccttgaacaaaggcgttgtgcgtgcgtgcattcagtggcagcggcgtttcccaactgaaccgaaacctcgtcgcgcgcgcagcactcgccgttatcatttcgtttcgttcatcacattctttttttttcccggcaataatatgtaggagtaccgctttaagggtcgtttcgtttggtttgaaggattttgttggagaaatagacgatcagattcctatagaaattcacactattcgtttagggagaactggagaaaattctcctttgccatagattccaattgaaaaacaggaaaattgttttaaacccttgagtacttgtctgaaaatcattcaagtagttatgaaaaaaatctaaaaaaaagactgacaatagtcatacaatgtatatatatactccttccgtcccataatataagagattttatcccttctactagtctcataatataagagattttgcttcactgcttgtcacatccatcaattctaatttaaatttctacctattttaaccctcaactacccagtcaccacaaccagaatcacatttaatatgggtattgtagtcttttcttctcatccttaatctttcccaaaagagaataatcccttatattattatgggtgtgtttagttcacgccaaaattgaaagtttggttgaaattggaacgatgtgacgaaaaagttttaaggttatgtgtgtaggaaagttttgatgtgatggaaaagttgaaagtttgaagaaaaagtttggaactaaacaaggtgatagtgctccacaaaatcttataggtccaaacttacacattgatacacgaaaagaaaaacaaattcagcaaatgaatagtagtactatttatattcgaatttgtcttttttttatcattgtttagattgaatttgaacttggttttttcgcggagtgctagacgttactacactctacattgtcaatttttttaaaaaaataactatttgcattgaatttaaaagaaaatggtacacaagaagacatgtcctcaagagaatagaatccattactagaaaaaagtttaaatttcaacatctattagagcatctccagcggtctctccaaatgcctctccaagctaaattttagcaagtcaagcaaaaaggaatactccaatagagttgctaaccggatggctaagccattcgactggccaaacgtccccactgcctggccaaatgtggagaggcaaactcactggccaaatggcgggccccacaccactttgtgtctccgcctcctcatccgagcacagcaaaggcatcggtttggagcagcggcggcggacagggatggagctgaggatccaccgttggcattggcgtcgccactacatctcgatggtgtgagcagcagtagtaacaacgtcgttgtcatcgccgatttctgccgtagttgccaatttccactgccacctccgccgccgtcagatccacccgcccgcccacccgctgcctcccttgtcggcgtgagtagccgcagcccacggcatcgcctccgcctctcattagtgcgagcagcagcaacgttgtcaccgttgccgccgatttccgtcgccgccaacaccttcgtcagatttgcctacctgcccgcccaccgacggcacgggggaatcgatgagggacgttcacgtcgccgcttcccacccatgtcgccggctgccgcctggatccgcttgccgccatcgagctcgtcaaccgccaactgtcgcctgctctcccatgctgtcttggagcgtcggtgataggtgaggggagaggttgtgcaaagaagggagaaaaaaaggagatagggctgatgtgtgtatcccattgctagaatggagagaatgttggagtgaaaggcaaatttggctcactaattttttagatgactggccaaatgagcattttgagagctcaaaatagtcaatcggttggagatgctcttgcaacctactctctctgtcccaaaaagaattcaatctgaacagagggagtatttattattttcctttgccaaatctaaaataaaccaatgctcgaagctacaaacatcacatcccacctccccatatttttaaaccctctttttttttcatatgcgtttctatactattcctaattttttataaatcctatgttccaaaagtgcccatagtgattaggatcctaccttcaaaacccatatgtctctaacgttgaaggtataggatattaggatcctgtcccataggatattaggatcctgtcccaatgtcctcaccattatgtctaagtattttgctatgtttttattttgtaatggcatttcttttttttccctcattttacttgttcattgtatttgtaataagtttttttactcttatccaaatttttatgacaatgggttacaacattgctagaatttttatttttctaaaatatgccatgtcttaacttgaccacattctagtttctattttaataggctatatatatgttcggttactgtttttttttcaatcaatttattctagtttctatggagagtttagttccaaactttttctttgaactttcaacttttttnnnnnnnnnnnnnnnnnnnnnnnnnnnnnnnnnnnnnnnnnnnnnnnnnnnnnnnnn
